United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 25

SEQ ID NO: 135530 - protein, 189 aa, Glycine max
  Coding DNA Sequence Number=SeqID_43845
MIMRGQDIYSSQDEATTSPSSSESEEVKWEEFSEEIYPQEEGQPLMVKEKCKEVSVSSKRLAKKESHFAIKTNIKETSPLRQPLHLLLCKKTLVSTAIPLGLEIIPQLKDLLDEGLVRIMRHQIPMIGGMMNVLSGATLICKITHASNIFMIHIYRDSLAPLIELVRNHVPSWKMPRKWVFRPYLTPTY

SEQ ID NO: 135531 - protein, 41 aa, Glycine max
  Coding DNA Sequence Number=SeqID_43846
MDMAWELPDMPTVSCTEPVDEDTGDHIEDMIRNLGQDSFEQ

SEQ ID NO: 135532 - protein, 194 aa, Glycine max
  Coding DNA Sequence Number=SeqID_43847
MVSPQGRNTWTVDDLMPYVEKLAIISEEQERIIEPVSHGPTSEREFSAQEFHILQSSVETRGIGRRRELVEAEQYSQQMMERGHGMYYTPATFSQYPSQMYQYSFEGHHTDTSASEHSFGGVAETQSHFSWPTMTPSQQHDAPMATPNAPFALQWNVPEAIPHMGDLLGVDLRQEFFVEAEQAEAGDNAVQKKS

SEQ ID NO: 135533 - protein, 18 aa, Glycine max
  Coding DNA Sequence Number=SeqID_43848
MSVALSGRSLSQLIGLAR

SEQ ID NO: 135534 - protein, 75 aa, Glycine max
  Coding DNA Sequence Number=SeqID_43849
MDEDVWESVHLNVHGRQWNPVKPAPPWNPIRNTFICLLNQTININNCNLQLKVTYNLTNGHKLKGGLQIGDRKFS

SEQ ID NO: 135535 - protein, 90 aa, Glycine max
  Coding DNA Sequence Number=SeqID_43850
MVIDQSLFYDLTKLPSDGVPFEGTLNDDWKFDFSAHDARQLVCTNNADMTGRLLARSLAFESRILHYLIVRILLPRSSNLAQGVNLTRHT

SEQ ID NO: 135536 - protein, 210 aa, Glycine max
  Coding DNA Sequence Number=SeqID_43851
MCHFWGLSVSTNHRGVRRDLRMPARGKEAIPFFLILSFYGKNSESGQDLGTRIPRKRLEEKAEALANQGEWATFIDLLALLVFRTVLFPNVDGLVDLAVIDAFLAYHHSKESPIIAVLADAYDTFDLRCEKSSARIVCCMPVRYVWLRIRKAWNRVERKDKGGGEEAVRRWFLGRCSVPRMGHQYRAGPEKGWEGENVCGLSGSKPSQSK

SEQ ID NO: 135537 - protein, 191 aa, Glycine max
  Coding DNA Sequence Number=SeqID_43852
DDIISSEVHGISMIIDQSLFFSLTKLPSQGAPFEGTIVDDWKFDYSSHDACRMALRANAPLPYPQLVTLFLRHFQIPLDDEPFIQVKRSFAIGAGAVTSFRYRKDQDGQWLKKDALLPQDERTPLPPPQRDDSAFMTEVLSELRGLRTYVGERFDSLDNRFAGMDIRLTQIEEDVGYIHQSFYLPPPPPPS

SEQ ID NO: 135538 - protein, 103 aa, Glycine max
  Coding DNA Sequence Number=SeqID_43853
MEACLAVEDLLQLMIDQGRLEVGDEGGEEQHICMQSADEEGLRKPKPLVIYFTRDADPQMPRYPSVVRPIPFPYQNSHAVLWRYAPPSERKEKATDINSLSAK

SEQ ID NO: 135539 - protein, 173 aa, Glycine max
  Coding DNA Sequence Number=SeqID_43854
MNEGVSKESRSMVDNGLENLGLIMTIREGYNNGGDIEKYLNHVIVVEVDVDASYSERGSVECHVDMVVPTCEFYFRSQYGDGLLLVFGPYDKVQEKANGEGAHMQDNFFKKAHEGDSYNVMPLAKCYVSQQGQVFEFIKLLESSHVDGNKVALSLIQRKTYGSKVALSRIGQA

SEQ ID NO: 135540 - protein, 207 aa, Glycine max
  Coding DNA Sequence Number=SeqID_43855
MGDQEETQEQMKADMSALKEQIASMMEAMLGMRKLMENNVATAAAVSLAAEANPTLPAIAHHPLPNAVGRERSTLGHISNPHLGYNRVAYPYGLPPNYTPTVMRDDVGHVPSPVLEGEPPRQSDEVREDHREYAQVDVDFYLSVPVEGPTPNILPQPNLPAQPIFLSTEGPPPVAEDRRKLDLIEERLRAVEGFGDYSFANMADLCL

SEQ ID NO: 135541 - protein, 32 aa, Glycine max
  Coding DNA Sequence Number=SeqID_43856
MPQEKDPRVLMSLRRSIRGVRKKAQSFKNLGI

SEQ ID NO: 135542 - protein, 334 aa, Glycine max
  Coding DNA Sequence Number=SeqID_43857
  Gene Ontology: Mol. function=oxidoreductase activity, acting on the aldehyde or oxo group of donors, NAD or NADP as acceptor; Cellular component=cytoplasm; Biological process=amino acid biosynthetic process
  Homolog annotation: Hit_ID=A8GL84; Match level="QueryCoverage=100%, HitCoverage=100%, E-value=1e-161, Identity=84%"; Hit description=N -acetyl-gamma-glutamyl-phosphate reductase
  Pfam annotation: Domain name=GFO_IDH_MocA; Domain location=2-120; Score=-18.5; E_value=0.043; Accession=PF01408.13; Description =Oxidoreductase family, NAD-binding Rossmann fold
  Pfam annotation: Domain name=Semialdhyde_dh; Domain location=3-146; Score=208.7; E_value=1.4e-59; Accession=PF01118.15; Description =Semialdehyde dehydrogenase, NAD binding domain
  Pfam annotation: Domain name=Semialdhyde_dhC; Domain location=163 -311; Score=111.2; E_value=3.2e-30; Accession=PF02774.9; Description =Semialdehyde dehydrogenase, dimerisation domain
  Pfam module annotation: Pfam domain module=GFO_IDH_MocA::Semialdhyde _dh::Semialdhyde_dhC; Domain location=2-120::3-146::163-311
MLNTLIVGASGYAGVELATYLNRHPHMNITALAVSAQSPDAGKLLSDLHPQLKGRVDLPLQPLGDAAEWAGKVDVVFLATAHEVSHDLAPEFLKAGCVVFDLSGAFRVNDDGFYQQYYGFSHQHQAWLDKAVYGLAEWNHEQIKDAQLVAVPGCYPTAAQLALKPLIKAGLLNPAQWPVINATSGVSGAGRKASVTTSFCEVSLQPYGLFNHRHHPEIVAHLGTPVIFTPHLGNFPRGILETITCRLNAGVSQQDVAAAFHSAYHDKPLVRLYDKGVPALKAVVGLPFCDIGFAVQGEHLIVAAAEDNLLKGASSQAVQCLNIRFGFPETLSLI

SEQ ID NO: 135543 - protein, 110 aa, Glycine max
  Coding DNA Sequence Number=SeqID_43858
MYPLLLPQRMYPPMVLRQRYQPVKPLILCEWGYKRILSRRLVLYSFGKGRRETQKEFRRLVLGEFFLAKGEENEEMNSTSFQGLENQKTLESFWHKEEEEVQRDLGLVKD

SEQ ID NO: 135544 - protein, 155 aa, Glycine max
  Coding DNA Sequence Number=SeqID_43859
MEAMKEQMAAMIEAMYIMKEIMESNAVVVATTSAAAEVDPTHPSGLNQVNPLVLDMVGQGREALGSTSGPHVVQSKISFLPYGLPPNYSPPNAVPVPNEDVNNSAPIPIKSQQPQSNHAHVSQPMRETYEAPRDHNLADVEPHLGYATEGQAVGC

SEQ ID NO: 135545 - protein, 47 aa, Glycine max
  Coding DNA Sequence Number=SeqID_43860
MENSRIILLTYHRRYLKRDSLEDMHNQERNLKRKRNEENKDVQDDIA

SEQ ID NO: 135546 - protein, 361 aa, Glycine max
  Coding DNA Sequence Number=SeqID_43861
MAPRKLASKRSRKDKAAEGTSSAPEYDNHHFRSAEHQQHFEAIKGWSFLRERRVQLRDDKYTDFQEEIVRRRWASLVTPMDKFDPDIVLEFYANAWPTEEGVRDMRSWVRGQWIPFDADALNQFLGYPLVLEEGQECEYGQRRNQADGFDEEAIAQLLCIPGQDFARTAAGRRVRIMRTNMTTLTQTWMTLLLSNILPSDHNSDLPLPKCQLVYAILTWMSVHVAQLIADAIYLFVGMPPTRHLLDPDKSNRVCQSFGVPVAPSKVIRPPITRSFIEKYCTQRQAQGGDPQAPDAPPPPPQADPAESFDTERYLRHLVRQQAANHRAHVQTHDSLYQLSLSLQSQGFASFPCPTPDQFRRE

SEQ ID NO: 135547 - protein, 432 aa, Glycine max
  Coding DNA Sequence Number=SeqID_43862
  Homolog annotation: Hit_ID=Q6WAY6; Match level="QueryCoverage=58%, HitCoverage=49%, E-value=5e-35, Identity=34%"; Hit description =Putative uncharacterized protein
MEPLQMQAFRKTYGKILELTIAEVSIEAIASLTQYYDQPLRCFTFADFQLVPTIEEFEEILGCPLGGRKPYLSSGCLPSLSRIATVVKDSARGLDRIKQTRNGIAGLPQKYLEDKPRGMANQGDWVPFMDVLALLIFGVVLFPNVDGLVDLAAIDAFLAYHHSKESPVVVVLADLFDTFDRRCEKSSARIICCLPALCEVEQSVGSPRWKEGKEGVLFSCGRYPNIPLVGTRGCINYNPALAIRQLGYPMRGAPTEESMSPFLMRGIRNGIIGGYHEWLKVHIRGLEWLAKLKVVSEENFEAPEEDEEVQALKSELGKAKLAKEKFKLAATHVQKECAGLREENAISARALEQETKRARKEEYGRNKFRGALWGSNSELKLRREERDQSRAHSMVLKEELVACSRSKRSLSQRLCETETNMLAIIAKYQEEL

SEQ ID NO: 135548 - protein, 151 aa, Glycine max
  Coding DNA Sequence Number=SeqID_43863
  Gene Ontology: Biological process=cell wall catabolic process
  Homolog annotation: Hit_ID=A4WBA8; Match level="QueryCoverage=100%, HitCoverage=32%, E-value=1e-62, Identity=76%"; Hit description =Putative invasin precursor
LSADEVAATRSLRGSRYDSPERTSLPVMEFRQRKTLSVWLATPPWDLKGGETVMLKLQVRSTHGIRQIHWLGDTQALSLTSPAKSNSADGWSVIIPAWNEQEGATNRWHLSAVVEDEKGQRVSSNEITLAVVQPLVALPDDDPRWKLLPEE

SEQ ID NO: 135549 - protein, 77 aa, Glycine max; identical to SEQ ID NO: 124966
  Coding DNA Sequence Number=SeqID_43864

SEQ ID NO: 135550 - protein, 189 aa, Glycine max
  Coding DNA Sequence Number=SeqID_43865
DAGSRQARQGASAGVDGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPLQSMDTINPTPNPHPLPPYDPSEYHNLTQHQSETRQNGNDTNHKKSSKNNNQVKEETSNKHHYSCRWDP

SEQ ID NO: 135551 - protein, 15 aa, Glycine max
  Coding DNA Sequence Number=SeqID_43866
EANKAASNDKHLLQE

SEQ ID NO: 135552 - protein, 219 aa, Glycine max
  Coding DNA Sequence Number=SeqID_43867
  Homolog annotation: Hit_ID=Q6WAY6; Match level="QueryCoverage=97%, HitCoverage=40%, E-value=2e-14, Identity=27%"; Hit description =Putative uncharacterized protein
MVEEFEEILGCLLGGRRPYLFSGFYPSLARISKIDQISAQELDHRKQVENGVVGIPRKYLEAKARILAAIDVFLTYHNHKESPVVAMLADLYDTFDRRCEESNARIVCCTPALYVWLVSHLFRQEVRHACPLESHRSCTEKGGANWDQLLASKEEASVNWFPRWKEGRTGVLISCGGFPNVPLMVMRGCISYNPILAIRQLGYPMRGAPLEDGLAPVIS

SEQ ID NO: 135553 - protein, 100 aa, Glycine max
  Coding DNA Sequence Number=SeqID_43868
MSLVESFASQVLQGKVAEEPQLFAVSGAVAVVAAGLVEERMDSTIEGWDDSSTRDCTCCLRGHNCSVVANFAAEVEEIVAQRGKGLCGGRQRELNHRVWR

SEQ ID NO: 135554 - protein, 85 aa, Glycine max
  Coding DNA Sequence Number=SeqID_43869
  Gene Ontology: Mol. function=hydrolase activity, acting on glycosyl bonds; Biological process=metabolic process
  Homolog annotation: Hit_ID=A8GEN6; Match level="QueryCoverage=100%, HitCoverage=44%, E-value=5e-38, Identity=88%"; Hit description =Intracellular protease, PfpI family
MVPFQALQMIGHWVDAVCPGKAVGDYIMTAIHDFDGAQTYSEKPGHRFTLNADFATAKEEHYDALLIPGGRAPEYLRLNPDVIAL

SEQ ID NO: 135555 - protein, 53 aa, Glycine max
  Coding DNA Sequence Number=SeqID_43870
MEVEEPWLGLWLPLNYRVDMGVAFVIGSVVDRGSSRVDLQACKLGTGRRFTTS

SEQ ID NO: 135556 - protein, 58 aa, Glycine max
  Coding DNA Sequence Number=SeqID_43871
GRIVLGNDQRSRQGQRQKPIKVLRDRRKERLGSRPIGRHPWLSPGPTESVTAKQPSIL

SEQ ID NO: 135557 - protein, 48 aa, Glycine max
  Coding DNA Sequence Number=SeqID_43872
MKGTMHEPQAKLGADQKFLPGVERNPKGTSNALEVLTQYNPQTLFEPL

SEQ ID NO: 135558 - protein, 419 aa, Glycine max
  Coding DNA Sequence Number=SeqID_43873
  Homolog annotation: Hit_ID=A5AVJ1; Match level="QueryCoverage=11%, HitCoverage=13%, E-value=2e-11, Identity=73%"; Hit description =Putative uncharacterized protein
  Pfam annotation: Domain name=Transposase_23; Domain location=131-190; Score=-17.4; E_value=0.095; Accession=PF03017.5; Description =TNP1ENSPM transposase
PRLFWFFRRFPQINVGGDSARIPFLEDAPASNASPSRRRGHQDILNTAIGRSNHGGRVRAAGSGAWKNELKVSIITDIFKGDKVSTSANFDLNLLAPRMSTKESYVEIAVNPSGEEHVGRVTPSTGLYVQSQDCTKLVALQKIYDGPFTIHCVVYADDVVRVSVKKVIDGEAKVPFATSEIKYVREALNTFIAWPLPLVKLVSNEHSGMTPNKVAKVAELNNDVPKQDPLCELIKTLIKIYDKPVEFVWDLTEFGIPNVNSSLFLMYTDVSEITSDDKCLNIAIHSHTSIVDHTHVQCGGYECGYYVMHWMWNIIGAELKSDWSVWFGDGLTLDPEAITTLCKKWAAYFLKVLSSCTRGRKHTVVTAETIKIEIDSKFLELQQIMDYSLLLGVHYRAPQQLHPYNQSRNADGLAILAEE

SEQ ID NO: 135559 - protein, 69 aa, Glycine max
  Coding DNA Sequence Number=SeqID_43874
MGDQEETQEQMKVDMSALKEQMASMMEAMLGMRQLMEKNVATAAAVSSAAEADPTFLATTHHPPLNAVG

SEQ ID NO: 135560 - protein, 278 aa, Glycine max
  Coding DNA Sequence Number=SeqID_43875
  Homolog annotation: Hit_ID=A1FUM5; Match level="QueryCoverage=50%, HitCoverage=97%, E-value=1e-68, Identity=89%"; Hit description =Putative uncharacterized protein
  Pfam annotation: Domain name=DUF1801; Domain location=160-270; Score =127.2; E_value=4.7e-35; Accession=PF08818.2; Description=Domain of unknown function (DU1801)
  Pfam annotation: Domain name=DUF1801; Domain location=29-138; Score =96.5; E_value=8.3e-26; Accession=PF08818.2; Description=Domain of unknown function (DU1801)
  Pfam module annotation: Pfam domain module=DUF1801::DUF1801; Domain location=160-270::29-138
MPAKRTAPSAAPTLLSGGNPQIAKGEGNAPVQAYIAAMPDWKRLIGEQLDALIEQAVPGVHKAVKWNSPMYAVAAGEGWFLSFHCFTRYIKVAFFRGAALTPVPPEPSKSADTRYLHIPQDGALDEAQFLDWVRQAAALPELLMATHAPNPADAGTPATELIDARIAELGDWRGEVLARVRALIHEALPDVQETWKWRGTPVWEHNGILCTGETYKQAVKLTFANGAALADPKGLFNASLEGNTRRAIDIHEGAMPNAAALKALLRAAAAFNAAKKKR

SEQ ID NO: 135561 - protein, 180 aa, Glycine max
  Coding DNA Sequence Number=SeqID_43876
MGDQEETQEQMKADMSALKEQMAAMMEAMLGMRQLMEKNAATAAAVSSAAEAGPNSLGNCAPSSLKHTAYPYGLPPNYSPPVLQDDAGHIASLVLEREPPQQPEEVYKDPQDYARRDVEFYPPIPEGPAPSTLPQPNIATQPIVFVHERTAPGTEERRKLDLLEERLRAVEDLGTIRSQT

SEQ ID NO: 135562 - protein, 83 aa, Glycine max
  Coding DNA Sequence Number=SeqID_43877
MYYTSPTFSQYPSQMYQYPFEGHDTDMSASEHSFGGVDLRHEFSAEAEQQGRRQWARRNPDREARRWDRPCGTGSRHHGHHND

SEQ ID NO: 135563 - protein, 96 aa, Glycine max
  Coding DNA Sequence Number=SeqID_43878
MKLLRGKEIALVKVQWGPDEGDSTWELEDKVRELYPEKREELELERRHANRDRISASKKVQFFSSFMAEYVVKSKVRVDFSSLEICGCWVLGSYNG

SEQ ID NO: 135564 - protein, 22 aa, Glycine max
  Coding DNA Sequence Number=SeqID_43879
MASAFPCVDPISRELDELIRLR

SEQ ID NO: 135565 - protein, 191 aa, Glycine max
  Coding DNA Sequence Number=SeqID_43880
  Gene Ontology: Mol. function=aspartic-type endopeptidase activity; Cellular component=chromatin; Biological process=chromatin assembly or disassembly
  Homolog annotation: Hit_ID=A5AQE0; Match level="QueryCoverage=70%, HitCoverage=10%, E-value=5e-19, Identity=34%"; Hit description =Putative uncharacterized protein
DPIRKIVPQGTQEDEIVESEDHHLSFNALKGGRGVGTIKFIDYIENLPVTVLIDGHAQGNTFQLPIFLLPIFGVDLILGASWLKTIGSHIADYDALQLKLLWKDIVHKSMLDLPVMMEPELALLLHTYSVVKPYRYPYSQKEEIERLVSRMACIDYKALNAITIKDNFLIPTVDELIDEFFGASFFSKLDL

SEQ ID NO: 135566 - protein, 98 aa, Glycine max
  Coding DNA Sequence Number=SeqID_43881
RFCFFTKACLHFSERTPRLFSLTPLFVEAKLHDESRLIQRCFDDNKGDDKKLNGQPKNEFKMFKIESRTLQDSRGKLNSRIKRRLNHDKYEKVFSKTE

SEQ ID NO: 135567 - protein, 133 aa, Glycine max
  Coding DNA Sequence Number=SeqID_43882
  Pfam annotation: Domain name=Transposase_23; Domain location=49-119; Score=14.2; E_value=3.3e-05; Accession=PF03017.5; Description =TNP1ENSPM transposase
  Subcellular localization annotation: CTP_CleavageSite=32; ConfidenceScore=5.07e-01
MASFSQLQSQMQSQGLAVPLEPLVGLGPSGPRVSTKGSCVDPSGNDAETGDSDRCGLYIEADPARLVAVGKVYEGSTLVHNTPLLPGQVKVSVDEVKDADAPVPIPTDEVSLVGQALHNFLAWSTHLVKSLLH

SEQ ID NO: 135568 - protein, 217 aa, Glycine max
  Coding DNA Sequence Number=SeqID_43883
  Homolog annotation: Hit_ID=Q5QJQ3; Match level="QueryCoverage=47%, HitCoverage=81%, E-value=3e-55, Identity=99%"; Hit description =Putative uncharacterized protein
DAGSRQARQGASAGVGGCRGWLNYAASEQIVLRVHHMRAIGAGLFAITPAGERGMCCKAIKLGNARVFPVTTLSTLEDPHQFTTDMMVLLEFHIFTLGRGTELEFVIMVIAVSCSAPLTSITKIDAQVRGGETRQDYKDTRRFPLEAPSCALLFRPCRLPDTCPPFSLREAWRFLIAHAVGISVRCRSFAPSWAVCTNPPFSPNAAPYPVTIVLSPT

SEQ ID NO: 135569 - protein, 62 aa, Glycine max
  Coding DNA Sequence Number=SeqID_43884
MVHIGKCALKGFNDSQGSKSKAATRWIVVKYFTDQIPLEPKRMKAICIQWARYYLKVKNQTL

SEQ ID NO: 135570 - protein, 88 aa, Glycine max
  Coding DNA Sequence Number=SeqID_43885
MARSSEKKDPKELELLELEGDERFAGSSKSDRRVIPIPTILFNISQINGWAQGSKVRESDVTPRALHKAVIRAGKPSLEESCCAMREI

SEQ ID NO: 135571 - protein, 72 aa, Glycine max
  Coding DNA Sequence Number=SeqID_43886
MMHALDLNSQMQCGMYRIQYQGNSPKRVYTTPHLGNHAVFVEGRPTRSMHPPMDIHDIRRMNVDTIKYSDHG

SEQ ID NO: 135572 - protein, 140 aa, Glycine max
  Coding DNA Sequence Number=SeqID_43887
MDNEEGVQEQMKADLSALKDQMASISEVMLKLQKTIEDKVTTIASSTVREVEPVLQPALNPGRDRNTAVFGRRYSPQAYPYGLPPDFTPRAAPEDLSQAPTFEGHSNLMMTIPGKTMRKEIPILGPCSTSKIRPPMNYPN

SEQ ID NO: 135573 - protein, 164 aa, Glycine max
  Coding DNA Sequence Number=SeqID_43888
MYYPSYHQHQSYAEPNVPPVHVLGFMSQHHPSQAQYQSTSFSGHASQGCQQSFQPLGFSSYIPQYSLKVPSTSNVFYGSSQMFATTFNTPPSTYNLAPSSSCYCSSLPTQICDMSQEDEDEDEDNNNNNDDNDDGDGVDDDDNNGHHVPQQQRTITRQHPRTRG

SEQ ID NO: 135574 - protein, 102 aa, Glycine max
  Coding DNA Sequence Number=SeqID_43889
  Gene Ontology: Mol. function=helicase activity; Biological process =protein amino acid phosphorylation
  Homolog annotation: Hit_ID=A2Q206; Match level="QueryCoverage=99%, HitCoverage=24%, E-value=2e-20, Identity=53%"; Hit description=Beta tubulin
  Pfam annotation: Domain name=DUF889; Domain location=1-99; Score= -93.3; E_value=3.8e-05; Accession=PF05970.5; Description=Eukaryotic protein of unknown function (DUF889)
KEYCSVDSVDKSDELLNPAFGVLTLEFLNTLKTSGIPNHKLRIKIGTPIMLLRNLDQADGLCNGTRLIVTKLGTNVVEAEEYSSSAGTGKTLVNIKNAVSRK

SEQ ID NO: 135575 - protein, 75 aa, Glycine max
  Coding DNA Sequence Number=SeqID_43890
TLVSIATSLRLEFIPQVKELLDEGLVRKRLNPCALLVPKIGVKGRSPEYQEPQDLRSNPFQGGGNDAILLRKGIG

SEQ ID NO: 135576 - protein, 46 aa, Glycine max
  Coding DNA Sequence Number=SeqID_43891
MEREEKSEEVENGGGDDAFPEPQNVVRFDSKNPCASLMVPPFEEVL

SEQ ID NO: 135577 - protein, 226 aa, Glycine max
  Coding DNA Sequence Number=SeqID_43892
  Homolog annotation: Hit_ID=A5AZ88; Match level="QueryCoverage=45%, HitCoverage=8%, E-value=3e-07, Identity=34%"; Hit description =Putative uncharacterized protein
MSASDHAILQDRTHQPMKKSLLELSSHDALLAQNKLLSKQLEILTETLGKLPTKLSMGQPTHSSVLQKTLKKFIIWEINNNKGILKEDFQASSRVPIINKDSGGHTLATNSTKTRVDLQTGQIQKGPNIFQRITKLEETFTQFMQQNPNKECKAVMTRSKRFVEAEDEDSVVHKKETADKKGTDGKKNEENIIVDGNCSAVIQKILPPKHKDPGSVTIPCSIGEVN

SEQ ID NO: 135578 - protein, 107 aa, Glycine max
  Coding DNA Sequence Number=SeqID_43893
MHEQRLTINSWHSGLDGGGCMNDNQFMGFRIRFDDGGCTNSARQSIPLGFRTQWWRMHERRSIHGTPNKIRWWRMHEQRLTINSWGSGLDGGGFINGNQFMGLPNKI

SEQ ID NO: 135579 - protein, 232 aa, Glycine max
  Coding DNA Sequence Number=SeqID_43894
MTPSDFGLRSKELYVRVVHQGGQQEVYHHAFPASKLTAKYPGMCVARAQVFMAPHQAVLRPEEHLLLGHKYVVISCTDVEKLKRKHPQQCKTKEHNGVVTSEVNIISECHLSGHKPKENDKLSVPNEMINTRITLSPTPSECKIHENGEVKEPNILGKEKVNAEKDVCQGGEDVEVHCSAKDFYVGKDKLSRYSRRKGIKVKKPFLPPLPNGRSYRGLGWQPSLVTVQELSL

SEQ ID NO: 135580 - protein, 487 aa, Glycine max
  Coding DNA Sequence Number=SeqID_43895
  Gene Ontology: Mol. function=transferase activity, transferring nitrogenous groups; Cellular component=soluble fraction; Biological process=biosynthetic process
  Homolog annotation: Hit_ID=A8IKE5; Match level="QueryCoverage=100%, HitCoverage=100%, E-value=0.0, Identity=97%"; Hit description =Alanine aminotransferase 2
  Pfam annotation: Domain name=Aminotran_1_2; Domain location=60-467; Score=59.2; E_value=1.4e-14; Accession=PF00155.12; Description =Aminotransferase class I and II
MPPKPLDYGSINENVKKSQYAVRGELYLRASELQKEGKKIIFTNVGNPHALGQKPLSFPRQVVALCQAPFLLDDPNVGLLFPADAIARAKHYLSLTSGGLGAYSDSRGLPGVRKEVAEFILRRDGYPTDPELIYLTDGASKGVMQILNTIIRGQDDGILVPVPQYPLYSATIALLGGTLVPYYLEETANWGLDVNELRQSVEQARFKGITVKAMVIINPGNPTGQCLSEANLREVLQFCYQENLALLGDEVYQTNIYQDERPFISSRKVLMDLGPPISKEVQLISFHSVSKGYYGECGQRGGYFEMTNIPPEDLLTLHTVDEIYKVASISLSPNVPAQIFMGVMLHPPQPGDISYDKFVRESTGILESLRRRARLMTDGFNSCRNVVCNFTEGAMYSFPQIRLPPRALEAAKQAAKVPDVFYCLKLLEATGISTVPGSGFGQREGVFHLRTTILPDEEDMPAIMDSFKKFNDEFMEQYEDNRGYSRL

SEQ ID NO: 135581 - protein, 346 aa, Glycine max
  Coding DNA Sequence Number=SeqID_43896
  Gene Ontology: Mol. function=structural constituent of ribosome; Cellular component=ribonucleoprotein complex; Biological process =translation
  Homolog annotation: Hit_ID=O82529; Match level="QueryCoverage=42%, HitCoverage=100%, E-value=4e-63, Identity=78%"; Hit description =Ribosomal protein L27a
  Pfam annotation: Domain name=L15; Domain location=307-340; Score =43.1; E_value=9.7e-10; Accession=PF00256.14; Description=Ribosomal protein L15
MAIIQQDKTTCKQHTESRDEEEACKLITLSGVALQGSLNTIQIVYVTPKQVTSFHFGALSQVPKKFLPHWVAIGPVPNTYSLAAITQSTSFFFGLVGTCADPLDWNGGGFDQTTMMIFKEHYGRNVFGLNRLSIKVPQTKLHADLVEGGGNATGREGGGREEEEVRRGPVAHSHEQLTPNPNSINSPNPQTLILPQAEMTTRFKKNRKKRGHVSAGHGRIGKHRKHPGGRGNAGGMHHHRILFDKYHPGFFGKVGMRYFHKLRNKFYSPIVNIDKLWSLIPQDAKDKALKSKDTAPLIDVTQHGYFKVLGKGVLPQNQPIVVKAKLISKIAEKKIKEAGGAVLLTA

SEQ ID NO: 135582 - protein, 391 aa, Glycine max
  Coding DNA Sequence Number=SeqID_43897
  Gene Ontology: Mol. function=protein transporter activity; Cellular component=clathrin adaptor complex; Biological process=intracellular protein transport
  Homolog annotation: Hit_ID=A2Y726; Match level="QueryCoverage=99%, HitCoverage=99%, E-value=1e-169, Identity=72%"; Hit description =Putative uncharacterized protein
  Pfam annotation: Domain name=Adap_comp_sub; Domain location=159-390; Score=334.5; E_value=1.9e-97; Accession=PF00928.12; Description =Adaptor complexes medium subunit family
  Pfam annotation: Domain name=Clat_adaptor_s; Domain location=4-142; Score=-57.4; E_value=0.019; Accession=PF01217.11; Description =Clathrin adaptor complex small chain
  Pfam module annotation: Pfam domain module=Adap_comp_sub::Clat _adaptor_s; Domain location=159-390::4-142
MAGAASALFLLDIKGRVLIWRDYRGDVSALDAERFFTKLIEKQADPQAQDPVVHDNGVTYMFIQHSNVYLMIATRQNCNAASLLFFLHRIVDVFKHYFEELEEESLRDNFVVVYELLDEIMDFGYPQYTEAQILSEFIKTDAYRMEVTQRPPMAVTNAVSWRSEGINYKKNEVFLDVVESVNILVNSNGQIIRSDVVGALKMRTYLSGMPECKLGLNDRVLLEAQGRTTKGKAIDLEDIKFHQYVKPLIWVEASVEKHSKSRIEIMSLFYSTATNVEIELPVPVDATNPNVRTSMGSASYAPEKDALIWKIRSFPGGKEYMLRAEFRLPSITDEEATPERKAPIRVKFEIPYFTVSGIQVRYLKVIEKSGYQALPWVRYITMAGEYELRLI

SEQ ID NO: 135583 - protein, 254 aa, Glycine max
  Coding DNA Sequence Number=SeqID_43898
  Subcellular localization annotation: CTP_CleavageSite=29; ConfidenceScore=5.35e-01
LKLVDRLGPPSIPWVGDKGLQRHLPVFSSAMRRKNREAQRCPLVNFSSQLKQSPYSSRLAFSAGGGGFAGDGNNGRFGGERVVEGGHSEEKLGPLKAEEPAPCVECQGPVPRQNNLGGKVTTVRQYDWLEFQIESENFGWVLVRGMRETGLDYLQEARPGGPKPSNRGTSSFIFGGLVKWVGGLGMAEDEKGEATRGEVFSRTVMGCIRSSSFSITWIWLEANLTMTSSRRSQLDLDRVDSAMVSLLMKAPKLL

SEQ ID NO: 135584 - protein, 151 aa, Glycine max
  Coding DNA Sequence Number=SeqID_43899
  Gene Ontology: Mol. function=methyltransferase activity; Biological process=menaquinone biosynthetic process
  Homolog annotation: Hit_ID=A7QP17; Match level="QueryCoverage=82%, HitCoverage=47%, E-value=3e-40, Identity=68%"; Hit description =Chromosome chr1 scaffold_135, whole genome shotgun sequence
  Pfam annotation: Domain name=Ubie_methyltran; Domain location=34-150; Score=-87.3; E_value=6.8e-06; Accession=PF01209.9; Description =ubiECOQ5 methyltransferase family
  Subcellular localization annotation: CTP_CleavageSite=34; ConfidenceScore=5.37e-01
MNIKNRCGKRRTCHMAMTFVPSSTSSTFRPTLIRCASANERQALFSRIAPVYDNLNDLLSLGQHRIWKRMAVSWTGAKMGDCVLDVCCGSGDLSFLLSDKVGSHGKVIGLDFSKDQLSFALSRQQSLSKNCFMNIDIIGDMGRLYSIYPGF

SEQ ID NO: 135585 - protein, 344 aa, Glycine max
  Coding DNA Sequence Number=SeqID_43900
MVSRLLVGLLLGEQPYPQGCRSPRALPNVPTWCPQGVEVVDQLRRDRNTISATTQDEVVDTSTVPKNYDAMMTNMWCCVINTSWWLHIWVVQVRGFVVVGDEKMEARLAFVAYDPLLVTLQLVEKMKGEQGCESNSNGPIICLPEAWREPPPEAKKEAGNQATEEERKGKAHDPVRESLKLGPLIVKELENFEDPTHGILAVKAQHLELHLRGGGGDCKGVQTFHDGIEYGFHGGLVLGKASDGLLGAINGCMASIVLSGHPSRGATPLASLYSLIEPSMLSYYSWHIENVLRVVKHCKEKFYEVQGYLHMFLCHDDLYLAGLVVVEAEAVDAGCGGGGRRGKH

SEQ ID NO: 135586 - protein, 397 aa, Glycine max
  Coding DNA Sequence Number=SeqID_43901
MAAIKRKTQKILPLYQMAMKASLEEQTTQGTFVTHGREDILNTVIGRLDHGGHVCAAGTKGSNAEAAVNPSSPDHVAPVKPTVGLYVHREDCTELVALGKTYDRGSTIHGVAYAHDILRVSVDKVINGDPEVPLLTSEIKYVRQTLDTFIAWPTPLLTGSTQNKVNEVVQPVNDVDVDDPLRELIKSLVDIYEKLVELVWDAILNAKDRRGESQQYIEKWLKESHRETLKTTYEGKFDETTPRWIEVKSHVPSGGYECDYYVMHWMWNIIGWELKTDWMLCENEYNVGCLRYHNMAYLKELPEDGAYASTVSENRYFYVAAYARNDLQSTSYYVDAYASTDLEITHFYIGAKANTDLENPFFKDGHDVNNDFENTRSKSLLTSSLYSKVTFLRWWFG

SEQ ID NO: 135587 - protein, 93 aa, Glycine max
  Coding DNA Sequence Number=SeqID_43902
MPKPSSPTLSRPNPSRPPHVEDSLVGIHRARVCHHCCGRLENRCNRLNPLHLRSDEALPKLQLGRMITDQFVQNNCIGQELFSMLKHVVGVNR

SEQ ID NO: 135588 - protein, 362 aa, Glycine max
  Coding DNA Sequence Number=SeqID_43903
  Gene Ontology: Mol. function=translation initiation factor activity; Cellular component=eukaryotic translation initiation factor 3 complex; Biological process=translation
  Homolog annotation: Hit_ID=Q94KS2; Match level="QueryCoverage=74%, HitCoverage=82%, E-value=1e-149, Identity=97%"; Hit description=TGF -beta receptor-interacting protein 1
  Pfam annotation: Domain name=WD40; Domain location=172-210; Score =23.9; E_value=0.00058; Accession=PF00400.23; Description=WD domain, G-beta repeat
  Pfam annotation: Domain name=WD40; Domain location=217-255; Score =34.3; E_value=4.3e-07; Accession=PF00400.23; Description=WD domain, G-beta repeat
  Pfam annotation: Domain name=WD40; Domain location=25-116; Score =24.1; E_value=0.00052; Accession=PF00400.23; Description=WD domain, G-beta repeat
  Pfam annotation: Domain name=WD40; Domain location=314-352; Score =29.6; E_value=1.2e-05; Accession=PF00400.23; Description=WD domain, G-beta repeat
  Pfam module annotation: Pfam domain module=WD40::WD40::WD40::WD40; Domain location=172-210::217-255::25-116::314-352
  Subcellular localization annotation: CTP_CleavageSite=48; ConfidenceScore=5.35e-01
MFHSLNLCASCVPVNSGRIHRHTLQALYLVLPAFLTTGTAISFSPAPRTTTPPSGSPTTANASAPTAATTAPFGAATSQASSSSLFSIHLFNNIDTDRDSGRLITGSADQTAKLWNVQTGQQLFTFNFDSPARSVDFAVGDKLAVITTDPFMELPSAIHVKRIANDPAEQTGESVLLIKGPQGRINRAIWGPLNRTIISAGEDAVIRIWDSETGKLLKESDKESGHKKTVTSLAKSADGSHFLTGSLDKSARLWDTRTLTLIKTYVTERPVNAVAMSPLLDHVVLGGGQDASAVTTTDHRAGKFEAKFYDKILQEEIGGVKGHFGPINALAFNPDGKSFSSGGEDGYVRLHHFDPDYFNIKI

SEQ ID NO: 135589 - protein, 298 aa, Glycine max
  Coding DNA Sequence Number=SeqID_43904
MVPLEAFADGARIREEGAGGGVGIFVSIQVFGGARIALSLNGIELSTGLPDNAFGEDLISRWALSTITLVLSTVIWNIKKSFLGTTISTEVVVALSTSLMSSTEKTITTTNNNNKNTNIYGLVGFGALGIRFAKRANDPASQKPMQHPKHQRLAQNINDFFSPEVVIELFKVMAKLRIVAANRILVDTYFDARFHIWEDKWVPVVLALPRQRFSNDLSLSLMSVVKDYSRPEFCVEGLQRHPPGDVQSKTPSLSYLFEVTCRGLTRVLWPEFVICFRPFGKGGMNGTSTKRDFQSGSL

SEQ ID NO: 135590 - protein, 63 aa, Glycine max
  Coding DNA Sequence Number=SeqID_43905
  Gene Ontology: Mol. function=nucleic acid binding
  Homolog annotation: Hit_ID=A9PCK0; Match level="QueryCoverage=87%, HitCoverage=39%, E-value=2e-20, Identity=89%"; Hit description =Putative uncharacterized protein
MTEGATVILRNAKIDMFKGSMRLAVDKWGRVELTEPASFTVKEDNNLSLIEYELLQPQNIWWL

SEQ ID NO: 135591 - protein, 87 aa, Glycine max
  Coding DNA Sequence Number=SeqID_43906
  Gene Ontology: Mol. function=nucleic acid binding
  Homolog annotation: Hit_ID=A7PMA7; Match level="QueryCoverage=85%, HitCoverage=54%, E-value=2e-29, Identity=82%"; Hit description =Chromosome chr14 scaffold_21, whole genome shotgun sequence
  Subcellular localization annotation: CTP_CleavageSite=34; ConfidenceScore=5.10e-01
MADSKSGLRKPVFIKVDQLRPGTSGHTLTVKVVNAKMVMQRGRSDGPQSRQMQIAECLVGDETGMIIFTARNDQGLGALFRQFHGHL

SEQ ID NO: 135592 - protein, 107 aa, Glycine max
  Coding DNA Sequence Number=SeqID_43907
  Homolog annotation: Hit_ID=A7PMA8; Match level="QueryCoverage=82%, HitCoverage=92%, E-value=5e-09, Identity=42%"; Hit description =Chromosome chr14 scaffold_21, whole genome shotgun sequence
  Subcellular localization annotation: CTP_CleavageSite=92; ConfidenceScore=5.71e-01
MLAQEVAVAARKTIQIASAATRTLLSRRSSCPTKLNGLAFSYSSPQKRALSFSRLPVLLVGAQVSLTPLHSATASAMFTSLLSLHNTNWGCLSEAFGEVKGESIYKR

SEQ ID NO: 135593 - protein, 263 aa, Glycine max
  Coding DNA Sequence Number=SeqID_43908
  Gene Ontology: Mol. function=protein dimerization activity
  Homolog annotation: Hit_ID=A5BYZ7; Match level="QueryCoverage=33%, HitCoverage=31%, E-value=1e-08, Identity=34%"; Hit description =Putative uncharacterized protein
  Pfam annotation: Domain name=zf-C2HC_plant; Domain location=177-231; Score=55.4; E_value=1.9e-13; Accession=PF07567.3; Description =Protein of unknown function, DUF1544
MRFIFSASFEFVLLLSAVLIWFVLLVATRSVPECDGEGMSVRWWGAMVKGRVRCRSGSVRQRGQEAQQLALTFEIDGAFKVKHKGGKGKQIFRRQDCPAQLLKVNLCPCMDFVSNVCLIFSVTTQDLVDIIKSQDTTSKFVIMSGSGSNSSGGDTITSGSSSVARSKYKNAPGNKTDIGWEHGIDVDGNVKKVKCKYCSKIASGGVFRFKRHLVGTRKDSEPYATVSDEIKLLMMKIVVESKARKEKKRRLNSIDEDEESAER

SEQ ID NO: 135594 - protein, 19 aa, Glycine max
  Coding DNA Sequence Number=SeqID_43909
MANYLDGVMSGVTLFVDRP

SEQ ID NO: 135595 - protein, 343 aa, Glycine max
  Coding DNA Sequence Number=SeqID_43910
  Gene Ontology: Mol. function=protein transporter activity; Cellular component=clathrin adaptor complex; Biological process=intracellular protein transport
  Homolog annotation: Hit_ID=A7Q2E8; Match level="QueryCoverage=100%, HitCoverage=40%, E-value=1e-138, Identity=74%"; Hit description =Chromosome chr1 scaffold_46, whole genome shotgun sequence
MLMKAVTADAQAVQRHRATIIECVKDSDASIQKRALELVYVLVNETNVKPLAKELIDYLEVSDLDFRGDLTAKICSIVAKYSPEKIWYIDQMLKVLSQAGNFVKDEVWYALIVVITNASELHGYTVRALYRAFQMSAEQETLVRVTVWCIGEYGDMLVNNVGMLDIEDPITVTEFDAVDVVEIAIKRHASDLTTKSMALVALLKLSSRFPSCSEYDLFFKWRIKEIIVQFKGSFVLELQQRAIEFNSIIAKHQNIRSTLVERMPVLDEATSIGRRAGSLPGAASTPTAPSFNLPNGTAKPVAPLVDLLDLSSDDAPAPSSSSGGDILQDLLGVDLSPASQQSG

SEQ ID NO: 135596 - protein, 820 aa, Glycine max
  Coding DNA Sequence Number=SeqID_43911
  Gene Ontology: Mol. function=ligase activity, forming aminoacyl-tRNA and related compounds; Cellular component=mitochondrion; Biological process=tRNA aminoacylation for protein translation
  Homolog annotation: Hit_ID=A7Q980; Match level="QueryCoverage=89%, HitCoverage=97%, E-value=0.0, Identity=74%"; Hit description =Chromosome chr19 scaffold_66, whole genome shotgun sequence
  Pfam annotation: Domain name=HGTP_anticodon; Domain location=725-815; Score=96.9; E_value=6.3e-26; Accession=PF03129.11; Description =Anticodon binding domain
  Pfam annotation: Domain name=TGS; Domain location=127-187; Score =87.5; E_value=4.2e-23; Accession=PF02824.12; Description=TGS domain
  Pfam annotation: Domain name=tRNA-synt_2b; Domain location=457-621; Score=212.0; E_value=1.4e-60; Accession=PF00587.16; Description=tRNA synthetase class II core domain (G, H, P, S and T)
  Pfam annotation: Domain name=tRNA_SAD; Domain location=305-354; Score= 83.6; E_value=6.2e-22; Accession=PF07973.5; Description=Threonyl and Alanyl tRNA synthetase se
  Pfam module annotation: Pfam domain module=HGTP_anticodon::TGS::tRNA -synt_2b::tRNA_SAD; Domain location=725-815::127-187::457-621::305-354
MILIPHLGRENRTFTQPKTLETSRVTQSLGTKPKPKPKPTAQYAMLCSLIRIRRHAPFHHTLRSLLPINRFSSSSSSSASAAAAAAMVAHAKDEAYLSAAIPKRVRLFETIQAEQRTQRLSLSPDPIKVTLPDGNVKDAKKWLSTPLDVAREISKNLANSALIAKVNGVLWDMTRPLEDDCQLQIFKFDDDEGRDTFWHSSAHILGQSLETEYGCKLCIGPCTTRGEGFYYDAFYGDLGLNDDHFKQIEAGALKAVAEKQPFERIEVTRDQALEMFSDNKFKASITFFSSLRIEIINDLPADKTITVYRCGPLVDLCRGPHIPNTSFVKAIACLKASSAYWRGDKDRESLQRVYGISYPDQKSLKCVLEAEFHWGGLVVLCSCDSESGNWSSRQSCLAFIIGSLKTGLKNAELVEYLHRLEEAKKYDHRILGVKQELILHHEWSPGSWFFLPHGARIYNKLMDFIRNQYRDRGYQEVISPNVFNMDLWVQSGHAANYREDMFILEVDKQEFGLKPMNCPGHCLMFKHRVRSYRELPLRFADFGVLHRNEASGALSGLTRVRRFQQDDAHIFCRESQIKDEVRNGLNFINYVYKIFGFTYELKLSTRPEKYLGDIATWDKAESALKEALDDFGKPWQLNEGDGAFYGPKIDISVSDALSRKFQCATLQLDFQLPDRFKLEFSAEDEAKIERPVMIHRAILGSVERMFAILLEHYKGKWPFWLSPRQAIVCPVSEKSQSYALQVRDQIHQAGYHVDADTTDRKIQKKVREAQLAQYNFILVVGEEEANSGQVSVRVRDLAEHKVMSIEKLLEHFRDKTAAFE

SEQ ID NO: 135597 - protein, 69 aa, Glycine max
  Coding DNA Sequence Number=SeqID_43912
MTKKESAHDNIEEYRRISWNIPLKVAFTMDKMHMALSVLWIIPLHSEYDMSPYYLVRNNGPFKKSTVIL

SEQ ID NO: 135598 - protein, 146 aa, Glycine max
  Coding DNA Sequence Number=SeqID_43913
  Subcellular localization annotation: CTP_CleavageSite=77; ConfidenceScore=5.44e-01
MTFLSGQNKQNMYFMFKTLVIKGGQWQMASPPSSPPLPPPPIEAVSQSLSTLKRTRKATRLRSLATRLVGADRPMVHVDHVTEKAKSPHKKKLRTYLGIVARDKVDMTYETWKQVPAAQKDLIWEDIQTEFDILEASDVRTKKKIL

SEQ ID NO: 135599 - protein, 104 aa, Glycine max
  Coding DNA Sequence Number=SeqID_43914
MNPNENIQSMQKRFTHIVNHLASLGKIFPNEDLINKVLRCLSREWQPKEHEMELQRLNQNEETDKKKRSIALKASSSMQEENEEEESEDEEDFSLFVKKFQKFV

SEQ ID NO: 135600 - protein, 99 aa, Glycine max
  Coding DNA Sequence Number=SeqID_43915
MDICEDTDIPIILGRPFMLTASCIVDMGRKKLEMSFEDQKIDFDLFIEDKPAPEQNVCLQRKPHAKRIFGHALSRESQALNAQPLHLRLTWSAKLAVSR

SEQ ID NO: 135601 - protein, 49 aa, Glycine max
  Coding DNA Sequence Number=SeqID_43916
MRAPVVAVLNERQPIECGGCSAPLHLFPLTTTKPLTAPPRYLPFFTTKV

SEQ ID NO: 135602 - protein, 170 aa, Glycine max
  Coding DNA Sequence Number=SeqID_43917
GTNDFEHDSLRQLVKSLYYMYDKPVELKWDGSKFGLPNVDASFFLTFSDVNEIVAGYKCLNISILQLWMLQLWVMLPCMDSFSHNRYTMQRTDVLNVSITYKHGSRNLNERGHWQLVVLCPATNVVAWFCSLRKKPDTHIKIAINNAMKTTNTTKDGTNNPGTPKWIEVK

SEQ ID NO: 135603 - protein, 77 aa, Glycine max
  Coding DNA Sequence Number=SeqID_43918
MPVCGRARRGSRVRFPREERCVESPPTFICGKRQKNRRKPVKKKIPSSGVVFAFEEGRQKRGSCSYVPSIEEEIRPT

SEQ ID NO: 135604 - protein, 75 aa, Glycine max
  Coding DNA Sequence Number=SeqID_43919
  Subcellular localization annotation: CTP_CleavageSite=36; ConfidenceScore=5.65e-01
MSSGGVDPPRPPSHDSSGKGTTAKKRRYMVRLLPPRDSLTSSIPSPSSMSIPVRPLDVARTPSPPSTKARPSSSH

SEQ ID NO: 135605 - protein, 165 aa, Glycine max
  Coding DNA Sequence Number=SeqID_43920
  Homolog annotation: Hit_ID=Q84VH5; Match level="QueryCoverage=76%, HitCoverage=18%, E-value=4e-47, Identity=75%"; Hit description =Envelope-like protein
  Subcellular localization annotation: CTP_CleavageSite=21; ConfidenceScore=5.27e-01
MANSPKDTSSPGSPSVPSSPSSTKAPSNQEQPEFHIQPIQMIPGQAPVPEKLVPKRQQGVRISENPSLATSPREADPEMDKKIRSIVSSILKNASVPDADEDVPTSSTPNVSVPDAEKDVPTSSTPNAEVLPSPSEEESTEEEDQATEETPAPRAPNLLQVTSLT

SEQ ID NO: 135606 - protein, 300 aa, Glycine max
  Coding DNA Sequence Number=SeqID_43921
  Gene Ontology: Mol. function=phosphoprotein phosphatase activity
  Homolog annotation: Hit_ID=Q2HTA0; Match level="QueryCoverage=70%, HitCoverage=35%, E-value=1e-28, Identity=35%"; Hit description=IMP dehydrogenase/GMP reductase, related
  Pfam annotation: Domain name=DUF1723; Domain location=161-210; Score =63.6; E_value=6.4e-16; Accession=PF08330.1; Description=Protein of unknown function (DUF1723)
MVGTRGLGRALGAGRGRGISEDTHEADVPLRRRPTASARKQRVRLREDVTERPEDVPHVSDATPEMTGAADAVQTEGVATDGSLGSPVADESFPGGPRDPSILTDFAEHVAHSIWSGQERPDLKLVSHGRKVDKIGRPAPEIEGLIAGTGLSPLIRCSVITTDPGLISAFVERWHRETSTFHLPVGELTITLDDVASLLHLPITVALHTFEPLVTSDAIGLLTKLLEVSHEEATFETRQAGGPHVRLGWLRDLYQSQCRTRRWVVAARTYLLHLVGCTLFANKSSTHVHVVHLEAFRDQA

SEQ ID NO: 135607 - protein, 104 aa, Glycine max
  Coding DNA Sequence Number=SeqID_43922
MHEQRLKINSWGYGLDGGGCINDNQFMGLRIRFDGGRCTNRTWQSIGGAPDSMGINSWGYGLDGGGWMNDNQFMGLRIRFDDGGCTTSARQSIPGVPDSVEEDA

SEQ ID NO: 135608 - protein, 91 aa, Glycine max
  Coding DNA Sequence Number=SeqID_43923
  Subcellular localization annotation: CTP_CleavageSite=60; ConfidenceScore=5.04e-01
MTLLLSNILPSDRNANLPLQKDRTHKTPSGPEKVQQGPGVSSSGYGPLSVLHGARTPPARSRHHSSTEYLSPPARASGPLLIELSSRSTAP

SEQ ID NO: 135609 - protein, 65 aa, Glycine max
  Coding DNA Sequence Number=SeqID_43924
CNRPGHIKAHCPINESWPEKKSHEERRSKKAYIAWDDNDSSDGSEKEINLLSKDYESDENISQED

SEQ ID NO: 135610 - protein, 98 aa, Glycine max
  Coding DNA Sequence Number=SeqID_43925
MFDVLMMLKDQVLLSFIQDKNPRKSRYMIKLISRISRKKFQIEKTKGLTKELYHFKLRFALWGFLNTREGLSLCGSDFVEGVLQREWKISSGLLEDWT

SEQ ID NO: 135611 - protein, 85 aa, Glycine max
  Coding DNA Sequence Number=SeqID_43926
MKTVQVEASISSPSLYVWEFYRNSRGNNWRDLKEPLEMLLSLAEDTELYMFDESVDVPMRNCYEIDVFFVECEPVRKIKLFLLTV

SEQ ID NO: 135612 - protein, 54 aa, Glycine max
  Coding DNA Sequence Number=SeqID_43927
MACLDQQHSEKEGQTVVVMEDLSISNLDDSSNLDCIYCLKGHNYSVVHKLQVAH

SEQ ID NO: 135613 - protein, 76 aa, Glycine max
  Coding DNA Sequence Number=SeqID_43928
MGTDASGDRVTTDRSLPFLGAKQAENIAARQPSILCIRGSSRQTLARKGGGDMVNVPLKKKWQVSSPGRATPAPKL

SEQ ID NO: 135614 - protein, 193 aa, Glycine max
  Coding DNA Sequence Number=SeqID_43929
MGHGTFLSQTKYYIELIKKFGMKKCKEAFTPMATSTYLDLDEKDKLVDESRYRAALNKLDTWFTGENKKTNFKMIYVVKNVRIPKFMNLEWFSQQGFNFPNLLEVQGLSTFMQMKGTFYPELVKILSQPTLSRAREARLTGASSEGGKCAESPPTKVLAPLTFVPKDNNLILVSYPNFVRGPLLDDMQLLFGP

SEQ ID NO: 135615 - protein, 73 aa, Glycine max
  Coding DNA Sequence Number=SeqID_43930
  Subcellular localization annotation: CTP_CleavageSite=43; ConfidenceScore=5.03e-01
MCIHRKWPRGNLPQRDPGRIKQLKEPVPLPSMTVTALGALNTSSASRPSRDGHFSGSDASSSGTTSIPISRRR

SEQ ID NO: 135616 - protein, 350 aa, Glycine max
  Coding DNA Sequence Number=SeqID_43931
  Homolog annotation: Hit_ID=Q84VI1; Match level="QueryCoverage=100%, HitCoverage=51%, E-value=1e-141, Identity=76%"; Hit description =Envelope-like protein
MASSPKETSASGSPAVPSSPHQEQPEFNIQPIQIIPGQASVPEKLVPRRQQGVKIYENPSLATSPREVDTEMDKKIRSIVSSILKDASVPDAGEDVPTSSTPNVSVPDVEKDVPTSSGPNAEALPSPSEEESTEEEDQASEETPAPRAPEPAPGNLIDLEEVESDEEPIANRLAPGIAKRLQSRKGKTPIKRSGRIKTMAQKKSAPITPATSRRSKVAIPSKKRKEISSSDTDDDVELDVSTSKRAKTSGRKVPGNVPDAPLDNISFHSIGNVEKWKYVYQRRLALERELGRAAMDCKEIMDLIKAAGLLKTVSKLGDCYEGLVREFIVNIPSDISNRKSDDYQRVFVRG

SEQ ID NO: 135617 - protein, 62 aa, Glycine max
  Coding DNA Sequence Number=SeqID_43932
MRVYHTVTRTFGQPGENEPVGARRLTSSPAPFVVLTREVSQVTCGVTLWLPTPFVNHGKTSP

SEQ ID NO: 135618 - protein, 274 aa, Glycine max
  Coding DNA Sequence Number=SeqID_43933
  Homolog annotation: Hit_ID=Q2HW90; Match level="QueryCoverage=66%, HitCoverage=44%, E-value=4e-14, Identity=25%"; Hit description =Putative uncharacterized protein
MGSSQKPSLKKRFYQVKIKSLEVTSLRKLGQLMGQLQRQAFRRAYGKIWDLARVEVSMEPIASIAQYYDQPLRCFIFGDFQLSPMVEEFEEILGCPLGGRKPYLFSGFYPSLARISKKVQISAQELDRQRQVENGVVGIPRKYLERSTFFLAYHNHKESPVVAMLADLYDTFDRRCEESNARIVCCTPALYVGLVSHLFLQEGRPVYPLQGYRSCVEKGKANWDQLLASMGGRLLIGSLARRKEESRFYLHAKDVQMFPRWEQGVVLIIIPFSP

SEQ ID NO: 135619 - protein, 59 aa, Glycine max
  Coding DNA Sequence Number=SeqID_43934
DQGVPMNPKRIKIIPEWPTPPTPLIELVRNHVPSWEDAQEMGKEPRVKEPQDLRSNPFQ

SEQ ID NO: 135620 - protein, 98 aa, Glycine max
  Coding DNA Sequence Number=SeqID_43935
MLWVCMYVNLAKEMCVMLYAIFALKSNVPLEWPRGSLPQRGPGRTRWPKELVPPRSTTVTALGALYTSSASKPLRDGRFSGSDASSSRTTSILISRKK

SEQ ID NO: 135621 - protein, 146 aa, Glycine max
  Coding DNA Sequence Number=SeqID_43936
  Homolog annotation: Hit_ID=Q2HTA0; Match level="QueryCoverage=64%, HitCoverage=14%, E-value=1e-12, Identity=42%"; Hit description=IMP dehydrogenase/GMP reductase, related
  Pfam annotation: Domain name=DUF1723; Domain location=43-92; Score =49.7; E_value=1e-11; Accession=PF08330.1; Description=Protein of unknown function (DUF1723)
EHLEMKLSSHERKMAKFGRSALEIEGLVAANGLSHLIACSLDMDDRGLMSAYMECWHKETNSFHLPIGEVTITLDDVASLLHLPIIKAFHSFKQLHVNDPVNMLVELLEVNTTEARAETIQCHVSLFDYRGCETCIRQKLRHITGL

SEQ ID NO: 135622 - protein, 31 aa, Glycine max
  Coding DNA Sequence Number=SeqID_43937
YFNDPRPLEPERLNVLQIQWAQYYLRVRDQT

SEQ ID NO: 135623 - protein, 121 aa, Glycine max
  Coding DNA Sequence Number=SeqID_43938
MGDQEETQEQMKADMSALKEQMASMIEPMLGMRQLIENNVATAAVVSSVAEADPTLPAIAHHPLPNAVGRERSTLGHISNPHLGYNRVAYPYGLPPNYTPPIKRDDAGHVPSPILEGEPPR

SEQ ID NO: 135624 - protein, 60 aa, Glycine max
  Coding DNA Sequence Number=SeqID_43939
MEEETATNQILESSPVPIPDDSMPSAPASELEQPISQDSPAAQVLDLNEHAQEQPQEQDI

SEQ ID NO: 135625 - protein, 76 aa, Glycine max
  Coding DNA Sequence Number=SeqID_43940
  Subcellular localization annotation: CTP_CleavageSite=48; ConfidenceScore=5.02e-01
MKNCKNTSGEDVSFTSRISQSLTNSSQAIKSVPTSSSVVIIKKGEIVEAKLHGESKVIQRYFDDNNDDDKGDDKKL

SEQ ID NO: 135626 - protein, 288 aa, Glycine max
  Coding DNA Sequence Number=SeqID_43941
MASRKRKTPSTATPTRFDRSRFTSQEAWERFTNIVVPRKLLPKRNEVVYYTEFDEFKEELERCHWDEELTDFMDDNIDVAIIKEFYANLYDPEDKSPKQGEILCAYSRFALLKPDPQELAAKLCIPGRGFELNVDGYPLKFLRKNMATLAQTWSVLSFSNLIPTSHTSDVTLDKAKLIYGIIMKIDMNLGYLISHQISLIAQHDTSRLGFPTLRVTFRGPRKARGKRSEAPSTSASEAPTPSSSTVPSSSSTQIPVIPPVPLQTPLPAPLSAGPSDFIFTPQMLHSML

SEQ ID NO: 135627 - protein, 232 aa, Glycine max
  Coding DNA Sequence Number=SeqID_43942
  Gene Ontology: Mol. function=chloramphenicol O-acetyltransferase activity; Biological process=response to antibiotic
  Homolog annotation: Hit_ID=P62577; Match level="QueryCoverage=80%, HitCoverage=84%, E-value=1e-109, Identity=100%"; Hit description =Chloramphenicol acetyltransferase
  Pfam annotation: Domain name=CAT; Domain location=6-195; Score=416.1; E_value=5.2e-122; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPAGDSVVLLHVFPGWTQDDSYRIRRSGRTERGVRAYSPAWSELPTRN

SEQ ID NO: 135628 - protein, 106 aa, Glycine max
  Coding DNA Sequence Number=SeqID_43943
  Subcellular localization annotation: CTP_CleavageSite=49; ConfidenceScore=5.22e-01
MEELINKTQLSPQNNANVITSARRFLNRISSLQPTALILLPRTRFAIITARKRKQTSRAYTTFIIQHSHPTIVHCPHPTITHHPYSTITHHPSMDPIKTAQNDAYT

SEQ ID NO: 135629 - protein, 254 aa, Glycine max
  Coding DNA Sequence Number=SeqID_43944
  Gene Ontology: Mol. function=motor activity; Cellular component=cell projection
  Homolog annotation: Hit_ID=UPI00016621D1; Match level="QueryCoverage =93%, HitCoverage=40%, E-value=1e-19, Identity=35%"; Hit description =UPI00016621D1 related cluster
  Subcellular localization annotation: CTP_CleavageSite=38; ConfidenceScore=5.04e-01
MGTSTLTFRGLHVLAFRGLHALTFRGLHSLTFRGLHVLAIRGSRTLTFRGLHVLTIRGLHVLAFRGLHALTFRGPHTLTVRGVHVLGFRGLHVLTFRGLHALAFRGLNVLLFRGLHALAIRELHVLTFTGQHVLLFRGLHVLTFRGLHVVAFRGLHVLAFRGLHVVAFKGGLHAPAFRGLHILTFRGLHVLSIRGLHVLTFSGLQALAIKGLHVLTFRGLHVLLFRGLDVLAFRGLHTLTFRGLHVLLFGGLHV

SEQ ID NO: 135630 - protein, 61 aa, Glycine max
  Coding DNA Sequence Number=SeqID_43945
MDPVKYIFEKPALTGQIARWKGQSLYPQMINVFLFTTRLGFDCTNNMAEYEACALGIQGGH

SEQ ID NO: 135631 - protein, 69 aa, Glycine max
  Coding DNA Sequence Number=SeqID_43946
TGRVNVLSSLSIACLDFRYCHHQKGGDCRQRIKLKVLMMPKDYMNHMLLKDLLKTKQLEIFKMDEQDSL

SEQ ID NO: 135632 - protein, 76 aa, Glycine max
  Coding DNA Sequence Number=SeqID_43947
MQKRFTHIVNHLASLGKTFPNEDLINKVLRCLSREWQPKEHEMELQRLNQNEETDKRKRSIALKTLGYSYEHWLLP

SEQ ID NO: 135633 - protein, 106 aa, Glycine max
  Coding DNA Sequence Number=SeqID_43948
MCLSGKEKEALGSTKIEENHSKCINLTQCGARKSQAHRILVGNQREMTTLGCGQGLTFSPWVKVYDKLGFWLKACRTAGHDICQGLASGSGIKGMSHIISMIHMQQ

SEQ ID NO: 135634 - protein, 125 aa, Glycine max
  Coding DNA Sequence Number=SeqID_43949
  Gene Ontology: Cellular component=intracellular; Biological process =intracellular protein transport
  Homolog annotation: Hit_ID=A7QFJ3; Match level="QueryCoverage=29%, HitCoverage=5%, E-value=9e-12, Identity=81%"; Hit description =Chromosome chr8 scaffold_88, whole genome shotgun sequence
MKVRDKILILLDSWQEAFGGPGGKHSHYYWAYEELKQVLEGQHSKTVLTSALSLKGSILRRCLHQHVLEGQHSKTVLTSALSLKDGVAFGRSLKTPTSKMVIVAPSLKVLTFHDVGIYDGHPPLL

SEQ ID NO: 135635 - protein, 85 aa, Glycine max
  Coding DNA Sequence Number=SeqID_43950
MVGYTRSSFADLVFTGRRIKAGLKRGKFNHPTWTNEKTGANEEGENEGETHAATVIPTWPNIPPTQQCHYSANNKPSPYPPPSYP

SEQ ID NO: 135636 - protein, 23 aa, Glycine max
  Coding DNA Sequence Number=SeqID_43951
EFDKTEGQAGHLSARGIIAATAI

SEQ ID NO: 135637 - protein, 46 aa, Glycine max
  Coding DNA Sequence Number=SeqID_43952
MWTTTGEKLAAQLAQASKVASSRSNSLLEESSGGPKWAWLQFAPPF

SEQ ID NO: 135638 - protein, 263 aa, Glycine max
  Coding DNA Sequence Number=SeqID_43953
  Gene Ontology: Mol. function=homoserine dehydrogenase activity; Cellular component=chloroplast; Biological process=aspartate family amino acid biosynthetic process
  Homolog annotation: Hit_ID=P00561; Match level="QueryCoverage=100%, HitCoverage=32%, E-value=1e-133, Identity=90%"; Hit description =Bifunctional aspartokinase/homoserine dehydrogenase 1 (Aspartokinase I/homoserine ...
  Homolog annotation: Hit description=dehydrogenase I) (AKI-HDI) [Includes: Aspartokinase (EC 2.7.2.4); Homoserine dehydrogenase (EC 1.1.1.3)]
  Pfam annotation: Domain name=Homoserine_dh; Domain location=57-254; Score=347.3; E_value=2.6e-101; Accession=PF00742.10; Description =Homoserine dehydrogenase
QAVADQYADFLREGFHVVTPNKKANTSSLDYYHQLRHAASSSRRKFLYDTNVGAGLPVIENLQNLLNAGDELLHFSGILSGSLSFIFGKLDEGMSLSEATKLAREMGYTEPDPRDDLSGVDVARKLLILARETGRELELSDIIVEPALPADFDASGDVDSFMARLPTLDDQFAARVAKARDEGKVLRYVGNIEEDGVCRVKIAEVDGNDPLYKVKNGENALAFYSHYYQPLPLVLRGYGAGNDVTAAGVFADLLRTLSWKLGV

SEQ ID NO: 135639 - protein, 222 aa, Glycine max
  Coding DNA Sequence Number=SeqID_43954
MPKCQLVYAILTRMSIHVAQLIADAIYIFAGMAPTRHPLDPDKSNRALGFPALITGLCQSFGVPVAPTKVIRPPITRAFIEKYCRRRTPPHQAGQAGAFGIEQYLRHLVRQQAANHRAHVRTHDCLYQMSLSMQSQGFAPFSCPTPDQFRAEVAWPGDWPEAQAGEAPPEAPGDGEEAHEDEEMAICLTSWEGVEIRDWEIPRFMFSFIFLLSFLFYVIVLT

SEQ ID NO: 135640 - protein, 100 aa, Glycine max
  Coding DNA Sequence Number=SeqID_43955
  Homolog annotation: Hit_ID=A6FJQ2; Match level="QueryCoverage=38%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVKGVALCHCGSMMNPRQHSFEVAVAVSHENDVLRQSSSDKSWFLHKA

SEQ ID NO: 135641 - protein, 151 aa, Glycine max
  Coding DNA Sequence Number=SeqID_43956
  Homolog annotation: Hit_ID=A5B3J2; Match level="QueryCoverage=94%, HitCoverage=26%, E-value=8e-10, Identity=33%"; Hit description =Putative uncharacterized protein
MRGNPSTGDLAPLDLEIEATCRRNNAERKRKFLQDRTAQLGPEEAQSSEASSIFPEPREPEIGASEADIMAEDQPRRVTLDDYSSSTVPQFFTSIARPEVQAHNVTYLYSLIQLIQGNLFHGLPNEDPYAHLASYIEICNTVKIAGVPEDA

SEQ ID NO: 135642 - protein, 103 aa, Glycine max
  Coding DNA Sequence Number=SeqID_43957
  Homolog annotation: Hit_ID=Q2R1G5; Match level="QueryCoverage=77%, HitCoverage=6%, E-value=3e-08, Identity=41%"; Hit description =Transposon protein, putative, Mutator sub-class, expressed
MTTNLAKCMNSVLKGARALPIAALVNETFNKINDSFVTNGIKIMNMIKAGHRYSKDVYVMMQENQHIATSHLFACMFEKQGSLRFKKLQIRDLIDEQWHALSN

SEQ ID NO: 135643 - protein, 79 aa, Glycine max
  Coding DNA Sequence Number=SeqID_43958
MENAKHMATPMSTACYLDKDETGQSIDIKQYRGRAPVELVISLDLLWFLGIVRNKIVSLYLLRKRNTFLLAIVVLKFFG

SEQ ID NO: 135644 - protein, 66 aa, Glycine max
  Coding DNA Sequence Number=SeqID_43959
MGNVEKVQEQMKADMEAMKEQMATMMEAMMSMKKIMEANAVAVTATKSNSCSPGGSTSSRKRPATA

SEQ ID NO: 135645 - protein, 165 aa, Glycine max
  Coding DNA Sequence Number=SeqID_43960
MARAGDNGGVYHQLDESQRLFLDTWTTQMQRLLNRNKEEPYRRIVKSSSFTLKPLSPREVPTYKSNPQETQRKDAHAKVQYVKRLYDQVKVQIAKKNESYAKQVNKKRKAVVLESGDDPRHLRTNVFQEGGNDENHETGQIQAKGPSGEERRPKWRRTKPPSGEG

SEQ ID NO: 135646 - protein, 54 aa, Glycine max
  Coding DNA Sequence Number=SeqID_43961
STLSAYTEAVRELACEILELIAEGLGVPDTWIFNRFIRDVDRKCSKENASIALP

SEQ ID NO: 135647 - protein, 67 aa, Glycine max
  Coding DNA Sequence Number=SeqID_43962
MDLGFRWEALNASFSKIDAEPYYLLVPRWDLLLSKGKVVIGCHIVDNPLEAFYGDVLGHMGVIQNFN

SEQ ID NO: 135648 - protein, 243 aa, Glycine max
  Coding DNA Sequence Number=SeqID_43963
SAEHQQRFEAIKGWSFLRERRVQLRDDEYTDFQEEIVRRRSWVRGQWIPFDADAIGQFLGYPLSARRGPGVRVWPEEEPVRIMHTNMTTLTQIWMTLLLSNIQPSDHNSDLPLPKCQLVYAILTRMSIHVAQLIADAIYLFAGMAPTRHPLDPDKSNRALGFPALITGLCQLFGVPVAPSKVIRSPITRAFIEKYCAQRQAQGDAPQATDAPPPHQAGPAGSFDTEQYLRHLVRQQAANHRAH

SEQ ID NO: 135649 - protein, 80 aa, Glycine max
  Coding DNA Sequence Number=SeqID_43964
MRGYRMVTRTFRQPGANEPVDAKKLTSSSAPFAIQGQRVRWQAEIPYDHSHLSSTEENEFDDVRMMFYSRRPETFKPNDA

SEQ ID NO: 135650 - protein, 127 aa, Glycine max
  Coding DNA Sequence Number=SeqID_43965
SFGVPVTPNKVIRPPIPRAFIEKYCTPRQAQGDAHQAADASPPPQQADPAGSLGMERYLQHLVRQHAANHRGQVQIHECLYRFSLSQQGQGFAPFAYPTPEQFGAEVAWPGDWPEAQAGEEPAGSPG

SEQ ID NO: 135651 - protein, 312 aa, Glycine max
  Coding DNA Sequence Number=SeqID_43966
MAAQHIFDFRQRDAHAADLHIPVHPGGEHDVAVRTVVALIAGAESAQRLPVRPFKGDEVMLLQLPLLQIAQRQVDPGGMNAADHAGRAVAAVVMADEVAVGRQRAAVRHGAALLRGDRVPDAPDGGFGRPAEREQREIRAQGAQGLHRRRLDVVAALRHQAQRTQAVGRFAGEQHLQNGGHRTPQGDPVLFHQLVPADGVLFLMRRRQYQRGAGAQRTEQIEHRHVMVRRRDGNEDVVGSDRPALLSLVDDVGGGAVVEHHAFGFTGGAGGARSVGASRAAGVTPIGVSRSPPCTTSVGRHFPAVGVRSGGE

SEQ ID NO: 135652 - protein, 297 aa, Glycine max
  Coding DNA Sequence Number=SeqID_43967
  Homolog annotation: Hit_ID=UPI00016621D1; Match level="QueryCoverage =62%, HitCoverage=39%, E-value=1e-14, Identity=33%"; Hit description =UPI00016621D1 related cluster
GLYALTFKGLHVLPIRGLYVLAFRGLHALTFRGLHLHALAFVGLHALTFRGLLVLTIGGLHTLAFSGLHALAFRGLHVLAIRGLHVLAFRGFHVLTFRGLHTFVFVGLHVLTFRGPHALTFRGLHVLAFRGLHVLAIRGVHAFTFRGLRVLAIRGLQILTFRGLHALAIRGLHVLTLRGLHALTFRGRHVLAIIPGPPPDPRGGRTVRAQLEEEAITQLLCIPGQDFTCASAKRRVWIMHTNMTTVTQIWMTDRAHKTPSGPGGVQQGPGVSSFGYGPLSVLQGARSSPARSCHRDV

SEQ ID NO: 135653 - protein, 172 aa, Glycine max
  Coding DNA Sequence Number=SeqID_43968
MATRPRLQRNTRPRLKKAARLAFRGLHILAFRGLHALTFRGLHALAFRGLDGFTPSPSEDYKSSPSEDYTSSRFRGLHVLTFRGLHVLAFKRETRPLLRGLHVLSSEGYTPSPLDGCMPLPSRGLHILAFRGLHVLTFRGLLPSPLEDYTSSPSEGYTPSPSEGCMPSPSED

SEQ ID NO: 135654 - protein, 158 aa, Glycine max
  Coding DNA Sequence Number=SeqID_43969
  Gene Ontology: Mol. function=chitin binding; Cellular component =extracellular region; Biological process=chitin metabolic process
  Homolog annotation: Hit_ID=UPI000066154C; Match level="QueryCoverage =93%, HitCoverage=98%, E-value=8e-16, Identity=36%"; Hit description =Homolog of Homo sapiens "Keratin-associated protein 10-1
  Subcellular localization annotation: CTP_CleavageSite=73; ConfidenceScore=5.57e-01
MVRTCSPLKARTCSPLKVRTWSPLKARMCSPLKVRACSPLLARTCSPLKVRACSPTLARTPLLARTCSPLKVRACSPTKVRTCSPLMARACNPLKVRTCSPLMARACSPLKVRTRSPLMARACSLLKVRTCSPLKVRTHSPLKVRACSTNCCLVFTTS

SEQ ID NO: 135655 - protein, 127 aa, Glycine max
  Coding DNA Sequence Number=SeqID_43970
MGCFISRLSFPVGIFVSLPKHVLHFSGENTETFSSLTSYPELRRSKFLIGGYVGARASLLSTTPLFVTMTQELVARGDTLRLSAPRHSVTPCVIDEQRPMGSSAPFPEVSASFGGDFFKSHNLSRTT

SEQ ID NO: 135656 - protein, 29 aa, Glycine max
  Coding DNA Sequence Number=SeqID_43971
MGEIKKKEEEEGKKAPDQGLKENRRNVQK

SEQ ID NO: 135657 - protein, 124 aa, Glycine max
  Coding DNA Sequence Number=SeqID_43972
MLYLECDPIRKAVENEDDLDDVPVAGHEEDVGAGEQTDAGEQMDADGSEQRDTDAGEQRDAGGEERDVADSEEEKEVDSDEWFINFSCMMNGVEAEVETDGYHSEELNIPISSDDEDEDVEVYP

SEQ ID NO: 135658 - protein, 145 aa, Glycine max
  Coding DNA Sequence Number=SeqID_43973
MGSNQAPSFKKRFYHVKVKSLDLASLRELGQRMDQVRCQAFHKAYGKIWDLALIEVSVEAIASLSQYYDQSLRCFTFGDFQLVTALVRCIGGNSVPRRLSNVALRSASINSLSRKVASSSSPNKLGFTKLLVSHAESYEAAGFPR

SEQ ID NO: 135659 - protein, 94 aa, Glycine max
  Coding DNA Sequence Number=SeqID_43974
  Gene Ontology: Mol. function=endonuclease activity; Cellular component=extracellular region
  Homolog annotation: Hit_ID=P13717; Match level="QueryCoverage=100%, HitCoverage=35%, E-value=3e-50, Identity=100%"; Hit description =Nuclease precursor (EC 3.1.30.2) (Endonuclease) [Contains: Nuclease isoform Sm2; ...
  Homolog annotation: Hit description=Nuclease isoform Sm3; Nuclease isoform Sm1]
RDMGKLPGTQKAHTIPSAYWKVIFINNSPAVNHYAAFLFDQNTPKGADFCQFRVTVDEIEKRTGLIIWAGLPDDVQASLKSKPGVLPELMGCKN

SEQ ID NO: 135660 - protein, 119 aa, Glycine max
  Coding DNA Sequence Number=SeqID_43975
MNILTAHDQGWKQELSPYNQYEEERTPNLESVFKEFVAYHASSKANQNSMKNHEIHFGKSYSIENFHGGPKLQPYYQNEAEKGSNLDKLLMQFMEATKSTQRALQSIEIQVGELAEALT

SEQ ID NO: 135661 - protein, 167 aa, Glycine max
  Coding DNA Sequence Number=SeqID_43976
MDQLQHQAFCETYGKIWDLAMIEVSVEAIASLTQYYDQLLRDLGMPARRKKAISFLWVLPLHGKDIQGGIVLFPNEDGLVDLAAIDAFLAYHHSKESPKMREERHPFVPCKVTAYVSTKGRPIGSNSWKYGFCPYVRDVATYPSARERREAHGSVFQGRKMREVATN

SEQ ID NO: 135662 - protein, 249 aa, Glycine max
  Coding DNA Sequence Number=SeqID_43977
GQDHLELPSGVETKHEQQKPIKVHRNGCKWGWGHDRLIVAPFSTLSKRRTSLQGSPDQHFAHFLIPFCAFVHHQQEMAPRKLASKRSRKDKAAEGTSSAPEYDSHRFRSAVHQQRFEAIKGWSFLRERRVQLRDDEYTDFQEEIGRRRWTSLVTPMAKFDPEIVLEFYANAWPTEEGVRDMRSWVRGQWIPFDADAIGQLLGYPLVLEEGQECEYGQRRNRSDGFDEEAIAQLLCTTGAGFCPDCYREA

SEQ ID NO: 135663 - protein, 124 aa, Glycine max
  Coding DNA Sequence Number=SeqID_43978
MEGLVDLAAIDAFLAFHHGKESPVVAILAMYDTFDRGCERAAQELFVVHWLSMCDWFHTFFSKKVGPSIRYKEGRIRILSSCEGCPNVPLMEQGEFTRHVMRCEERTESLGEAVMGASAAIISG

SEQ ID NO: 135664 - protein, 106 aa, Glycine max
  Coding DNA Sequence Number=SeqID_43979
MPEFTSDYPQISASPHQLDIAYYASGSYNAQWNALELLHGKHMLCSSRILRKMEVEEPWLGLWLPLNYRVDMGTSFFVGKLPLGLVFWFVLWVVFGIGCAAGGLCG

SEQ ID NO: 135665 - protein, 251 aa, Glycine max
  Coding DNA Sequence Number=SeqID_43980
  Gene Ontology: Cellular component=cytoplasm
  Homolog annotation: Hit_ID=Q57MB2; Match level="QueryCoverage=94%, HitCoverage=71%, E-value=1e-111, Identity=85%"; Hit description =Nucleoid-associated protein ndpA
  Pfam annotation: Domain name=NA37; Domain location=3-251; Score =278.2; E_value=1.6e-80; Accession=PF04245.4; Description=37-kD nucleoid-associated bacterial protein
MSLDIDQIALHQLIKRDEQNLELVLRESLLEPNATVVEMMAELHRVYSAKSKAYGLFNEESELAQALRLQRQGEEEFLPFSRAATGRLRDELAKYPFAEGGIVLFCQYRYLAVEYLLVAVLNNLSSMRVNEELDISSTHYLDINHADIVARIDLTEWETNPESTRYLTFLKGRVGRKVADFFMDFLGASEGLNAKAQNRGLLQAVDDFAADAQLDKSERQNVRQQVYAYCNEQLQAGDEIELESLSEKSSP

SEQ ID NO: 135666 - protein, 178 aa, Glycine max
  Coding DNA Sequence Number=SeqID_43981
MEADMEAMKEQMATMMEAKMIMKKIMEANVVTIAATSTVAKVNPMPPSGINQMNHPTSDMTHEIPHHNLADFEPCLGYATEGQAVGGIPLQNTLEGPQYHPQLHLLHSTISKNPHAMAEMGKLDHLEERLRAIEGGEDYAFANLEELFLVPNIITPPKFKVLDFDKYKGTTCPKNHLK

SEQ ID NO: 135667 - protein, 172 aa, Glycine max
  Coding DNA Sequence Number=SeqID_43982
  Homolog annotation: Hit_ID=A7UQU7; Match level="QueryCoverage=62%, HitCoverage=18%, E-value=2e-10, Identity=35%"; Hit description=IMP dehydrogenase/GMP reductase, putative
MSPRASRWLTSKAHMKGITGAPYRARCDALTVTDVSWLPYTKHRGLRTFDLISSFQGQLRWGPMVVTARPERVVQQFGYIQSIPPPSVSARLSHDDIYDRWMHFSEHVLPVGELCLVHGHDDYDGYEAIAQRLERVLNLRMVTAGTKLYEIMQDCLTIARGGASADGSVRAR

SEQ ID NO: 135668 - protein, 76 aa, Glycine max
  Coding DNA Sequence Number=SeqID_43983
  Subcellular localization annotation: CTP_CleavageSite=58; ConfidenceScore=5.24e-01
MHLRDQGSLLYNKEKNKMKDCKNTSGEDVFFTSRISQPLTNSSQAPRTTSSSSSGLCRSSHSKISQNSLELGPFSL

SEQ ID NO: 135669 - protein, 208 aa, Glycine max
  Coding DNA Sequence Number=SeqID_43984
  Homolog annotation: Hit_ID=A7PJZ4; Match level="QueryCoverage=53%, HitCoverage=23%, E-value=2e-15, Identity=42%"; Hit description =Chromosome chr12 scaffold_18, whole genome shotgun sequence
  Pfam annotation: Domain name=DUF1723; Domain location=159-208; Score =38.7; E_value=2.1e-08; Accession=PF08330.1; Description=Protein of unknown function (DUF1723)
MVKTRELGRALGMVVDRGLGRRDHDYSDGAPQRRRPTALARRQRVPVTVADDAPAVPADEPMVDVDAQDTDAEANAHDTGVEAATDEAKEFPGGPKDPSVLMEYAQHVAASVWSGEERPELKLSSHGRKVHKLGMHVPAIEEMVVGTGLSSLTACSIDIGDRELISSFVERWHRETSTFHLLVGEVSITLDDVTSLLHMLIVGDFHAF

SEQ ID NO: 135670 - protein, 157 aa, Glycine max
  Coding DNA Sequence Number=SeqID_43985
MDPGGATTLDAGVVAANVEGSSAGLALALALLALQIETVRSLGFQQFFLMYAKLMTGLRHLKVRLLETTPLALHRAVIRVGKPSLEELDWDIEVIWPEMRAPTFMSMQETRPKISLALSTVRSKVCDVGAKLEYERTLHTWAKVVKSFPENPPQDGP

SEQ ID NO: 135671 - protein, 93 aa, Glycine max
  Coding DNA Sequence Number=SeqID_43986
YCTPSQAQGDAPQAAGAPPPPHQADPTGSFDTERYLQHLVRQQAANHRGQVQIHMCLYQPSISQQSQGFAPFACPTPDQFRAEVAWPGYWPEA

SEQ ID NO: 135672 - protein, 39 aa, Glycine max
  Coding DNA Sequence Number=SeqID_43987
MSFSRDFLSGNRLPNLGVPPSMTIHAEPYHLVDIQDGPG

SEQ ID NO: 135673 - protein, 96 aa, Glycine max
  Coding DNA Sequence Number=SeqID_43988
MPLSPVILVTLADNELMSVASSFLSLGGAYLHGTAWLFRYGNGTGLTTEGYQGFWGAASLVKYTTKGLGLPKLLSSADCIHTCCSSLPSSPTSSWP

SEQ ID NO: 135674 - protein, 118 aa, Glycine max
  Coding DNA Sequence Number=SeqID_43989
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6Q2Z9; Match level="QueryCoverage=92%, HitCoverage=9%, E-value=2e-38, Identity=73%"; Hit description =Phosphoenolpyruvate carboxylase
MGIAETHHRVRKGGNMVLAAKSCDDIFNNLLQDGVSPDELYNTVFKQEVEIVLTAHPTQINRRTLQYKHLKIACVVSNYFSTFKQHLLDYNDRPDLSPEDRDMLIEDLVPFLNYFHSA

SEQ ID NO: 135675 - protein, 88 aa, Glycine max
  Coding DNA Sequence Number=SeqID_43990
DAGSRQARQGASAGVGGCRGWLNYAASEQIVLRVHHMRAIGAGLFAITPAGERGMCCKAIKLGNARVFPVTTLLNDGQCQACMPAGRL

SEQ ID NO: 135676 - protein, 84 aa, Glycine max
  Coding DNA Sequence Number=SeqID_43991
MSKNGRKPSRNHSRKRYESASAWIFFTELIFLSKFERERKNWGRSLPPSSPRRARLLPPEATAFWRNLLEGPSGPGCYLHPYFY

SEQ ID NO: 135677 - protein, 139 aa, Glycine max
  Coding DNA Sequence Number=SeqID_43992
MASITEAMLKLQKTIEDNATTAASNTAREAEPLPPHTDYPLQKDDEGDAHLGPLLPFKEPAPHELPQPNIVRHDLSPSAPVKELVPFAKDKGEIDLLEERLRAVEGLGNYPFSNLADLCLDSLAGAAVAWYTNLEASQI

SEQ ID NO: 135678 - protein, 200 aa, Glycine max
  Coding DNA Sequence Number=SeqID_43993
  Pfam annotation: Domain name=G-patch; Domain location=78-122; Score =14.9; E_value=0.003; Accession=PF01585.14; Description=G-patch domain
MDINPAYSCLYGKIVDSCPGSGPFNASPDIEDMLVSCPSSAPYVEAAEESLETAFQSFEVVSCASVEPSPSLPSLSNAAIMVARVMLRNGFELGMGLGKDCLGNADVVDIKGNPYKYGLGYEPGMPGRRNVPSRFRADRLWPGRISQCFTSTGMVSEEEVAAIEEEFPQDPPSFVQPCHPDSQVGNWRVISQSEVYTADS

SEQ ID NO: 135679 - protein, 250 aa, Glycine max
  Coding DNA Sequence Number=SeqID_43994
MDQVQRQAFSKVYGKIWDLAMMELAPTIEEFEGILECLIGGRKPYLFSGNGVAGIPRKCLEEKAETLASQGEWVSFINVLALLMFGTILFPNVDGLVDLVAINAFLAYHHRKESLVIAILADAYDTFDLTCEKSSARKDKANREELLAGMMGASISWFPWRKEGGAGVGAPSEETITPFIAEEAEVPKESEEVQALKAELEKTRVAKEKLKVAATRVRKECDELKDINMTTDEALEREMKKARKEEWSRN

SEQ ID NO: 135680 - protein, 187 aa, Glycine max
  Coding DNA Sequence Number=SeqID_43995
LFRYRTHPTKGAHTPTGGSSLGLGFDLASPDQQCSLWRKHSKELFAKAGIDLRPDPNDIWGTLAISHRQPISHGGPGKDLPVPVPKVAQAFGGRKDPLKVYLQGLAKGGHDSLRRAQRRLLLNASGEREEEQHVYMQSADEEGPKKPKPLVIHFTRNTTPQRPQHPSAVSGGRSIPFPYENNRAVSW

SEQ ID NO: 135681 - protein, 219 aa, Glycine max
  Coding DNA Sequence Number=SeqID_43996
  Homolog annotation: Hit_ID=A6FJQ2; Match level="QueryCoverage=17%, HitCoverage=84%, E-value=6e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPIQPTCQGSKRLARASSGLAREDMALSTQGRETCRASCINESANARGEAVCVLGALPLPRSLTRCARSFGCGERYQLTQRRTIKIPGVSPWKLPRALSCSDPAAYRIPVRLSPFGKAWRFLIAHAV

SEQ ID NO: 135682 - protein, 76 aa, Glycine max
  Coding DNA Sequence Number=SeqID_43997
  Homolog annotation: Hit_ID=A5BP71; Match level="QueryCoverage=86%, HitCoverage=17%, E-value=7e-11, Identity=49%"; Hit description =Putative uncharacterized protein
  Pfam annotation: Domain name=zf-CCHC; Domain location=35-52; Score =18.9; E_value=0.0021; Accession=PF00098.14; Description=Zinc knuckle
MDTNPDPTTIRAKGRPKSTRIRNEMDWVEPSDHRQKCSRCGAEGHNRRRCPMQSDRGKVEINGVDQSRLSDIGVHH

SEQ ID NO: 135683 - protein, 138 aa, Glycine max
  Coding DNA Sequence Number=SeqID_43998
MHYLDHLAAGGQICLVPGQCAPDYMDWFFRISHLFITPIQAVDPPKHPLVPQHDTYVESDIPEVPMAPEAGPSHAPSDAEQPRHAVDACQAIAKRLERLLNLRIVTTGTEIHEVMEDYIRIARGITVDGNAYVRARRR

SEQ ID NO: 135684 - protein, 367 aa, Glycine max
  Coding DNA Sequence Number=SeqID_43999
  Gene Ontology: Mol. function=phosphoprotein phosphatase activity; Biological process=intracellular signaling cascade
  Homolog annotation: Hit_ID=A7R8Y3; Match level="QueryCoverage=35%, HitCoverage=38%, E-value=2e-26, Identity=44%"; Hit description =Chromosome undetermined scaffold_3090, whole genome shotgun sequence
MKRHEFVWEPYTATVMGALPPICVVGSVAWFAVVPLICFHVVEWHQPDRVLRQFGLQQPIPGCPSQPQNLHGITLKGKQDENWFHLLALIIGQWNNQAEFRVDVYPRQEGLLGYNSDYMVWYRRKTKMFVDPNNANTAALGEVVETLQYMVSPQGRNTWTVDDLVPYVDKLAIISEEQERITEPVSHGPASEREFPAPKFHILQSSVETRGIGRQREPIEAEKYSQQMMERGHGMYYTPATFSEYPSQMYQYPFAGHDTDTSETSHSFSGVAETQPHFSWPTMTPSQQHNAPMATPNAPFAPQWNVPGAIPDMGDLLGVDLRQEFSAKAEQAEAGRQRGGRRNPDHQARRWDQPCGTSSRHHGHHND

SEQ ID NO: 135685 - protein, 76 aa, Glycine max
  Coding DNA Sequence Number=SeqID_44000
MAYTHISVEDSQAILLKFQPARINYTLHLTLQGHTMLNGMPQGSSMISTHCVRVVSSEKWRLRKPSRGYGYHCSIK

SEQ ID NO: 135686 - protein, 186 aa, Glycine max
  Coding DNA Sequence Number=SeqID_44001
  Homolog annotation: Hit_ID=Q5CEG7; Match level="QueryCoverage=48%, HitCoverage=84%, E-value=4e-36, Identity=82%"; Hit description =Senescence-associated protein
  Subcellular localization annotation: CTP_CleavageSite=37; ConfidenceScore=5.56e-01
MNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGIRCTICGRAHESRCCIPNEEQIAHEVNYMGNQPRGNFITSGFPGFQNNQQYQQQRQWQNHPGNQFKRDQGGSSTRP

SEQ ID NO: 135687 - protein, 87 aa, Glycine max
  Coding DNA Sequence Number=SeqID_44002
  Homolog annotation: Hit_ID=Q2HW90; Match level="QueryCoverage=81%, HitCoverage=14%, E-value=4e-09, Identity=43%"; Hit description =Putative uncharacterized protein
MGSNQAPSFKKRFYHVKIKSLEVAGLRELGQRMDQVQRQAFRKAYGKIWDLAMIEVSVEAITSLTQYYDQSLRCFTFRDFQLVPTIE

SEQ ID NO: 135688 - protein, 158 aa, Glycine max
  Coding DNA Sequence Number=SeqID_44003
SSNLALVSEEDLIVMWAFHKGLQIDWAHLVRYRMHKALRLNAPLPYPHLVTLFLQHFNIPLDSEPYLPIKRSFLIGASVIASFGYQKEHDGSWVKKGARHILDRFDGLQTFVGERFDTLELQMDMCFNEMESRITKVEEDVSYIRSSFDLPPSPPPSS

SEQ ID NO: 135689 - protein, 92 aa, Glycine max
  Coding DNA Sequence Number=SeqID_44004
  Homolog annotation: Hit_ID=A5AZ23; Match level="QueryCoverage=48%, HitCoverage=3%, E-value=3e-08, Identity=57%"; Hit description =Putative uncharacterized protein
MAYRGQLARCLTAVSIGPPSSRMHGEFVALVSLVREQAAHFYGDSKCLNNPYFMGPFPISFGFVYIPLDVDYVSKWVEAKPTRTDDAKVWSP

SEQ ID NO: 135690 - protein, 156 aa, Glycine max
  Coding DNA Sequence Number=SeqID_44005
MNEEGPVGGARTDGAVKGAAVEEDGTVVEGVVEGSGKVDEEGAEVSGAAEVGGASDLLPLAFLGPLNVTVGSSRFQQFFFIYVKLMAGLRLSKDMEFDVTPLALHKVVIKAGMLGNDRNLVGDECDVRRVEGRDQVGVRKNTPSMSECGHVLPEDL

SEQ ID NO: 135691 - protein, 232 aa, Glycine max
  Coding DNA Sequence Number=SeqID_44006
  Gene Ontology: Mol. function=RNA-directed DNA polymerase activity; Biological process=RNA-dependent DNA replication
  Homolog annotation: Hit_ID=Q5NRP4; Match level="QueryCoverage=42%, HitCoverage=6%, E-value=8e-09, Identity=35%"; Hit description =Putative gag-pol polyprotein, identical
  Pfam annotation: Domain name=zf-CCHC; Domain location=189-206; Score =22.6; E_value=0.00058; Accession=PF00098.14; Description=Zinc knuckle
MSHHSSSVNGEGTSHKDSLSRILDELSFLKLWNEKLERKEKEKERVKINQDEREQIRAEERRKILKVLRKEKHAFYSSHDPCKSLSEELHDYYEGRHREKKRKPQEANINLPYFHGKDNVEANLDWEIRVEQQLKKKSTSKSYGSHSYPKKDQGQGILGVTPSNPKDDKGKTIEKQAPKASMQEKTSSIKCFKCLGRGHITSQCPTTKTMIMRGQDIYSSQDEATTSPSSSE

SEQ ID NO: 135692 - protein, 100 aa, Glycine max
  Coding DNA Sequence Number=SeqID_44007
MSCGSVQVEGTSTWLFKENKGGYIPCGSLLVKDFTRLLEISRTSGCLGTGRILRKVLQLQDSWPPQILCFPKETPSIGHLSLLVRVTTIGKPECQSLLKP

SEQ ID NO: 135693 - protein, 148 aa, Glycine max
  Coding DNA Sequence Number=SeqID_44008
  Homolog annotation: Hit_ID=Q2HUM1; Match level="QueryCoverage=38%, HitCoverage=72%, E-value=8e-10, Identity=61%"; Hit description =Putative uncharacterized protein
IDIGPYVPTIVNGSTTSGSTTIEKPRDKWSEEDRKVQYNLKAKNIITSALGIDEYFRVSNCTIAKEIDWQPKVTAITESTDLSTVSLATLFGKLQEHEMELQRLNQHEENDKRKKGIALKASSSIQEESDNEDLEEDEDLNIFVKRFN

SEQ ID NO: 135694 - protein, 52 aa, Glycine max
  Coding DNA Sequence Number=SeqID_44009
WAKRISTAKENFGRASASKPCAKHEISVISAAGAFSLAKLKTGAKLNFTYSR

SEQ ID NO: 135695 - protein, 114 aa, Glycine max
  Coding DNA Sequence Number=SeqID_44010
MTGPLDESISCFLIRVDPWVLVPITFRGLHVLALRGLHVLTFGYTPSPWVLVTLTVERTTRPRLERTTRPRLERTTRPRLERTTRPHHQRAARPHLQRTTCPRLERATRPHLGY

SEQ ID NO: 135696 - protein, 113 aa, Glycine max
  Coding DNA Sequence Number=SeqID_44011
MCGISCQCQDLHAILLKITTSPHQLDLAPYASEPYNAQWNPPGLLHDRHTLRSSRILGEMEVDEPWLGLWLPLNYQVDMGARMAFVDNGAVGKEKVCYWLSKDIVGLVGNLAV

SEQ ID NO: 135697 - protein, 275 aa, Glycine max
  Coding DNA Sequence Number=SeqID_44012
  Homolog annotation: Hit_ID=Q2HW90; Match level="QueryCoverage=81%, HitCoverage=52%, E-value=4e-14, Identity=28%"; Hit description =Putative uncharacterized protein
VSIAEISIEAVVSLTIYYDQPLRCFTFGDFQLVPTVEEFEKILGCPLGGRKPYLFSGFLPSLSKIAVVKYLEGKGRDMANQEEWVPFMGVLAVLIFGVVLFPNMDGLVDLASINAFLAYHHSKESPVVAILADLFDTFDRRGCINYNPALAIRQLGYPMRGASTEESFSPFLVRYFGAQGFKVIHRVHKAWEGPLRKDKELRGIRNGIIGGYHECLKVRTRGLDWLSKLKIINEENFEALEEDEEVRALKTELGKARLAKEKFKLVATDVWKECA

SEQ ID NO: 135698 - protein, 124 aa, Glycine max
  Coding DNA Sequence Number=SeqID_44013
  Gene Ontology: Mol. function=protein binding; Cellular component =cytoplasm; Biological process=humoral immune response
  Homolog annotation: Hit_ID=Q5QM96; Match level="QueryCoverage=83%, HitCoverage=18%, E-value=9e-35, Identity=64%"; Hit description =Rubisco subunit binding-protein beta subunit-like
  Pfam annotation: Domain name=YTH; Domain location=51-124; Score =141.0; E_value=3.4e-39; Accession=PF04146.6; Description=YT521-B -like family
MRKEKIPHQAPFAIQAAQLLGRAIGAGLFAITPAGERGMCCKAIKLGNARVFPVNASGQFCGVAEMVGTVDFNKNMDFWQQDKWSGSFPLKWHIIKDVPNPNFRHITLENNENKPVTNSRDTQE

SEQ ID NO: 135699 - protein, 182 aa, Glycine max
  Coding DNA Sequence Number=SeqID_44014
  Subcellular localization annotation: CTP_CleavageSite=48; ConfidenceScore=5.48e-01
MATPPASPPPPTIASESPSTLKWMRKATRLRSLATRPPGAERSVVHVNPMTGKADSPHKKKLRTYLGIVAGRCDIQDLERSPCCSEGFVMGGYSTFDGRTKKKVLQTVGEQWRQFKSDLTRKWALAANKDSVDDTVCEKYDISKEKWAQFCQTRRDPSWEDVQKKTDVIQKQNTAPHVLSRG

SEQ ID NO: 135700 - protein, 109 aa, Glycine max
  Coding DNA Sequence Number=SeqID_44015
MRMLEDKQTKVSALQVEKEAREGVIELLHKEAMKWMDRFALTLNESQELPRLLARAKEVADTYSAPDEVHTMTSKIILMMPKNQELSKLQRIKSQKASRINFQRIMIQE

SEQ ID NO: 135701 - protein, 157 aa, Glycine max
  Coding DNA Sequence Number=SeqID_44016
MAPKKLSTKRPRRDATGEGSSATSEFDSHRFRSVEHQQRFEAIRGWSFHRERCFQLREDEYTDFQEEIARRHWTPLATPMAKFDPEIVLEFNANAWPTGEGVWDMRSWVRGQWIPFDADSLSQFLGNTLVLEEDQQCEFSQKRSQADGLDEEAITQL

SEQ ID NO: 135702 - protein, 282 aa, Glycine max
  Coding DNA Sequence Number=SeqID_44017
MQQPGAIEQPEPYAANIYNRPPQPQQQNQLQQSNYDLSSNRYNPGWRNHPNLRWSSPQQQQQQPAPSFQNAAGPSRPYIPPPIQQQQQPQKQPTVEAPPQPSLEELVRQMTMQNMQFQQETRASIQSLTNQMGQLATRLNQQQSQNSDKLPSQAVQNPKNVSAISLRLGKQCQGPQPIAPSSSANEPAKLHSIPEKGDDKNLPNNFCAGESSSTAIPRYAKFLKELCTNKRKLKGSERISMGRNVSALIGKSVPQIPEKCKDPGPLQSTDVMDFLKDQFPSF

SEQ ID NO: 135703 - protein, 37 aa, Glycine max
  Coding DNA Sequence Number=SeqID_44018
MTCKVRVAKKALNSVLEVVMMANTEWAYRMDEWAIPR

SEQ ID NO: 135704 - protein, 100 aa, Glycine max
  Coding DNA Sequence Number=SeqID_44019
MECLEGVWETLEGNERCRFRGTIRLTATSLVHPEQPARTLQQPVEWVLPTPTPYRLVESVKVIEVSSSEEDLEEDPEELPLAPTMDAPDLPEDDEDPLLD

SEQ ID NO: 135705 - protein, 22 aa, Glycine max
  Coding DNA Sequence Number=SeqID_44020
MNQGTWGRTRMDARPMINRLSL

SEQ ID NO: 135706 - protein, 43 aa, Glycine max
  Coding DNA Sequence Number=SeqID_44021
MKLCFHNRDRAHRTPSGPKEVQQGPGVSSSDYGPLSVLGYACI

SEQ ID NO: 135707 - protein, 109 aa, Glycine max
  Coding DNA Sequence Number=SeqID_44022
MRPDEVVPPEPIMPAIHETVEAGESQLRQEAATPERTSQTPKGPLSPGMDLSFAQQVADAPTPIIEMLEDPTTPVLRLSSTPPATPVLHLTNEEDMQDTQGTQDQSQEF

SEQ ID NO: 135708 - protein, 81 aa, Glycine max
  Coding DNA Sequence Number=SeqID_44023
MTKFGLCLSLGPRPPLDDKKGADYPMTKFGLCLSSGPPPLDDKKGANNRKGQYDKDYGAADKSKALAPTYPPMRNSDLRSS

SEQ ID NO: 135709 - protein, 208 aa, Glycine max
  Coding DNA Sequence Number=SeqID_44024
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=P19366; Match level="QueryCoverage=100%, HitCoverage=48%, E-value=1e-103, Identity=83%"; Hit description=ATP synthase subunit beta
  Pfam annotation: Domain name=ATP-synt_ab; Domain location=1-117; Score=73.8; E_value=5.8e-19; Accession=PF00006.16; Description=ATP synthase alphabeta family, nucleotide-binding domain
  Pfam annotation: Domain name=ATP-synt_ab_C; Domain location=130-202; Score=86.4; E_value=9.2e-23; Accession=PF00306.18; Description=ATP synthase alphabeta chain, C terminal domain
  Pfam module annotation: Pfam domain module=ATP-synt_ab::ATP-synt_ab _C; Domain location=1-117::130-202
MAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGNIDEATAKATNLEMESNLKK

SEQ ID NO: 135710 - protein, 117 aa, Glycine max
  Coding DNA Sequence Number=SeqID_44025
  Homolog annotation: Hit_ID=A5C6R1; Match level="QueryCoverage=100%, HitCoverage=13%, E-value=7e-25, Identity=49%"; Hit description =Putative uncharacterized protein
  Pfam annotation: Domain name=zf-CCHC; Domain location=22-38; Score =3.6; E_value=0.44; Accession=PF00098.14; Description=Zinc knuckle
  Pfam annotation: Domain name=zf-CCHC; Domain location=4-21; Score =20.1; E_value=0.0014; Accession=PF00098.14; Description=Zinc knuckle
  Pfam module annotation: Pfam domain module=zf-CCHC::zf-CCHC; Domain location=22-38::4-21
MSIVQCFYCKGHGHFASHCPKKFCNYCKKGHIIKECQIRPPRRNATAFTATNGSSTTPVYGDQNPPALGLSGKASLPSSPWYFDSSASNHMTINVAALTNVTNYSGSTLREDDCEGT

SEQ ID NO: 135711 - protein, 52 aa, Glycine max
  Coding DNA Sequence Number=SeqID_44026
MAVAFLQQLEGFTIRPGCREKDGNGGGLLSLTRFGSIGTTSFSPMLFFTARN

SEQ ID NO: 135712 - protein, 248 aa, Glycine max
  Coding DNA Sequence Number=SeqID_44027
  Homolog annotation: Hit_ID=Q6WAY6; Match level="QueryCoverage=99%, HitCoverage=46%, E-value=7e-09, Identity=23%"; Hit description =Putative uncharacterized protein
MGTRGCINYNLVLAIRQLGYPMRGAPLEEDLTPIIARGFNSTNAEALQKVRKAWEMGQNKDKELRGSSNGPFDGYHRWLKAYTQGLDWLPNLRTTKGVEVEAPKEDEEVQALRTELEKAQTVKEKFKSAALRIQKENAELRDVNIATTEALEQETKRARREEHGRNKFRGALWGSNSELKLRKEESNQSRVDSLILKDELRICLRSKRSLSQRLCETETNMLAILTNPSLVDVVVEETSLLHPTLPPP

SEQ ID NO: 135713 - protein, 53 aa, Glycine max
  Coding DNA Sequence Number=SeqID_44028
MGAKHLTRTKERSHVIKQRVAGDHKISANDLSFPEFHKSPNDGCQAPDKDQRK

SEQ ID NO: 135714 - protein, 153 aa, Glycine max
  Coding DNA Sequence Number=SeqID_44029
MTGRLLAGSLTFDNRIMHYIIVRILLPRSSNLAQASEEDLILMWAFLTGRQIDWAHLVQYRMHMALRANAPLPYPQLVTLFLHHFQIPLDDEPFVQVKRSFAIGAGAVTSFGYQRFDSLDNRFAGMDICLTHLEEDVGYIRQSFDLPPPPPPS

SEQ ID NO: 135715 - protein, 141 aa, Glycine max
  Coding DNA Sequence Number=SeqID_44030
MRSWVRGQWIPFDADALSQFLGDPLVLEEGQQCEFSQRRNRVDEETIAQLLCTTGQDFARTAAERRVRIMRTNMTTLTQTWMTLLLSNVMPSDHNSDLPLPKCQLVYAILTWMNDHVALVCHPPGTLWTRISLIGPCGFQR

SEQ ID NO: 135716 - protein, 33 aa, Glycine max
  Coding DNA Sequence Number=SeqID_44031
MAPTRNLLDPEKSNRALGFPALVTGLCQSFGFQ

SEQ ID NO: 135717 - protein, 234 aa, Glycine max
  Coding DNA Sequence Number=SeqID_44032
  Homolog annotation: Hit_ID=Q2HW90; Match level="QueryCoverage=97%, HitCoverage=50%, E-value=5e-15, Identity=26%"; Hit description =Putative uncharacterized protein
RQAFCKAYDKIWDLAMVEVSIEAIASLAQYYDQSLRCFTFGDFQLSPMVEEFEEILGCPLGGRRPYLFSGFYPSLARISKIVQISAQELDHRKQVRNGVVGIPRKCLEAKARILAAIDAFLAYHDHKESLVVAMLADLYDTYDRRCEKSSTRVVCYTPALYVWLVSHLFRQEVRHACPLESHRSCTEKGGANWDQLLANKEGASVNWFPQRKEGRTGVLISCRGFPNVPLMGTR

SEQ ID NO: 135718 - protein, 85 aa, Glycine max
  Coding DNA Sequence Number=SeqID_44033
  Subcellular localization annotation: CTP_CleavageSite=20; ConfidenceScore=5.15e-01
KRKSAQYANRLSPRVGRFINAAGTTGFPTGKRAACKLGTGRRLQRRDWENPGVTNLIALQHIPLSPAGVIAKRPAPIALPNSCAA

SEQ ID NO: 135719 - protein, 73 aa, Glycine max
  Coding DNA Sequence Number=SeqID_44034
MAESGLEESEWAQARYDQLNLIEARSRIVSGHGQKSRQVNGRNQPRYIGTDASGARVMTDRSLPLPGAKQAEN

SEQ ID NO: 135720 - protein, 156 aa, Glycine max
  Coding DNA Sequence Number=SeqID_44035
MAASGHAILRDRAHSPTKRSLLELSSQDALLAQNKLLSKQLEALTKTLSCVICGGAHESGCCIPQEETTHEHGQPYNSQQGQWRNHPGNHFNKDQGGPSNRPPQQGPSLYDQTMKLEETCSVHASIYVKPKEHRASHKESGSPGGTVGETIGRSFV

SEQ ID NO: 135721 - protein, 198 aa, Glycine max
  Coding DNA Sequence Number=SeqID_44036
MGEAEEVQEKMKAEMEAMKEQMATMMEAMMSMKKIMEANAVIVAATSAVAKVNPMLPSGLNQMNHPTSNMETHEIPYHNLADFEPCLGYAAEGQAVGGVPLQNTLEGPQYHPQPQPSRFTTEMLRAIEGGEDYAFANLEELFLVPNIVTPPKFKVPDFDKYKGTTCSKNHLKMTTVTWYTNLGTFLSPFLEGPNGCPR

SEQ ID NO: 135722 - protein, 82 aa, Glycine max
  Coding DNA Sequence Number=SeqID_44037
MAHEIQLSCLQKKNEKSDKRNFKEKKEKKGYITWEDSVINSYLAHGPKIYRKAHENPRAFSCIFDPIYLESSIQCPCGVIST

SEQ ID NO: 135723 - protein, 53 aa, Glycine max
  Coding DNA Sequence Number=SeqID_44038
MGDRLEDMIRDLGQESFQQAHALMYNTLQNDSKKPLYPRCNNSLTLLSAMLSL

SEQ ID NO: 135724 - protein, 79 aa, Glycine max
  Coding DNA Sequence Number=SeqID_44039
MQAWSFTLWVEIPKFSLVDNQVEAPEEKANKIKSFFIYAVGNWDAEFYAKRDWGEHTIHEKQTRETIGTDKNHTQKTIL

SEQ ID NO: 135725 - protein, 57 aa, Glycine max
  Coding DNA Sequence Number=SeqID_44040
VKKRLSHEVLKVTVELSSSVGLSAHPPLSAASAHLARQKNLAENQYQGHTLSARSVR

SEQ ID NO: 135726 - protein, 72 aa, Glycine max
  Coding DNA Sequence Number=SeqID_44041
MPIGWTSQKSGADIEEEELTDLRSNPLQGEGDDAILPRKGPITRTMSKRLQEDWARVAEEGPRVLMNLRVDF

SEQ ID NO: 135727 - protein, 105 aa, Glycine max
  Coding DNA Sequence Number=SeqID_44042
  Gene Ontology: Mol. function=phosphoprotein phosphatase activity; Biological process=intracellular signaling cascade
  Homolog annotation: Hit_ID=A5C0F5; Match level="QueryCoverage=99%, HitCoverage=15%, E-value=4e-17, Identity=41%"; Hit description =Putative uncharacterized protein
MSALPPICVVGSVAWFAVVPLICFHVVEWHQPDRVLRQFGMQQPIPGCPSQPQNLHDITLKGKQDENWGQLWAPLISQWNNRTEFKVDVYPRQDVLLSFNSDYMV

SEQ ID NO: 135728 - protein, 82 aa, Glycine max
  Coding DNA Sequence Number=SeqID_44043
  Subcellular localization annotation: CTP_CleavageSite=20; ConfidenceScore=5.01e-01
MAVLKVALSSVRIYCFRIIMANSHKSRKRSLSLSKIIGRPVRVTMFCENTPTIWDQHRLKEALKPGDPQGLHSEESVRASPS

SEQ ID NO: 135729 - protein, 210 aa, Glycine max
  Coding DNA Sequence Number=SeqID_44044
  Gene Ontology: Mol. function=nucleic acid binding
  Homolog annotation: Hit_ID=Q2AA09; Match level="QueryCoverage=86%, HitCoverage=59%, E-value=4e-09, Identity=28%"; Hit description =Retrotransposon gag protein
MERSMIDTASGGALGDMTPAEARNLIEKMAFNSQQFSARNDAIFIRGVHEVATNSSSSGETKKLEGKQDALVNLVTQLVMNQKSAPVTRLCGLCSFADHHTDLCPSMQQSEAIEQPEAYATNIYNRPPQPQQQNQPQQNSYDLSSNRYNPGWRNHPKLRWSNPSQQQQQQPYFQNVASPSRPYVPPPIQQQQQQQPQKQQTVEASSATFP

SEQ ID NO: 135730 - protein, 80 aa, Glycine max
  Coding DNA Sequence Number=SeqID_44045
MAYKTKPSMVQSSTDQSKETDSEKLNFEVEIEDRHAETQAVNWPLDEEKSEEEEQEEADYVLARDRTRREIKLLDQVASE

SEQ ID NO: 135731 - protein, 85 aa, Glycine max
  Coding DNA Sequence Number=SeqID_44046
MDCHNQKGGDCGSNAFQDYFDDAKESRIKQVPKNQESKSFKNQVSKNQDSRIIKFQDLIKFQESRFKNNQDQDSRIKRRLNQDKY

SEQ ID NO: 135732 - protein, 96 aa, Glycine max
  Coding DNA Sequence Number=SeqID_44047
MWKRIRRVELVLWMRWWLRNDELLKPKRRRMNPYISIGEIKRKLKKKKIASYGSRFDEEMSKIGRFRGLGMEECRKREEAAQGFLENVIFIEQDAL

SEQ ID NO: 135733 - protein, 53 aa, Glycine max
  Coding DNA Sequence Number=SeqID_44048
FYHLSLVATYPSAGGRHEGSRVRLPWEENARSRHQRLFEENVGKIEKGVVYEL

SEQ ID NO: 135734 - protein, 83 aa, Glycine max
  Coding DNA Sequence Number=SeqID_44049
MANLTSSRINGELTLAGQLAKQLAEKSSSTFGANVEAMPSKVILMMPKNQELRKFQIFKNLVSRIKIQDSRFKYQVSRIKIQE

SEQ ID NO: 135735 - protein, 144 aa, Glycine max
  Coding DNA Sequence Number=SeqID_44050
MTLIGWKYQRLPSFLKTKVRASSPSIALTAQIATMVMTIALQELLSLGILFEKQYNATSDSTASSSFSDSCAKALQLYASTFSCCRKSKVSQVRQQEEEEARPLTVALELPFHPPLKKESHPSAVPTIRHFPEESISEGGKIQD

SEQ ID NO: 135736 - protein, 69 aa, Glycine max
  Coding DNA Sequence Number=SeqID_44051
MASGNRLPRVCNRLQGLKWRQDVKMVSANRLPIVCNRLHRVTGHCNRLPIGCNRLHREIGHWFPCAKAV

SEQ ID NO: 135737 - protein, 307 aa, Glycine max
  Coding DNA Sequence Number=SeqID_44052
  Homolog annotation: Hit_ID=A5ADW6; Match level="QueryCoverage=84%, HitCoverage=11%, E-value=1e-10, Identity=23%"; Hit description =Putative uncharacterized protein
HSITGESVHSVIGDFEHPDLEHYNFEHSDYEHSDFAHSENMAQPPPCERTLREIAAPDFTYESLCIQYPDEDVPYVLKTGLIHLLPKFHGLAEGVAKDWLYYLAPRSITSWDDLKRVFLEKIFPASRTTSIRRISQMLASGGALGDMTPAEARNLIEKMASNSQQFSTRNDAIVIRGVHEVATNPSASSETKKLEGNLDALVNLVTQLALNQKSVPVARVCGLCSSTDHQTDLCPSMQQPGAIKQPEAYAANIYNRPPQPQPQNQPQQSNYDLSSNRYNPGWRNHPNLRWSSPQQQRQQPAPSFQNA

SEQ ID NO: 135738 - protein, 125 aa, Glycine max
  Coding DNA Sequence Number=SeqID_44053
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=65%, E-value=2e-33, Identity=100%"; Hit description=LacZ protein
MENDLGMDKLESFHGGTLVQEMVKGLRANGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 135739 - protein, 139 aa, Glycine max
  Coding DNA Sequence Number=SeqID_44054
RDSKVSMTDLVSAEDDAFRITDSKKVYTDNHSGISARQRDSKVSMTDLVSPEDDAFRLTDSKKVYTDNHSGISARQRDSKVSMTDLVSAEDDETTFASACYHAFRLTDSKKVYTDNHSGISARQRDSKVSMTELVSAED

SEQ ID NO: 135740 - protein, 315 aa, Glycine max
  Coding DNA Sequence Number=SeqID_44055
  Gene Ontology: Mol. function=3-dehydroquinate synthase activity; Cellular component=mitochondrion; Biological process=aromatic amino acid family biosynthetic process
  Homolog annotation: Hit_ID=A4W7Y5; Match level="QueryCoverage=100%, HitCoverage=87%, E-value=1e-150, Identity=85%"; Hit description=Iron- containing alcohol dehydrogenase
  Pfam annotation: Domain name=DHQ_synthase; Domain location=18-315; Score=-93.6; E_value=7.9e-06; Accession=PF01761.11; Description=3 -dehydroquinate synthase
  Pfam annotation: Domain name=Fe-ADH; Domain location=12-315; Score= -136.1; E_value=2.6e-07; Accession=PF00465.10; Description=Iron -containing alcohol dehydrogenase
  Pfam module annotation: Pfam domain module=DHQ_synthase::Fe-ADH; Domain location=18-315::12-315
MSTTDIRVVPGPANYFSHSGSLARLNDFFTPEQLSRAVWIYGERAIEGARPFLPESFNAPGAKHLPFKGHCSERDVTHLVHEAGSEASVVIGVGGGALLDTAKAVARRLGIPVVAIPTIAATCAAWTPLSVWYNDAGQALQFEIFDDANFLVLVEPQIILNAPAEYLLAGIGDTLAKWYESVVLAPQPENLPLTVRLGINGALAIRDVLLAHSEEALADQQRGEQTQAFRDVVDAVIAGGGMVGGLGERYTRVAAAHAVHNGLTVLPQTEKYLHGTKVAYGILVQSALLGQEDVLAQLISAYQRFNLPTTLRALE

SEQ ID NO: 135741 - protein, 44 aa, Glycine max
  Coding DNA Sequence Number=SeqID_44056
MGPLQRQAFCKVYGKILDLTAAEVFTEAVVSLAQYYDQPLRLKA

SEQ ID NO: 135742 - protein, 38 aa, Glycine max
  Coding DNA Sequence Number=SeqID_44057
MRIPGCLATVLSVSPELGKGGRSIGRDPSLYLRPSLST

SEQ ID NO: 135743 - protein, 377 aa, Glycine max
  Coding DNA Sequence Number=SeqID_44058
MASKKRKATTSRLQEPYDTTKFTFEGAWERYSQNIHSRNILPEKNVNLFVTKYDEFRWELIRRNWHKALTQFMDEHIDVALVKEFYSNLYDPEDKSPKHVRVRGRLIKFNAASLNAFLETPPLIQPGEQSALEAPEEGSDDTSPDLEDPQGPGQGPSATTSTPSAPSASVPPLPPSSAPTLVHTGTSAQSSDLMVLMLQSLHHGSCLVMQSIHDLAQHRPIISMEDFMAQVAWPGVQPSPLGGGQASTAQEPQPQPETTPRTSPVTTPVLEVSKEEDGAADIGYVVDLQATQSTWDPWPTTAQDIPQPAQDAPSSPQDEPTAACALSENHALSEALSPLSELEESRGESENHLCAQHVISSLSESLVSSCAKRAQLA

SEQ ID NO: 135744 - protein, 117 aa, Glycine max
  Coding DNA Sequence Number=SeqID_44059
MVGKDLGSTGGPHYAQSQNKHAFPPYGLPPNYTPSNVAYTPTDLEPCLEQATEGQAVGGIPLENTLEGPQYHPQLHLLHSTISKNPHAMAEMGKLDHLEERLMAIEGGEDYAFANLE

SEQ ID NO: 135745 - protein, 120 aa, Glycine max
  Coding DNA Sequence Number=SeqID_44060
  Pfam annotation: Domain name=DUF1723; Domain location=59-103; Score =17.0; E_value=0.0051; Accession=PF08330.1; Description=Protein of unknown function (DUF1723)
EAIADDVVVDVEGFPGGPHVTSVFMDYVHHVVVTVWNGKERPVLKLSSHGSCPPIEKIGRPAPEIEGLVETSSFHLSVGEVTITLDDVALLLHLPIIGAFYSFEALHVDQVVDLLVDLLE

SEQ ID NO: 135746 - protein, 30 aa, Glycine max
  Coding DNA Sequence Number=SeqID_44061
MGKGKHSLSHEPDELTNYSTPLSSPTPPES

SEQ ID NO: 135747 - protein, 73 aa, Glycine max
  Coding DNA Sequence Number=SeqID_44062
MHWGLSLLRKLINSLGWLIRWMLWLQEFDLEICDAILPRKGPITRTMSKRLQEDWARAAEEGPRVLMNLRVDF

SEQ ID NO: 135748 - protein, 234 aa, Glycine max
  Coding DNA Sequence Number=SeqID_44063
MADVSRGPTQRKDKPACQSWRGAVNVVESGRPRRSKPLKDVTTPTRFIYEALQKGGIIPRGGHEKDSYLMHPSAPHSMEACLAVGDLLQQMIDQGRLEVGDEGGEEQHICIQSTDEEGLRKPKPLVIHFTRDAARQTPRHPSVVRPIPFPYKNSHAVSWRYAPPSERKEGATDISSLLAKVTNITGLSGMTRNSHVFAPPDLPTQPANTKGKARMTEGQNVKVIPAPDEDVSMK

SEQ ID NO: 135749 - protein, 26 aa, Glycine max
  Coding DNA Sequence Number=SeqID_44064
MNKKDKWWLDRNIEMAITEATGLQMR

SEQ ID NO: 135750 - protein, 63 aa, Glycine max
  Coding DNA Sequence Number=SeqID_44065
MLEDPASVEGVLSVWRTTMLQTKFREDPTVNEGWAAFLPRQLHVAFSRSFIKRLPPEASSWLL

SEQ ID NO: 135751 - protein, 64 aa, Glycine max
  Coding DNA Sequence Number=SeqID_44066
AEFEIPKASESRTKKKLLKTVADQNSVDDTVYEKYNISKEKWAQFCHTRRDPSWEDVQKKARAI

SEQ ID NO: 135752 - protein, 215 aa, Glycine max
  Coding DNA Sequence Number=SeqID_44067
MAKFDPDIVLEFNANAWPTEEGVRDMRSWVRGQWIPFDADALSQFLGDPLVLEEGQECEFSQRRNRADGFDEEAIAQLLCTPGQDFARTAAGRRVRIMRTSMTTLTQMWMTLLLSNVLPSDHNFDLPLPKCQLVYVILTRMSVHMAQLIADAIYLFVGMPPTKHPLDPDKSNRALVMQSYPAKALGRRLQVDWARDPREGPRVLMSLRVDFEPMG

SEQ ID NO: 135753 - protein, 70 aa, Glycine max
  Coding DNA Sequence Number=SeqID_44068
MQSQGFASFSCPTLDQFRAEVAWPGDWPEAQAGEAPPEAPGDGEEAHEDEEMADLLDFLGGSGDTAYIFV

SEQ ID NO: 135754 - protein, 108 aa, Glycine max
  Coding DNA Sequence Number=SeqID_44069
MENWRTTLGNQFAGHQTRWWRMHERCRNVPFCGRARRGSRVRFPKEERCAESPPTFICGKGQKNRRKPVKMKILSSGVIFTLGEGISTSHVCLEGQQPIFRFVEIVLP

SEQ ID NO: 135755 - protein, 160 aa, Glycine max
  Coding DNA Sequence Number=SeqID_44070
MEIIISVPLITCDFCRREHYQDNCYMYSTNNSGWRQLTPYNQYEEQRVPDLDIVFAEFMAYHASSKANHNAIQKQEIQCAKVFFEDYQGEPESQFYYQNELERSFNLDILLMQFKDTIGSIQRAFKSAEIQVGKLVEEVTQAMSRREEEIVKVDTQEESP

SEQ ID NO: 135756 - protein, 68 aa, Glycine max
  Coding DNA Sequence Number=SeqID_44071
MNSTSFQGLENQKTSESPFGTKKKKKFKEIHRLVKDCNEMIGKVFKIIEMQNKALLLQTLHVWSRRPF

SEQ ID NO: 135757 - protein, 80 aa, Glycine max
  Coding DNA Sequence Number=SeqID_44072
MLRNLTDYVIIPFLPSGTLRNFTDCALTFLFNFRHATKLHGLCYNAFLLASGMSRNFTNYLRMGAKYLEVVKRGSHPNNG

SEQ ID NO: 135758 - protein, 168 aa, Glycine max
  Coding DNA Sequence Number=SeqID_44073
  Subcellular localization annotation: CTP_CleavageSite=13; ConfidenceScore=5.19e-01
MLFYVKPAKRLTLCQAGMSSRKRKSVGSRPTPQYDTRRFQSFEAWTRYTDNVLGRYILVERKVEIYHTELGEFKGEMERRNFHKRLTNLADSSIDLALVKEFYANLYSPEGPSPKQVRIQSHLITIDADNLNAFLETPVVLAEGESLPAYSRYCRMPTDTREIEVALC

SEQ ID NO: 135759 - protein, 92 aa, Glycine max
  Coding DNA Sequence Number=SeqID_44074
MCRWQRTKLFVDELRGFGGGGSASVTRCWPSLGYCGVSPCACLVAQGPDDLAGGDRHSVELTEARNQSWKPQDPVGLLRVHWVSCGCDPCKQ

SEQ ID NO: 135760 - protein, 92 aa, Glycine max
  Coding DNA Sequence Number=SeqID_44075
MPAGRLLEDPTNFCSTRSVSKLNLTIIPHPKPYKLQWLNEQGEMIVNQQVKVANNQVQIKIKWDEEKNRKRKEEQPLMVKEECKEVVSPPRG

SEQ ID NO: 135761 - protein, 93 aa, Glycine max
  Coding DNA Sequence Number=SeqID_44076
MLDSFGSDFLGNLMLRNSNIHHSISWSAQTILKGRVFPVFDFEDLSAMPGANLLAMGSSFRFDLLLRMRSPGAGSGALGAGSPLWIVLFICDS

SEQ ID NO: 135762 - protein, 73 aa, Glycine max
  Coding DNA Sequence Number=SeqID_44077
MRGKSSVGNLTPLDLEIEATCKRNNAERRRKILQERTAQPSLEEVQSSKSSSAFPDLRESEVGASEAHIMAED

SEQ ID NO: 135763 - protein, 81 aa, Glycine max
  Coding DNA Sequence Number=SeqID_44078
MEKEDDWRHHFKEKMSQEEAHHHRKPWIRASHGPKIYRKAHENHRVFSCISDPIILESSIQCSWRIGLHHMATTNNCYIKT

SEQ ID NO: 135764 - protein, 73 aa, Glycine max
  Coding DNA Sequence Number=SeqID_44079
MTNKVKRMYHHVENNSEGHKERDNKGIFMYQKKYVEDIPKRFNMMECNSVITPTETGIKLQIDGDEKEVDPTL

SEQ ID NO: 135765 - protein, 170 aa, Glycine max
  Coding DNA Sequence Number=SeqID_44080
MQSHVMSSPLSRDFLFSEGEVVVGRDVTDESPKVFYGDVLGYMSFIQDFYQQSSVRLRAHEQFQKRDSSWALSSLEKTFHRNILTQSGDHFDIWSFHHPCLPFSIWGLRRQVKGCEYATAAGYAAQPRDIGYFGRQRADVGSSFLLIAQRRVPPQNCVTIFVWKRNRSNY

SEQ ID NO: 135766 - protein, 103 aa, Glycine max
  Coding DNA Sequence Number=SeqID_44081
MVNDSRIGTLLKTLLSLVDVCIELINGEDQSNSREKPEETTTIRDDALRWLTMLRLGGIDGNPVLRGTRRRTTGQETLGTSGWVLLPKTKLDQSRPNPGIVSQ

SEQ ID NO: 135767 - protein, 117 aa, Glycine max
  Coding DNA Sequence Number=SeqID_44082
MLTVSCIVDIGRKKLELDFEDQKIDFDLFVEDKLAPKHNVCLQVMEGGQEVLKKNSPFAKHKPCAKRISVHVLSRESQVLSAQPLHLRLIHSTKVAKAKLSLIEFDLNSAKRHLILG

SEQ ID NO: 135768 - protein, 189 aa, Glycine max
  Coding DNA Sequence Number=SeqID_44083
VNPWVLEPIAFRGLHVLTFRGQHTLTFRGLHVLAFRGLHALAFRALQVLTIRGLQILTFRGLHVLAIRGLHVLLFRGLHALPFRGLHVLAFRGLHDYTSSSSEDYKSSPSKDYTSSPSEDYTSLPSEDYTSSPSEDYRSSPSEDYTSLPLEDYKSSPSEDYTSSPSEDYTPSPSEGYTPSPSEGYTPSP

SEQ ID NO: 135769 - protein, 82 aa, Glycine max
  Coding DNA Sequence Number=SeqID_44084
RTREPRLRSPAKGHVATALPPQDERTPSPPPQREDSALLNEVLTELRGLRSYVGDHFDSLDIRFAGMDIRLTQLEEDVGYIR

SEQ ID NO: 135770 - protein, 168 aa, Glycine max
  Coding DNA Sequence Number=SeqID_44085
MRGAPSVESLTPFITRGFSDPNARVLQRVRKAWEVVERKDRELRGSSNRTIGGYHRWLRAYTQGLDWLPKLRAAKEEEVEASKEREEVQALKAELEKAQAIKEKFKTTAVKIRRENDELRDINTATAKALEQEPKRAWKEEHSRNKFRGALWGSNNELKLQREERNQS

SEQ ID NO: 135771 - protein, 31 aa, Glycine max
  Coding DNA Sequence Number=SeqID_44086
WQPTAVRGGHRWSWVVEKKVLGFGWAFGVTP

SEQ ID NO: 135772 - protein, 94 aa, Glycine max
  Coding DNA Sequence Number=SeqID_44087
MKQKPPTLIPKTIPKLQNSLRIMTELQNQGKGNKTQKGYQRNLTHQGSINKNQAQRLLCKQSMGQNTPNDYEACRCAQILIKAVNSSLSNYHDM

SEQ ID NO: 135773 - protein, 52 aa, Glycine max
  Coding DNA Sequence Number=SeqID_44088
MVVVDGDGGTAWSTVVLRWLLFLLEKGRMGRRGKRCDGVTLHRPYHHLTKED

SEQ ID NO: 135774 - protein, 46 aa, Glycine max
  Coding DNA Sequence Number=SeqID_44089
MVIGNSQRQSQTYNLNSLEMPKGWLSHANQCHLPTVHGQVPQHLTH

SEQ ID NO: 135775 - protein, 131 aa, Glycine max
  Coding DNA Sequence Number=SeqID_44090
  Homolog annotation: Hit_ID=A7P4H6; Match level="QueryCoverage=92%, HitCoverage=50%, E-value=6e-16, Identity=44%"; Hit description =Chromosome chr4 scaffold_6, whole genome shotgun sequence
MEDGDNILDAIYEEDTLDDDVDMVDVEEGELVEPDSQNVLGQSSAGDINEPNQEPLSKNQKRRANKKKNKKKRKGSGSNAMDINRFVLDTCRRLKEKKSYMVYTAVGCLGVSALSDLVNEVVKPCYVLNFD

SEQ ID NO: 135776 - protein, 234 aa, Glycine max
  Coding DNA Sequence Number=SeqID_44091
MEQKKGESSIAPVPKVNERDVSVDLPLRGKKILPSYKTTHFQIQVFLPKLLVDVDFASGMQEYCCPKHCRDPCQKMKLALLEKNPLSLAPTFGSLTFKMLHNMPPPVRNRLPSAVFWPPQSSILKPLEHKEKLSTASGDAFSQLVANMEMTQLECSLVDICQGMGRTEEVQEHRESSNKSEDDEPWVRKYITEDAGTSKLKQGFGRSKLASGRKICKVRDKIAHIREYEYPYGA

SEQ ID NO: 135777 - protein, 78 aa, Glycine max
  Coding DNA Sequence Number=SeqID_44092
MIQQVVEQRKNHEHCARNEKSPYNEHSRLPLENRGGGRWQTWRGYQKVAMKSDNDDSGIGGNERRLMESDIGDGSRIG

SEQ ID NO: 135778 - protein, 657 aa, Glycine max
  Coding DNA Sequence Number=SeqID_44093
  Gene Ontology: Mol. function=transcription factor activity; Cellular component=nucleus; Biological process=regulation of transcription, DNA-dependent
  Homolog annotation: Hit_ID=A5AMI6; Match level="QueryCoverage=96%, HitCoverage=99%, E-value=0.0, Identity=57%"; Hit description =Putative uncharacterized protein
  Pfam annotation: Domain name=AP2; Domain location=297-354; Score =50.2; E_value=7.1e-12; Accession=PF00847.11; Description=AP2 domain
  Pfam annotation: Domain name=AP2; Domain location=396-448; Score =60.8; E_value=4.7e-15; Accession=PF00847.11; Description=AP2 domain
  Pfam module annotation: Pfam domain module=AP2::AP2; Domain location =297-354::396-448
  Subcellular localization annotation: CTP_CleavageSite=51; ConfidenceScore=5.21e-01
MKRMNESNNTDDGNNHNWLGFSLSPHMKMEVTSAATVSDNNVPTTFYMSPSHMSNSGMCYSVGENGNFHSPLTVMPLKSDGSLGILEALNRSQTQVMVPTSSPKLEDFLGGATMGTHEYGNHERGLSLDSIYYNSQNAEAQPNRNLLSHPFRQQGHVNVETHPYYSVFACRGLYQAPSEEEATKETHVSVMPQMTGGGLQNWVAPTREYSTHQQILEQQMNCGIWNERSGVSVGTVGCGELQSLSLSMSPGSQSSCVTAPSGTDSVAVDAKKRGHAKLGQKQPVHRKSIDTFGQRTSQYRGVTRHRWTGRYEAHLWDNSCKKEGQTRKGRQGGYDMEEKAARAYDLAALKYWGPSTHINFSIENYQVQLEEMKNMSRQEYVAHLRRKSSGFSRGASIYRGVTRHHQHGRWQARIGRVAGNKDLYLGTFSTQEEAAEAYDIAAIKFRGANAVTNFDISRYDVERIMASSNLLAGELARRNKDNDPRNEAIDYNKSVVTSVNNGETVQVQARNNNENDSEWKMVLFNHPLQQQANGSDHKIMNCGNSRNSAFSMALQDLIGVDSVGSEQHNMLDDSSKIGTHFSNPSSLVTSLSSSREASPEKMGPSLLFPKPPPMETKIVNPIGTSVTSWLPSPTVQMRPSPAISLSHLPVFAAWTDT

SEQ ID NO: 135779 - protein, 159 aa, Glycine max
  Coding DNA Sequence Number=SeqID_44094
MGQPRTHSQGNIPFSWERKPGVPKVTTAESFRREHKFVHKLQPPPYTSNFQRNSVDVFQIPLPPCAFQPPNYETFSKMQDGDPFFAAYKKCTKSTKSVDRNSKLQINTSMETTQTRLRNSISMSFISCKRSCAVRDNNLVRVSRLPQNVDEESDYCIII

SEQ ID NO: 135780 - protein, 347 aa, Glycine max
  Coding DNA Sequence Number=SeqID_44095
  Gene Ontology: Mol. function=protein serine/threonine kinase activity; Cellular component=nucleus; Biological process=protein amino acid phosphorylation
  Homolog annotation: Hit_ID=P51568; Match level="QueryCoverage=97%, HitCoverage=86%, E-value=1e-138, Identity=70%"; Hit description =Serine/threonine-protein kinase AFC3
  Pfam annotation: Domain name=Pkinase; Domain location=74-346; Score =155.4; E_value=1.5e-43; Accession=PF00069.16; Description=Protein kinase domain
  Pfam annotation: Domain name=Pkinase_Tyr; Domain location=74-346; Score=-92.8; E_value=1e-06; Accession=PF07714.8; Description=Protein tyrosine kinase
  Pfam module annotation: Pfam domain module=Pkinase::Pkinase_Tyr; Domain location=74-346::74-346
MVSVEKIHIERERTRKRPRLAWDVAPPSASEAQRALPVPGDEGFERKHVSPPKRDDDREGHYVFNLGENLTPRYKILGKMGEGTFGRVLECWDRQTREYVAIKVVRSIRKYRDAAMLEIDVLQQLAKNDRGSSRYGTYGVFEKLGPSLFDFLKRNKYCPFPVDLVREFGRQLLESVAYMHELRLIHTDLKPENILLVSSEYVKLPSYKRISSDEMQFRCLPKSSAIKLIDFGSTAYDNQNHSSIVSTRHYRAPEIILGLGWSYPCDLWSVGCILIELCSGEALFQTHENLEHLAMMERVLGPIPEHMICRSNKGAEKYFKRGSRLRWPEGAVSRESISAVKKLGHLK

SEQ ID NO: 135781 - protein, 487 aa, Glycine max
  Coding DNA Sequence Number=SeqID_44096
  Gene Ontology: Mol. function=protein binding; Cellular component =protein complex; Biological process=hyperosmotic response
  Homolog annotation: Hit_ID=O81694; Match level="QueryCoverage=83%, HitCoverage=96%, E-value=1e-164, Identity=76%"; Hit description=19S proteosome subunit 9
  Pfam annotation: Domain name=PCI; Domain location=349-453; Score =110.7; E_value=4.4e-30; Accession=PF01399.18; Description=PCI domain
MSVVVANATLYMPLTTDRDLDPTTLVDWDLFNPVTTIVGSITEKPLQLKGPRRGLCGRGFLRAGAMSSPYLPATTDSLALATEAKDPSEAISILYRVLDDPSSSPDALRMKEQAITNLTKLLTDENRGEDLRSLLTQLRPFFSLIPKAKTAKIVRGIIDSVAKIPGTSDLQIALCKEMVLWTRAEKRTFLRQRVEARLAALLMESKEYSEALTLLSGLVKEVRRLDDKLLLVDIDLLESKLHFSLRNLPKAKAALTAARTAANAIYVPPAQQGAIDLQSGILHAEEKDYKTAYSYFFEAFESFNALDDPKAVFSLKYMLLCKIMVNQADDVGGIISSKAGLQYLGPDLDAMKAVADAHSKRSLNLFEIALRDYKAQLEEDPIVHRHLSSLYDTLMEQNLCRLIEPFSRVEIAHIAELIELPTDHVERKLSQMILDKKFAGTLDQGAGCLVIFDDPKTDAIYPATLETISNVGKVVDSLYVRSAKIMA

SEQ ID NO: 135782 - protein, 353 aa, Glycine max
  Coding DNA Sequence Number=SeqID_44097
  Homolog annotation: Hit_ID=A7P523; Match level="QueryCoverage=69%, HitCoverage=78%, E-value=7e-84, Identity=54%"; Hit description =Chromosome chr4 scaffold_6, whole genome shotgun sequence
MNPSTESDNAIIIDIDSSVKTPSFVENHPNEEKHQLNVPFLLRPSYATHELRNLRRSLQWCALDHSSLVGQLISYVVFIFLTIAVPLFTSLFVHVPSSSSQLDPFNFNKLLQLPQSALAVIAFFTLSRFFPRHGLRQLLFLDVLQDDSTYVRRGYTRELQKAFRYLATGLFLLACVLFRLTCELQILRFEGLRKLFEGCGSDANMIFREHLGSLLLVLESKSATTFFNSGDLVICSAVQLCGFFLCLMGAARITHRAQGIVSIATKWHMVVTNASAESEHWKTQMPEGLPSPTASDSDSSDIYISVTTQGPSFQTRQALVRRRCRKNTCVVGVARACVPMVARTTVRGCAVRT

SEQ ID NO: 135783 - protein, 118 aa, Glycine max
  Coding DNA Sequence Number=SeqID_44098
  Gene Ontology: Mol. function=protein serine/threonine kinase activity; Cellular component=ubiquitin ligase complex; Biological process=protein amino acid phosphorylation
  Homolog annotation: Hit_ID=A5C5X6; Match level="QueryCoverage=94%, HitCoverage=14%, E-value=5e-28, Identity=58%"; Hit description =Putative uncharacterized protein
QNHQWGLTHHVERAIEKGTFAEMLDPSVVDWPMEDAMKLAKMGLQCAELRRKDRPDLGKVILPELNRLRDLAEDNNLISVLDNSMDAPLAKQVSVHLDGGGPSFTQSREIRANNSVSF

SEQ ID NO: 135784 - protein, 63 aa, Glycine max
  Coding DNA Sequence Number=SeqID_44099
MKFEMPLNFPPPRVYSSARLVNLAKWSYAWCICLILRHNIIQFSLRDSGEIDKEQLSSYDIVF

SEQ ID NO: 135785 - protein, 315 aa, Glycine max
  Coding DNA Sequence Number=SeqID_44100
  Gene Ontology: Mol. function=voltage-gated potassium channel activity; Cellular component=apical plasma membrane; Biological process=cellular calcium ion homeostasis
  Homolog annotation: Hit_ID=A7PD34; Match level="QueryCoverage=99%, HitCoverage=48%, E-value=1e-129, Identity=69%"; Hit description =Chromosome chr17 scaffold_12, whole genome shotgun sequence
  Pfam annotation: Domain name=cNMP_binding; Domain location=95-195; Score=36.9; E_value=7.1e-08; Accession=PF00027.20; Description =Cyclic nucleotide-binding domain
MSVRLEEWRIRKRDTEEWMRHRQLPQDLQERVRRFAQYKWLATRGVNEEAILLSLPLDLRREIQHHLCLSLVRRVPFFSQMDDQLLDAICERLASSLSTEGTYLFREGDPVDEMLFIIRGQLESSTTNGGRSGFFNSISLRPGDFCGEELLTWALMPNSNLNLPSSTRTVKALTEVEAFALQAEDLKSVASQFKRLHSKKLQHAFRYYSHQWRTWASCFIQAAWRRHQKRKATRELSLKEGLYYLALSEAERDGSGNYEIEESSGSVKKVQNLGPTVFASKFAANTKKGNHKLQDPVPQLFKPDEPDFSLDHEQV

SEQ ID NO: 135786 - protein, 886 aa, Glycine max
  Coding DNA Sequence Number=SeqID_44101
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q4VCL9; Match level="QueryCoverage=99%, HitCoverage=96%, E-value=0.0, Identity=85%"; Hit description=Plasma membrane H+ ATPase
  Pfam annotation: Domain name=Cation_ATPase_N; Domain location=1-59; Score=56.9; E_value=6.8e-14; Accession=PF00690.17; Description =Cation transporterATPase, N-terminus
  Pfam annotation: Domain name=E1-E2_ATPase; Domain location=71-292; Score=309.4; E_value=6.6e-90; Accession=PF00122.11; Description=E1 -E2 ATPase
  Pfam annotation: Domain name=Hydrolase; Domain location=296-582; Score=77.1; E_value=5.6e-20; Accession=PF00702.17; Description =haloacid dehalogenase-like hydrolase
  Pfam module annotation: Pfam domain module=Cation_ATPase_N::E1-E2 _ATPase::Hydrolase; Domain location=1-59::71-292::296-582
MKELSLTSDEGASRLQVFGPNKLEEKKESKLLKFLGFMWNPLSWVMEAAAIMAIALANGGGRPPDWQDFVGIIALLFINSTISFIEENNAGNAAAALMAGLAPKTKVLRDGRWTEQDAAILVPGDIISIKLGDIIPADARLLEGDALSVDQSALTGESLPVTKNPSEEVFSGSTVKKGEIEAVVIATGVHTFFGKAAHLVDSTNQVGHFQKVLTAIGNFCICSIAVGIIIELIVMYPIQHRKYRDGIDNLLVLLIGGIPIAMPTVLSVTMAIGSHRLSQQGAITKRMTAIEEMAGMDVLCSDKTGTLTLNKLSVDKNLIEVFAKGVEKDYVILLAARASRTENQDAIDAAIVGMLADPKEARAGIREVHFLPFNPVDKRTALTYIDSDGNWHRSSKGAPEQILNLCNCKEDVRKRVHGTIDKFAERGLRSLGVARQEVPEKNKDSPGAPWQFVGLLPLFDPPRHDSAETITRALNLGVNVKMITGDQLAIAKETGRRLGMGTNMYPSSSLLGQSKDAAVSAVPVDELIEKADGFAGVFPEHKYEIVKRLQERKHICGMTGDGVNDAPALKKADIGIAVADATDAARSASDIVLTEPGLSVIISAVLTSRAIFQRMKNYTIYAVSITIRIVFGFMFIALIWKFDFAPFMVLIIAILNDGTIMTISKDRVKPSPMPDSWKLREIFATGVVLGAYMALMTVVFFWLMKDTDFFSDKFGVRSIRNSPGEMMAALYLQVATFLAVYANWGFARIQGMGWGWAGVIWLYSLVTYIPLDILKFAIRYVLSGKAWDNLLENKTAFTTKKDYGKEEREAQWATAQRTLHGLQPPETTNLFNDKNSYRELSEIAEQAKRRAEVARLRELHTLKGHVESVVKLKGLDIDTIQQHYTV

SEQ ID NO: 135787 - protein, 649 aa, Glycine max
  Coding DNA Sequence Number=SeqID_44102
  Homolog annotation: Hit_ID=A7P4Y5; Match level="QueryCoverage=64%, HitCoverage=73%, E-value=2e-52, Identity=37%"; Hit description =Chromosome chr4 scaffold_6, whole genome shotgun sequence
  Subcellular localization annotation: CTP_CleavageSite=19; ConfidenceScore=5.30e-01
MASVPGSRSAGKIVRTRRSAAARSRTPYDRPAPPPPPPEPPSPNWISRFVISPSRFIASGAGKIFSSVLDLDNSPSDSSSATSSHSSSANDSDAEEVGTFDDENDNPSEGDVALSKGLQPCVGNSKSKHMIEQLLMKESFSREECDRLIKIIRSRVVDPANDDDGDKRPTDIPNKIFGSGTLYRLNSVLTYYCFLTMESNYFLDTDSPELHSAAIMEAKKWLREKKSGLDTNSDIGYGSPSLNLVALPQDPKDEGSPVDVAKLYMRTRPPWASPSIDHTKPQTPSGIQLFKEETPYLFGNNSTPPSKLKRDSAATGSWSIQDEIRRVRSRATEDLLRSLPSSKIDWSAFAMENKNNVNSSAIENIGASLGERVHNSTNLVDASANLARGLGSQVSPDLDSKLDEFQPESVLSNPVNINFEQNQGSVAVQQTRVLFHCLSVEVLQFYLAYENPCHIGTQDGGEITTSGLRDGSSDDMHRDGGLVKVNGISDTNGPGHQLDSVEETREAINSRLQDSNHLVIKEKVRAEDALANGFPSSEPSFNPGQVIEQSTKTLDNKPNTTDSSQERTAQGLEQEECQTLRESAEVPDVIGDDSVAGGVVSGSQNSSSVYEVQPGVESGLSTTPTSIAKQKGRRIATRYNRRGRGKGVK

SEQ ID NO: 135788 - protein, 349 aa, Glycine max
  Coding DNA Sequence Number=SeqID_44103
  Gene Ontology: Mol. function=protein binding; Biological process=red or far red light signaling pathway
  Homolog annotation: Hit_ID=A7P4X8; Match level="QueryCoverage=97%, HitCoverage=95%, E-value=1e-102, Identity=53%"; Hit description =Chromosome chr4 scaffold_6, whole genome shotgun sequence
  Pfam annotation: Domain name=F-box; Domain location=12-59; Score =26.5; E_value=9.8e-05; Accession=PF00646.24; Description=F-box domain
  Pfam annotation: Domain name=Kelch_1; Domain location=104-146; Score =4.7; E_value=0.84; Accession=PF01344.16; Description=Kelch motif
  Pfam annotation: Domain name=Kelch_1; Domain location=150-188; Score =16.4; E_value=0.033; Accession=PF01344.16; Description=Kelch motif
  Pfam annotation: Domain name=Kelch_1; Domain location=190-236; Score =10.8; E_value=0.16; Accession=PF01344.16; Description=Kelch motif
  Pfam module annotation: Pfam domain module=F-box::Kelch_1::Kelch _1::Kelch_1; Domain location=12-59::104-146::150-188::190-236
MAVVGGEKEKEELIPGLPYEIAELCLLHVPYPYQALSRSVSSTWNRAITHPSFIYSKKTLSHPHLFVLAFHSQTGKIQWQALDPSSGRWFVLPQMPLPENTSSTAFASAALPRQGKLFVIAGGGEGSDTLVYRAATNQWALAAPTPGGRRRGFFAAEGVEGKIVAVGSGGTDIYDPESDTWREGKTLGGELERYEVVAAGGKVYVSEGWWWPFMLSPRGWVYETERDTWREMGSGMREGWSGVSVAVGGRVFVIAEYGDAPVKVYDEEFDTWRYVKGGRFPRDVIKRPFCATGLEDRIYVASLDLNVAIGKINVGVNSNNEQVSVTWEVVEAPRAFREFSPSSCQMLYA

SEQ ID NO: 135789 - protein, 246 aa, Glycine max
  Coding DNA Sequence Number=SeqID_44104
  Gene Ontology: Mol. function=RNA-directed DNA polymerase activity; Cellular component=chromatin; Biological process=chromatin assembly or disassembly
  Homolog annotation: Hit_ID=A5B2I6; Match level="QueryCoverage=52%, HitCoverage=6%, E-value=4e-14, Identity=29%"; Hit description =Putative uncharacterized protein
  Pfam annotation: Domain name=Retrotrans_gag; Domain location=110-199; Score=-0.3; E_value=0.058; Accession=PF03732.8; Description =Retrotransposon gag protein
MVTKANARMETRMEAMEKVKEENPKVVESQLSSIEGMIQRLVAAWEKKSPTTNIHTVDASGGDEGATAHDGNRWRNLEMPIFDGEDAMGWLTKIERYFRLRAVREEDKLEAVMVAMDEEALGWFQWWESWNTNHSWDGFKIVVTQRFQASSLGNPVQSLLALEQEETMQGFICQFEKCVGMVRLHEPKNLMEAMIKARRMEDKNRVLEKLPLSNSKGYDLHKPSYSSQKFVRDWQLANNKVVDMAR

SEQ ID NO: 135790 - protein, 590 aa, Glycine max
  Coding DNA Sequence Number=SeqID_44105
  Gene Ontology: Mol. function=SNAP receptor activity; Cellular component=integral to membrane; Biological process=intracellular protein transport
  Homolog annotation: Hit_ID=A7P5H6; Match level="QueryCoverage=97%, HitCoverage=74%, E-value=1e-100, Identity=64%"; Hit description =Chromosome chr4 scaffold_6, whole genome shotgun sequence
  Pfam annotation: Domain name=SNARE; Domain location=252-314; Score =69.4; E_value=1.2e-17; Accession=PF05739.10; Description=SNARE domain
  Pfam annotation: Domain name=SNARE; Domain location=538-576; Score =3.8; E_value=0.11; Accession=PF05739.10; Description=SNARE domain
  Pfam annotation: Domain name=Syntaxin; Domain location=339-445; Score= 94.3; E_value=3.9e-25; Accession=PF00804.16; Description=Syntaxin
  Pfam annotation: Domain name=Syntaxin; Domain location=52-158; Score =95.2; E_value=2e-25; Accession=PF00804.16; Description=Syntaxin
  Pfam module annotation: Pfam domain module=SNARE::SNARE::Syntaxin::Syn taxin; Domain location=252-314::538-576::339-445::52-158
  Subcellular localization annotation: CTP_CleavageSite=59; ConfidenceScore=5.39e-01
MHAKSAQSSFRDRTQEFHSITERLKKSGSGPNGPSSSTSSTRSEEQRSAIANQSEFNRRASKIGYGIHQTSQKLAKLAKLAKRTSVFDDPTMEIQELTGVIKQDITALNSAVVDLQFLCNSRNESGNVSADTTSHSSTVVDDLKTRLMSTTKEFKDVLTMRTENMKVHENRRQLFSSSASKDSANPFIRQRPLAARAAASTSNAPALPWANGSPSSSQAFPKKQVDGESQPLLQQQQQQQEVVPLQDSYMQSRAEALQNVESTIHELSNIFNQLATLVSQQGEIAIRIDENMDDTLANVEGAQGALLNIAERLKKTGPAPNGQSSSSSRSEEQRSAIANQSEFNRRASKIGFGIHQTSQKLAKLAKLAKRTSVFDDPTMEIQELTGVIKQDITALNSAVVDLQLLSNSRNESGNASTDTTSHSTTVVDDLKTRLMSATKEFKDVLTMRTENLKVHENRRQLFSATASKDSANPFVRQRPLATRSAASTSNAPAAPWATGSSSSQLFPKKQVDGESQPLLQQQQQQQEVVPLQDSYMQNRAEALQNVESTIHELSNIFNQLATLVSQQGEIAISADWVFAQPDPQLHPLGI

SEQ ID NO: 135791 - protein, 442 aa, Glycine max
  Coding DNA Sequence Number=SeqID_44106
  Gene Ontology: Cellular component=integral to membrane
  Homolog annotation: Hit_ID=A7QQ43; Match level="QueryCoverage=79%, HitCoverage=73%, E-value=2e-87, Identity=51%"; Hit description =Chromosome chr2 scaffold_140, whole genome shotgun sequence
MADDDKAVGEGEMKETTGGTSPSGSGKKKNKGFLLRIWNGIFRLHGDDFEKRLQYISKEEAQVMTRMNRRSRSWRRISRNLIVFSVIFEVVAVVYAIMTTRSIDLNWKMRAIRVSPMFLLPALAAAAYTTFVSFTRMSCKCGYQCWISDRRDKKILERLRAERQEKIDELKERTNYYTTQQLIQLYPCIYFIKCITERAALDGNCLRLRYDPDPAAKAAAASVLASKLGADSGLKVYLGDESSPSAPLGRSNDIEIVQSSGLRNRRQLQSRSTSPGTTTPNFADQQLVGPGGIDQTQTFELNKPVVVEHHLPQSSTTQDGGWIARIAALLVGEDPTQSYALICGNCYMHNGLARKEDFPVITYYCPHCHALNKPKQSDEHISGLTSPNTGGTPNTDDGVTDAVKNARASAAESVITSSSPGSASSSEIEEVSERASVDEKID

SEQ ID NO: 135792 - protein, 566 aa, Glycine max
  Coding DNA Sequence Number=SeqID_44107
  Gene Ontology: Mol. function=histone-arginine N-methyltransferase activity; Cellular component=cytoplasm; Biological process =regulation of transcription, DNA-dependent
  Homolog annotation: Hit_ID=Q8GWT4; Match level="QueryCoverage=100%, HitCoverage=83%, E-value=0.0, Identity=64%"; Hit description=Protein arginine N-methyltransferase 5
  Pfam annotation: Domain name=PRMT5; Domain location=180-566; Score =611.0; E_value=1.1e-180; Accession=PF05185.7; Description=PRMT5 arginine-N-methyltransferase
MDPSYRPSLVQNDALGSGLLPFAGSDLVLSPSQWSSHVVGKISSWIDLDSEDETLRVDSETTLRQEIAWASHLSLQVCFGCMDMVMVPALYQYEYGCQNTAFDEFSCLRCTGLESQIVLAGMQTIKGIKACLLPAPKGTSCANYARCVNQILQGSNNMQLWLRLPLVKPDDDSMDAKSVALVDYWETWNSFRLLCEHHSQLSVALDILSTLPSPNSLGRWFGEPLRAAILHTDCFLTNSHGSPCLSKRHQSLITGVFNHSIQIIISGNSVHTKASMDANDNSGTNSQRHPLRPYLDYVGYLYQRMDPLPEQERFEPLMDNLEAQTYETFERDAMKYIQYQRAVSKALLDRVPDEEASVKTIVLMVVGAGRGPLVRASLQAAEETGRKLKVYAVEKNPNAVVTLHALVKLEGWEYTVTIVSSDMRHWNAPEKADILVSELLGSFGDNELSPECLDGAQRFLKQDGISIPSSYVKAHKDLVHFETAYVVKMHNVARLAPTQPVFTFTHPKHPDKESNQRHKKLNFVIPNDTGSAMVHGFAGYFDATLYKDVHLGIEPSTATPNMFSWY

SEQ ID NO: 135793 - protein, 386 aa, Glycine max
  Coding DNA Sequence Number=SeqID_44108
  Gene Ontology: Mol. function=metal ion binding; Cellular component =integral to membrane; Biological process=ubiquitin cycle
  Homolog annotation: Hit_ID=A7P5G9; Match level="QueryCoverage=81%, HitCoverage=80%, E-value=1e-120, Identity=66%"; Hit description =Chromosome chr4 scaffold_6, whole genome shotgun sequence
  Pfam annotation: Domain name=PHD; Domain location=310-354; Score=2.2; E_value=0.0073; Accession=PF00628.20; Description=PHD-finger
  Pfam annotation: Domain name=zf-C3HC4; Domain location=311-351; Score= 36.2; E_value=1.2e-07; Accession=PF00097.16; Description=Zinc finger, C3HC4 type (RING finger)
  Pfam module annotation: Pfam domain module=PHD::zf-C3HC4; Domain location=310-354::311-351
  Subcellular localization annotation: CTP_CleavageSite=41; ConfidenceScore=5.53e-01
MARPTHHVIDITGSSGPSTSSSSTPHDRLANDVDFGALNSRTSRRRGDTTRSSRQHRSPLNSGLWICVELVITVSQIVASVVVLSLSKHEHPRAPLFAWIVGFASGCVATLPLLYWRYYHNCLVRELESSSQASLRSNDPSGTLLSDSTTNGGEDVPASSRSNQESWLMNARLKLLVEYFKIAVDCFFAIWFIVGNVWIFGGHSSADQAPNLYRLCVVFLTFSCIGYAMPFILCATICCCLPCIISILGVREDMAQTPGASSESINSLPTYKFKMKKNKSKGESNSAVSEGGVVASGTEKERMISGEDAACCICLAKYENNDELRELLCSHLFHKDCVDKWLKINALCPLCKSEVSENVRGSVSGEDANQHQGESRIENGLTNTSS

SEQ ID NO: 135794 - protein, 216 aa, Glycine max
  Coding DNA Sequence Number=SeqID_44109
  Gene Ontology: Cellular component=nucleus; Biological process=cell division
  Homolog annotation: Hit_ID=Q39878; Match level="QueryCoverage=100%, HitCoverage=46%, E-value=2e-87, Identity=78%"; Hit description =Mitotic cyclin a2-type
MDKVNRVCAKDEERPLRITRARARALRGITPYSRPSLKNEQKNVLRAHPKRAASSENKTSVVVPAVVQQKGRAVLSDVSNMCAKPHDKCTKSSKFQAKGVYTKKTTKLAALGVSTEVSSTQENVRAKLAEELSTIRMVESKDTIREGVTADTALSMQNSLKSDELQSSPNKDIHMIWEKLGASDSLTIVDIDSELKDSQVWSSYAPDIYSNIQVTE

SEQ ID NO: 135795 - protein, 387 aa, Glycine max
  Coding DNA Sequence Number=SeqID_44110
  Gene Ontology: Cellular component=nucleus
  Homolog annotation: Hit_ID=A7P5M8; Match level="QueryCoverage=77%, HitCoverage=95%, E-value=4e-81, Identity=54%"; Hit description =Chromosome chr4 scaffold_6, whole genome shotgun sequence
  Pfam annotation: Domain name=tify; Domain location=279-314; Score =63.1; E_value=9.6e-16; Accession=PF06200.5; Description=tify domain
  Subcellular localization annotation: CTP_CleavageSite=43; ConfidenceScore=5.21e-01
MAQPHNGNTNNTSNQQLVLHDFLGMRPAADSPKTADVRLPEPSASASSTGGRGPFSATSDIASGNHLEGVPFYGPRSDFSGTEISNRLVGSKRSNSDSTFMGSSRDAFQLVPDSFQNSHLMKVLRNAAGGERPRRPNDDAVLLGMQSMKPSSSQIFQPPTSTKIDANKWERSILMNVGPSMQHPPRGVQLAPFVHQMASSKIRDTNAGPSFISQSAADEGSRTGIKGPGILSSAAATATEKSIPSAVMLGGSRPKPGTNEKLLDFMHFIIDTDSSQHGLTSASRQMTIFYGGQAHVFDDVHPHKADVIMALAGSNGGSWSTAFSPKSAVKMVNDGILHSGENETGVVSNAAFPQELHGKLSITGSSSHAIGLGDRVTTPAGKPRTET

SEQ ID NO: 135796 - protein, 383 aa, Glycine max
  Coding DNA Sequence Number=SeqID_44111
  Homolog annotation: Hit_ID=Q2V3C8; Match level="QueryCoverage=71%, HitCoverage=89%, E-value=3e-56, Identity=45%"; Hit description =Uncharacterized protein At4g32560.3
MEHTVSNSSSVEQILNLLYAAGYVDATNPDAPPSQKIAAGLSWCIAAITQDLDTDALFPVIQWLASHIRQNQEHCVNEVHHAENTIEVDECRTSIQALSGNLDELNQRKMNVVKQLYILQERINKEGADSAVQKLLSLLTSLKNLEKQEKYFQSNRDAKHSELQDDISELERKITNDSDNENLPDELHHSFGELVEKVNLMKKQLAARLRDIVVLRRQIDDLPCQSEVIQYERRLSELYAQIQGKHRQTRKYYATYNALLEIKELMLKETSLLNSIISQFQEAFSSTDGRIKLVHSMEGIVKGSQQKLERVHVGLQEEERIRNDLKDRYAAATGEHKHCYSLLKAFQVVPWCRVKLVYDPLWVIILCLSDKASVDLRIVLLNW

SEQ ID NO: 135797 - protein, 55 aa, Glycine max
  Coding DNA Sequence Number=SeqID_44112
MKEEKRKTKVTSCQLPSWSETWLWKRRKKEVAKELNLVGRVASEAKDKNGKEKRI

SEQ ID NO: 135798 - protein, 27 aa, Glycine max
  Coding DNA Sequence Number=SeqID_44113
MEVEVEQSSLRVCEWKGVPNGKIDIMG

SEQ ID NO: 135799 - protein, 1432 aa, Glycine max
  Coding DNA Sequence Number=SeqID_44114
  Gene Ontology: Mol. function=nucleoside-triphosphatase activity; Cellular component=integral to membrane; Biological process=transport
  Homolog annotation: Hit_ID=A7P5L1; Match level="QueryCoverage=100%, HitCoverage=100%, E-value=0.0, Identity=75%"; Hit description =Chromosome chr4 scaffold_6, whole genome shotgun sequence
  Pfam annotation: Domain name=ABC2_membrane; Domain location=1160 -1374; Score=255.1; E_value=1.5e-73; Accession=PF01061.15; Description=ABC-2 type transporter
  Pfam annotation: Domain name=ABC2_membrane; Domain location=501-714; Score=198.7; E_value=1.4e-56; Accession=PF01061.15; Description=ABC -2 type transporter
  Pfam annotation: Domain name=ABC_tran; Domain location=176-399; Score= 54.2; E_value=4.5e-13; Accession=PF00005.18; Description=ABC transporter
  Pfam annotation: Domain name=ABC_tran; Domain location=889-1079; Score=104.1; E_value=4.3e-28; Accession=PF00005.18; Description=ABC transporter
  Pfam annotation: Domain name=PDR_assoc; Domain location=719-783; Score=128.6; E_value=1.9e-35; Accession=PF08370.2; Description=Plant PDR ABC transporter associated
  Pfam module annotation: Pfam domain module=ABC2_membrane::ABC2 _membrane::ABC_tran::ABC_tran::PDR_assoc; Domain location=1160 -1374::501-714::176-399::889-1079::719-783
MESGELRVASARIGSSGVWRSGSIDVFSGSSRRDDDEQELKWAAIEKLPTYLRMTRGILTETEGQPTEIDINKLCPLQRKNLVERLVKIAEQDNEKFLFKLRDRIDRVGLEIPTIEIRFEHLNVEAEAHVGSRALPTIFNFCINLFEGFLNSLHLIPSRKKPFTVLDDVSGIIKPKRMTLLLGPPSSGKTTLLLALAGRLSKDLKFSGRVSYNGHGMEEFVPQRTSAYISQTDLHIGEMTVRETLAFSARCQGIGTRYEMLAELSRREKAANIKPDPDLDIYMKAAALEGQETNVVTDYIMKILGLEVCADTMVGDDMIRGISGGQKKRVTTGEMLVGPARALFMDEISTGLDSSTTFQMVNSLRQSIHILNGTAVISLLQPAPETYELFDDIILLSDGQIVYQGPRENVLEFFEYMGFKCPERKGVADFLQEVTSRKDQEQYWANKDEPYSFVTVKEFAEAFQSFHAGRKLGDELATPFDMSKGHPAVLTKNKFGVCKKELLKACVSREFLLMKRNSFVYIFKMWQLILTGFITMTLFLRTEMHRDTETDGGIYMGALFFVLIVIMFNGYSELSMSIMKLPVFYKQRDLLFFPCWAYSLPTWILKIPITLVEVGIWVVMTYYVIGFDPSIERFIKQYFLLVCINQMASGLFRFMGAVGRNIIVANTVGSFALLAVMVMGGFILSRVDVKKWWLWGYWFSPMMYGQNALAVNEFLGKSWSHVTPNSTEPLGVKVLKSRGIFPKAYWYWIGVGASIGYMLLFNFLFPLALHYLDPFGKPQALISEEALAERNAGRNEHIIELSSRIKGSSDKGNESRRNVSSRTLSARVGGIGASEHNKKRGMVLPFTPLSITFDEIRYSVEMPQEMKSQGILEDRLELLKGVNGAFRPGVLTALMGVSGAGKTTLMDVLSGRKTAGYIQGQITISGYPKRQETFARIAGYCEQTDIHSPHVTVYESLVYSAWLRLPPEVDSSTRQMFIEEVMELVELTSLREALVGLPGVNGLSTEQRKRLTIAVELVANPSIIFMDEPTSGLDARAAAIVMRTVRNTVDTGRTVVCTIHQPSIDIFDAFDELLLLKRGGEEIYVGPLGQHCSHLINHFEFIHQVTSEAQEAALGVNFAEIYKNSDLYRRNKALIRELTTPPTGSKDLYFPTKYSQTFFTQCMACLWKQHLSYWRNPPYSAVRLLFTTIIALLFGTIFWDIGSKRQRKQDLFNAMGSMYAAVLFIGIQNATSVQPVVAIERTVFYRERAAGMYSALPYAFGQVAIEIPYIFIQTLVYGVIVYAMIGFDWTFSKFFWYLFFMFFTFLYFTFYGMMAVGLTPDHNVAAIVSFGFYMIWNLFSGFVIPRTRMPVWWRWYFWICPVSWTLYGLVTSQFGDIKEPIDTGETVEEFVRSYFGYRDDFVGVAAAVLVGFTLLFGFTFAFSIKAFNFQKR

SEQ ID NO: 135800 - protein, 372 aa, Glycine max
  Coding DNA Sequence Number=SeqID_44115
  Gene Ontology: Cellular component=cellulose and pectin-containing cell wall
  Homolog annotation: Hit_ID=A7P5N4; Match level="QueryCoverage=98%, HitCoverage=99%, E-value=1e-162, Identity=75%"; Hit description =Chromosome chr4 scaffold_6, whole genome shotgun sequence
  Pfam annotation: Domain name=DUF642; Domain location=39-364; Score =767.3; E_value=9.8e-228; Accession=PF04862.3; Description=Protein of unknown function, DUF642
MERFSFLLVLFCCFHVAFSFTHGAVINGEFELGPKPQDMKGTVVTGGPHSIPGWEISGFIEYIKSGQKQDDMLLVVPNGAYAVRLGNEASIKQNLKVVKGMYYSITFVVARTCAQEEKLNVSAAPDWVVLPMQTVYGGNGWDAYAWSFRADYPSVDMVFHNPGKEEDPACGPIIDSIAIQPLYPPRLTNKNVLKNGGFEEGPYVFPNTSSGVLIPPNIVDHIEHSPLPGWMVESLKAVRYIDSDHFSVPKGKRAVELIGGKESAIAQVARTIPGKTYTLFFAVGDAGNSCEGSLSVEAYVGKESVKVPYESKGKGGFKRATLKFVAVSTRTRILFLSTFYNMRSDDLASLCGPVIDDVTLISLRKPHRRFHI

SEQ ID NO: 135801 - protein, 437 aa, Glycine max
  Coding DNA Sequence Number=SeqID_44116
  Gene Ontology: Mol. function=magnesium ion binding; Cellular component=membrane; Biological process=metabolic process
  Homolog annotation: Hit_ID=Q3E945; Match level="QueryCoverage=71%, HitCoverage=63%, E-value=7e-69, Identity=55%"; Hit description =Uncharacterized protein At5g25820.1
  Pfam annotation: Domain name=Exostosin; Domain location=141-400; Score=71.4; E_value=3e-18; Accession=PF03016.6; Description =Exostosin family
MAIVLMVQYSELPSSKFLSSVTTKITMEGNNLHLDGSNSNSTHALEEKAISPQVPQFHNDRDSITSPAPEKAKGLDETDSRSPVASVTSAATSVKSDITGSVSKDGKSGSLQGSSNLTSNNGKPVTAKNSKKRPSKVVSISKMNLPLQHNHASSKLVKPARASAVDLEILHAKSEILNAPVIMNDPRLYPPLYRNASMFRRSYELMENMLKVCIYQDEDRPIFHEPLLDGIYASEGCTISQAPAETRGRMLSSIRALCNADIEVGFKIGKDVSLPETYIRRFARLCSPILLKHWENKEPDMKISGPLPHVRGNVNYIQFMKSSKFCIHARGHEVNSPRVVEAIFHECIPVIISDNFIPPFFEILNWESFAVFVTEEEIPNLRNILLSISEERYLEMHKRVKKVQEHFPWHAEPVKDDLSHMLLHSIWYNRLFHISQT

SEQ ID NO: 135802 - protein, 397 aa, Glycine max
  Coding DNA Sequence Number=SeqID_44117
  Gene Ontology: Mol. function=RNA binding
  Homolog annotation: Hit_ID=A7P5N7; Match level="QueryCoverage=100%, HitCoverage=99%, E-value=5e-72, Identity=42%"; Hit description =Chromosome chr4 scaffold_6, whole genome shotgun sequence
  Pfam annotation: Domain name=Agenet; Domain location=3-66; Score =44.1; E_value=5e-10; Accession=PF05641.3; Description=Agenet domain
  Pfam annotation: Domain name=ENT; Domain location=336-396; Score =23.4; E_value=0.00081; Accession=PF03735.5; Description=ENT domain
  Pfam module annotation: Pfam domain module=Agenet::ENT; Domain location=3-66::336-396
MRLRKGNKVEIRGNADGLSVEWCCARIISGDGHTYSVQYDCSSTTSEASIERVSRKAIRPCPPLIKGIESWAANDHVEVYIAGSWRAATVLKVIGGDFYLVRLWVSCKEFNVLKVNMRARQSWQNGQWVVMSKGSGMSGDVMSSRYLISNSYKDQPENQCRNIFSPGLDASGLQESRLASSSTLKRMSPYDSSVIEAYPRKLRDVENMGVCERFKAVATAPLLQKVDAVAYPQNIMGEKCMHTSYTNGANQYYETGKENPCNVSTHFLERIEEPDYSCSDQSSVGSCSVISSNSNKFSSDTLAGSCQDEDSLCSDAESLDVEPVNEGCSTSFEEVVAERIHRLELHAYHSTIEVLYASGPLSWEQEELLTNLRISLHISNDEHLMEIKNLVSSGLNF

SEQ ID NO: 135803 - protein, 93 aa, Glycine max
  Coding DNA Sequence Number=SeqID_44118
  Gene Ontology: Cellular component=extracellular region
  Homolog annotation: Hit_ID=A7P5R4; Match level="QueryCoverage=97%, HitCoverage=54%, E-value=5e-38, Identity=75%"; Hit description =Chromosome chr4 scaffold_6, whole genome shotgun sequence
  Pfam annotation: Domain name=DPBB_1; Domain location=17-91; Score =45.4; E_value=2e-10; Accession=PF03330.9; Description=Rare lipoprotein A (RlpA)-like double-psi be
YCCDGNRPGQFPPGNLFVAVNEGLWDNGAACGRRYRIRCVSGNNRPCKGGSIDVKVVDSCSRSPCPNTLLMSNDAFAAIARFPHVKINIEYTQ

SEQ ID NO: 135804 - protein, 284 aa, Glycine max
  Coding DNA Sequence Number=SeqID_44119
  Gene Ontology: Mol. function=phospholipase D activity; Cellular component=membrane; Biological process=phosphatidylcholine metabolic process
  Homolog annotation: Hit_ID=Q2HWT8; Match level="QueryCoverage=88%, HitCoverage=31%, E-value=6e-82, Identity=61%"; Hit description =Phospholipase D alpha 2
  Pfam annotation: Domain name=C2; Domain location=13-92; Score=25.3; E_ value=0.00023; Accession=PF00168.21; Description=C2 domain
MGTKGTTHKGKRFLAQVKGCLLCRPEIVGTRLYATIDLDKARVGRTRMIGNQPSHPRWNETFEIYCAHQISKIIFTVKDGNPIGATLIGRASVPVEQVRKGPIVKRWVEILDEEDQRPVPGHAKICVSVQFYDVTDDTTCLWSQGISMPFFGVPRTFFNQREGCNVTLYQDAHVPRGIGVVPYIPISEEKDYMPAMCWEDINKAINEAKYFIYITGWAVYTEITLVRDKDESETLGELLKRKADQGVKVLLLIWNDRTSVPELKDGFMATHDQETAGYFRGGIL

SEQ ID NO: 135805 - protein, 826 aa, Glycine max
  Coding DNA Sequence Number=SeqID_44120
  Gene Ontology: Mol. function=phospholipase D activity; Cellular component=membrane; Biological process=phosphatidylcholine metabolic process
  Homolog annotation: Hit_ID=Q2HWT8; Match level="QueryCoverage=99%, HitCoverage=99%, E-value=0.0, Identity=64%"; Hit description =Phospholipase D alpha 2
  Pfam annotation: Domain name=C2; Domain location=9-125; Score=18.8; E_ value=0.0025; Accession=PF00168.21; Description=C2 domain
  Pfam annotation: Domain name=PLDc; Domain location=340-379; Score =35.8; E_value=1.6e-07; Accession=PF00614.13; Description =Phospholipase D. Active site motif
  Pfam annotation: Domain name=PLDc; Domain location=669-696; Score =41.2; E_value=3.7e-09; Accession=PF00614.13; Description =Phospholipase D. Active site motif
  Pfam module annotation: Pfam domain module=C2::PLDc::PLDc; Domain location=9-125::340-379::669-696
MPHLLHGRLDVIIYEVDTLPTLNDCNLNLCSKGTSRSVGKRFLSQLKSCFLCQCQCQPEFVETGLYATIDLDKARVGRTKLLNDQSSNPTWDETFHVYCAHLISHVIFTVKQKDPIDATLIGRAYVPVEQVVNGNIVDEWVQILDEDHNPIPSESKIHVKMQFSSVRNDINWSQGIRSPRFQGVPHTFFSQKNGCKVTLYQDAHVSDGFVPWIPLSGGKPYEHRKCWEDIYNAIMDARNFIYITGWSVYSEITLIRDPMKPTTRITLGELLKMKAEEGVKVLMLVWDDRTSVPDFKKDGLMATHDQETADYFKNTKVKCVLCPRNPDDGKSIVQGFETSTMFTHHQKTIVVDTQVAMGQQGQKRTIVSFVGGIDLCDGRYDTQEHPLFSTLDTVHKDDFHQPNFPGASIKKGGPREPWHDIHCKLEGSVAWDVLYNFQQRWEKQVGNQLLFSSSKLDEYFVPRSTVVTTNENETWNVQLFRSIDGGAASGFPPDPEEAAELGLVSGKDNIIDRSIQDAYISAIRRAKNFIYIENQYFLGSSYGWQASDIVVEDIGALHLIPKELSLKIVSKIEAGERFSVYVVIPMWPEGIPESGSVQAILDWQRRTMEMMYADIAKAIQRKRIQANPRDYLTFFCLGNREGKKDMEYTPTEAPEPDTDYARAQKARRFMIYVHAKMMIVDDEYIIIGSANINQRSMDGERDTEIAMGAFQPRHIAYNGAPRGQIYGFRRALWCEHLGDHGDTNIFDNPESVDCIRLVNHLAETNWDIYSKETFDEYREFHHLMRYPIEVTNNGAITILQGLEHFPDTKAKILGSQSVYLRPILTT

SEQ ID NO: 135806 - protein, 169 aa, Glycine max
  Coding DNA Sequence Number=SeqID_44121
MTMEETFRGTKEFEQQPKVHEAEPKMKGDMEAKLREFEKIYTLTTTEKRKTDLLSKASLEYETNNMRLKYVLQVKYFLKHWCLLALCVHRNYLKALLDAMGGNYANYLNILFGRGSGVRETLIRNSNISFEKNIYSSAPNCVRVVVAVVASRWWWVEEEKEDKGAKDDT

SEQ ID NO: 135807 - protein, 337 aa, Glycine max
  Coding DNA Sequence Number=SeqID_44122
  Gene Ontology: Mol. function=transferase activity; Cellular component= membrane; Biological process=metabolic process
  Homolog annotation: Hit_ID=A7P5W0; Match level="QueryCoverage=99%, HitCoverage=69%, E-value=1e-156, Identity=75%"; Hit description =Chromosome chr4 scaffold_6, whole genome shotgun sequence
  Pfam annotation: Domain name=Exostosin; Domain location=7-301; Score =242.4; E_value=1e-69; Accession=PF03016.6; Description=Exostosin family
MEKLFKVYVYPDGDLPIVHDAPCKDIYSIEGRFLHEMEHGVGRFRTNDPTAAHVYFLPFSVTWMVKYFYSTPHSYDVTPLKNFVSDYVRVISTKYPFWNKTHGADHFMVACHDWGPYASEGNPFLYNTSIRVLCNANTSEGFNPQKDVPLPEIHLYGGEVSPKLLSPPPGNATRRYLAFFAGGMHGPIRPILLHHWNNRDINDDMRVYEYLPKDLDYYSFMLNSKFCLCPSGYEVASPRIVESIYAECVPVILSKNYTLPFSDVLRWESFSVQVDVSDIPRLKEVLSAIPESEYQKLKHGVRAVRRHFTLNQPAKRLDVFHMILHSIWLRRLDIDLR

SEQ ID NO: 135808 - protein, 575 aa, Glycine max
  Coding DNA Sequence Number=SeqID_44123
  Gene Ontology: Mol. function=aminoacyl-tRNA ligase activity; Cellular component=mitochondrion; Biological process=tRNA aminoacylation for protein translation
  Homolog annotation: Hit_ID=A7P633; Match level="QueryCoverage=98%, HitCoverage=98%, E-value=0.0, Identity=70%"; Hit description =Chromosome chr4 scaffold_6, whole genome shotgun sequence
  Pfam annotation: Domain name=DALR_2; Domain location=434-500; Score= -2.4; E_value=0.038; Accession=PF09190.2; Description=DALR domain
  Pfam annotation: Domain name=tRNA-synt_1e; Domain location=79-392; Score=536.0; E_value=4.2e-158; Accession=PF01406.10; Description =tRNA synthetases class I (C)
  Pfam annotation: Domain name=tRNA-synt_1g; Domain location=93-395; Score=-257.1; E_value=0.00041; Accession=PF09334.2; Description=tRNA synthetases class I (M)
  Pfam module annotation: Pfam domain module=DALR_2::tRNA-synt_1e::tRNA- synt_1g; Domain location=434-500::79-392::93-395
  Subcellular localization annotation: CTP_CleavageSite=48; ConfidenceScore=5.53e-01
MSTVSLLKCYRPFFSMLFPHSAPPRPHASIFRRKNFPSFCATSSPPPLTAEKGCGKFDSEGLALPEVWLHNTMSKTKELFKPKVDSKVGMYVCGVTAYDLSHIGHARVYVNFDLLYRYFKHLGFQVCYVRNFTDVDDKIIARAKELGEDPISLSRRYCEEFCQDMVTLNCLSPSVEPKVSEHMPQIIDMIEKILNNGYAYIVDGDVYFNVEKFPEYGKLSSRDLEDNRAGERVAVDSRKKNPADFALWKFGTYLRWISNAILQSAKPGEPFWESRWGPGRPGWHIECSAMSAAYLGYSFDIHGGGIDLVFPHHENEIAQSCAACKKSDISVWMHNGFVTIDSVKMSKSLGNFFTIRQVIDIYHPLALRYFLMSAHYRSPINYSNIQLESASDRVFYIYETLHECESFLNQHDQTIRKDSIPPDTLDIIDKFHDVFLTSMSDDLHTPVVLAGMSDPLKSINDLLHTRKGKKQQFRIESLSALEKSVRDVLTVLGLMPASYFEVLQQLKEKALKRANLTEDDVLQKIEERAAARIQKEYAKSDAIRKDLAVVGITLMDSPNGTTWRPAIPLPLQELL

SEQ ID NO: 135809 - protein, 48 aa, Glycine max
  Coding DNA Sequence Number=SeqID_44124
MWVGRGGGGGLGNGRGVKVTEALLGEKSTAALMGELLGVPNNFPKGRK

SEQ ID NO: 135810 - protein, 161 aa, Glycine max
  Coding DNA Sequence Number=SeqID_44125
MNISVVEIEPFCNVASSVKEEGVVELLTATGILLADLGNGDLAAVEGRVGVAGVGCGCMSAWSEGGFDMDDGGGMGGGVGKGDWLCCIGTRHEGVVGLEGGGDGGGVELQQIWPWQPRGGPRPREKVQRPSFEVGVEMKGTEDEGCAETKGIGAAEMVAGG

SEQ ID NO: 135811 - protein, 248 aa, Glycine max
  Coding DNA Sequence Number=SeqID_44126
  Gene Ontology: Mol. function=metal ion binding
  Homolog annotation: Hit_ID=A7QDI0; Match level="QueryCoverage=45%, HitCoverage=53%, E-value=2e-18, Identity=43%"; Hit description =Chromosome chr10 scaffold_81, whole genome shotgun sequence
  Pfam annotation: Domain name=zf-C3HC4; Domain location=173-229; Score= 8.4; E_value=0.01; Accession=PF00097.16; Description=Zinc finger, C3HC4 type (RING finger)
MSGLNWSILRVNNLLMDQHRGEVLDPVHDRNLSHSVEGVAIARASISGEVGEVDEDLGSDKELKDDVKGQDKHDQENISDKLPGVDQGTSYNSNNLVNQEVIETVVVIESVQTEYANEDNTKLEAKVDESGLSLVSMKAPKGVSETDKNSCVIDIKCSSRKKIYKSSEGERICRICHLTSGQSSDATTVGTSDSATSADLIQLGCACKGKPGIAHVHCALAWFKLKGNMYLFLPNISLIINNNISVIF

SEQ ID NO: 135812 - protein, 70 aa, Glycine max
  Coding DNA Sequence Number=SeqID_44127
MVCVGENLEGKERQRPSVEERIEAQKDRRRVKRQVEEEGRSELLVLLLRLGPKYTLPSSFTLVKSNNNSN

SEQ ID NO: 135813 - protein, 119 aa, Glycine max
  Coding DNA Sequence Number=SeqID_44128
  Gene Ontology: Mol. function=structural constituent of ribosome; Cellular component=ribonucleoprotein complex; Biological process =translation
  Homolog annotation: Hit_ID=P51425; Match level="QueryCoverage=42%, HitCoverage=98%, E-value=1e-23, Identity=100%"; Hit description=60S ribosomal protein L39
  Pfam annotation: Domain name=Ribosomal_L39; Domain location=30-62; Score=37.3; E_value=5.3e-08; Accession=PF00832.11; Description =Ribosomal L39 protein
  Pfam annotation: Domain name=Ribosomal_L39; Domain location=77-119; Score=100.6; E_value=4.9e-27; Accession=PF00832.11; Description =Ribosomal L39 protein
  Pfam module annotation: Pfam domain module=Ribosomal_L39::Ribosomal _L39; Domain location=30-62::77-119
GLVIRVFAHPCAVEPPEEKAKMPSHKTFRIKKKLAKKMRQNRPIPYWIRMRTDNTISAVTGVAPSLDSEPSHKTFRIKKKLAKKMRQNRPIPYWIRMRTDNTIRYNAKRRHWRRTKLGF

SEQ ID NO: 135814 - protein, 106 aa, Glycine max
  Coding DNA Sequence Number=SeqID_44129
MNTNGDRKKKRRRKRRTNNKRKKKAEEEGCARGGRRYMNRRKKKARQHCSFIYVIRVNDIFAISPYMLGAPAKMLGVPSNSLHLMWAMGLILQIFIYKIKFKKCFM

SEQ ID NO: 135815 - protein, 235 aa, Glycine max
  Coding DNA Sequence Number=SeqID_44130
MAFPSVNEQRETNGNDQLILLHTGPFQNRRASTERPTGRRERRRGPSLAPFRNPQIPQSDNVVPIPDRLNLVLLELKHENGVRVGGAVVVLIKQPVIKIPRDLHVHAVNLDPLVPSELPLQPLNLQHLLSVHAEAEPGVVVVAAIDLNLTRFASERGARGVQPVGEDEGHVVVDDEGDVEAREGFWGGAEFGSGEVPEEESVGGEFFGTVFFPEEEGSYVVVEGEGGGVRVGWGI

SEQ ID NO: 135816 - protein, 173 aa, Glycine max
  Coding DNA Sequence Number=SeqID_44131
MSLDPSAVSVYYAITCGSNLHASSCLEMLLYGFAPTLNIVVDCGNLRKSVAHILLRHGADAADSVYNTNSFAASTTLHTLSLDLVNRRDFSNPRGQWCDDDVDVDVDVDVVRRRALWPALMEVPPSPPPLHGHHWISLTPLPFPILCLSQRLNFSVAVFSKSSFSLDGLWGFW

SEQ ID NO: 135817 - protein, 41 aa, Glycine max
  Coding DNA Sequence Number=SeqID_44132
MDEGIGDLSSDEGRIGATTTREVSFTTGLLQFGMRQCDISR

SEQ ID NO: 135818 - protein, 90 aa, Glycine max
  Coding DNA Sequence Number=SeqID_44133
  Gene Ontology: Mol. function=binding
  Homolog annotation: Hit_ID=A7PBI2; Match level="QueryCoverage=77%, HitCoverage=5%, E-value=2e-12, Identity=55%"; Hit description =Chromosome chr16 scaffold_10, whole genome shotgun sequence
MDLARKVFNEIPERDVVAWTALIIEHVHNGEPQKGLRCLRHMHCEDAPMPNARTWEGGFLACGSLGARIDPFVRWFTKILSVGRPSSGFM

SEQ ID NO: 135819 - protein, 348 aa, Glycine max
  Coding DNA Sequence Number=SeqID_44134
  Gene Ontology: Biological process=chloroplast organization and biogenesis
  Homolog annotation: Hit_ID=A5BKC8; Match level="QueryCoverage=47%, HitCoverage=38%, E-value=9e-34, Identity=43%"; Hit description =Putative uncharacterized protein
  Pfam annotation: Domain name=CDT1; Domain location=52-200; Score =55.7; E_value=1.6e-13; Accession=PF08839.2; Description=DNA replication factor CDT1 like
MEQNACKELSKIASNFKCEKVLETVDESIVCPTPQKNEEPLTVKSKEGQTNLPEKYSTLADLFGHMSCSLRLLYLCKKAPIFKMFAARKFSHAHLAQMKYILPKSVYIDRVLVHDKKSLCVVPDMKITLKFEVVKDCFGESADLALRRYFKSKLIDFFDMHPEDMPTQKSTSSYKPAKRVLDFSLMEDNDGLGIEMDKLESIRALHESSRGCSEDCNSFGSVSAPQEVLSPVDDNLVAVEFFALIGKEKDKRNDDIDALLGADEKLEDFDDDQENKENKEGVVVEEEMDEAFNFRLNGIGSNVATGWWFVNEGEAVLLAHHDGSCTYYDITNSEVCVLSLMPDSKCQA

SEQ ID NO: 135820 - protein, 528 aa, Glycine max
  Coding DNA Sequence Number=SeqID_44135
  Gene Ontology: Mol. function=transcription regulator activity; Cellular component=nucleus; Biological process=regulation of transcription
  Homolog annotation: Hit_ID=A7P5W9; Match level="QueryCoverage=89%, HitCoverage=71%, E-value=0.0, Identity=77%"; Hit description =Chromosome chr4 scaffold_6, whole genome shotgun sequence
  Pfam annotation: Domain name=WD40; Domain location=204-241; Score =18.7; E_value=0.021; Accession=PF00400.23; Description=WD domain, G -beta repeat
  Pfam annotation: Domain name=WD40; Domain location=268-306; Score =43.0; E_value=1.1e-09; Accession=PF00400.23; Description=WD domain, G-beta repeat
  Pfam annotation: Domain name=WD40; Domain location=310-348; Score =41.3; E_value=3.4e-09; Accession=PF00400.23; Description=WD domain, G-beta repeat
  Pfam annotation: Domain name=WD40; Domain location=352-390; Score =51.9; E_value=2.3e-12; Accession=PF00400.23; Description=WD domain, G-beta repeat
  Pfam annotation: Domain name=WD40; Domain location=394-432; Score =50.8; E_value=4.9e-12; Accession=PF00400.23; Description=WD domain, G-beta repeat
  Pfam annotation: Domain name=WD40; Domain location=436-474; Score =54.7; E_value=3.1e-13; Accession=PF00400.23; Description=WD domain, G-beta repeat
  Pfam module annotation: Pfam domain module=WD40::WD40::WD40::WD40::WD4 0::WD40; Domain location=204-241::268-306::310-348::352-390::394 -432::436-474
MVHSHTETLRAVNLKEPKRGYRGMPWCPPALKCSTTFMSGDKYSSSQYSVFTCSVTPGQPSLISDDPEAVTLTGSSQEAANQINQKEIHWGLLEDSLEERLEKAGALLSDSEKGEGEAKEGENDETKKRSIEGGKQGASVKKVKKDKGGSATGKSAKPEANTIPSAPRVKPELPLPVIPAEAEQSVLEDLRNRVQLSSVALPSVSFYTFINTHNGLSCSSISHDGSLIAGGFSDSSLKVWDMAKLGQQQTSSLSQGENEQIFGQGGGKRQYTLFQGHSGPVYAASFSPVGDFILSSSADSTIRLWSTKLNANLVCYKGHNYPVWDVQFSPVGHYFASSSHDRTARIWSMDRIQPLRIMAGHLSDVDCVQWHANCNYIATGSSDKTVRLWDVQSGECVRVFVGHRGMILSLAMSPDGRYMASGDEDGTIMMWDLSSGRCLTPLIGHTSCVWSLAFSSEGSVIASGSADCTVKLWDVNTSTKVSRAEEKGGSANRLRSLKTLPTKSTPVYSLRFSRRNLLFAAGALSKSG

SEQ ID NO: 135821 - protein, 135 aa, Glycine max
  Coding DNA Sequence Number=SeqID_44136
  Homolog annotation: Hit_ID=B0LUR8; Match level="QueryCoverage=97%, HitCoverage=47%, E-value=4e-26, Identity=52%"; Hit description =Transcription factor
VQRSLQDKSFLVATYEGKHNHGVFRDLLKPSSSIQETSIMDNYLPMTVMPNDKLDTMNIDLCLCNRAQTDIRRCDDIKEQNDRGSNSKIEEYASSPVKDPDFIMPLAEAVVHSLNSQSYKQVGLNLSLGLPEPHH

SEQ ID NO: 135822 - protein, 382 aa, Glycine max
  Coding DNA Sequence Number=SeqID_44137
  Gene Ontology: Mol. function=phosphoprotein phosphatase activity; Cellular component=protein serine/threonine phosphatase complex; Biological process=protein amino acid dephosphorylation
  Homolog annotation: Hit_ID=A7P656; Match level="QueryCoverage=90%, HitCoverage=96%, E-value=1e-176, Identity=86%"; Hit description =Chromosome chr4 scaffold_6, whole genome shotgun sequence
  Pfam annotation: Domain name=PP2C; Domain location=59-359; Score =279.2; E_value=8.4e-81; Accession=PF00481.12; Description=Protein phosphatase 2C
MYYYRQKQYKGYWIKEIQCTSGAALQKTQTNPTKKIGMGIYLSTPKTEKFSEDGENDCLRYGLSSMQGWRATMEDAHAAYTDLDESTSFFGVYDGHGGKVVAKFCAKFLHQQLFKSETYLTGDIGASLQKAFLRMDEMMRGQRGWRELSILGDKINKFTGMIEGLIWSPRSSDGNCHVDDWAFEEGPHSDFAGPTSGSTACVAVIRNNQLVVANAGDSRCVISRKGQAYNLSRDHKPDLEIEKERILKAGGFIHVGRVNGSLNLARAIGDMEFKQNKFLSAEKQIVTANPDINTVELCDEDEFVVLACDGIWDCMSSQQLVDFVHEQLHSETKLSAVCERVLDRCLAPSTASGEGCDNMTMIVVQFKRPAQSSVPAEESSSN

SEQ ID NO: 135823 - protein, 1205 aa, Glycine max
  Coding DNA Sequence Number=SeqID_44138
  Gene Ontology: Mol. function=DNA-directed RNA polymerase activity; Cellular component=nucleus; Biological process=transcription
  Homolog annotation: Hit_ID=A7P644; Match level="QueryCoverage=96%, HitCoverage=98%, E-value=0.0, Identity=71%"; Hit description=DNA -directed RNA polymerase
  Pfam annotation: Domain name=RNA_pol_Rpb2_1; Domain location=67-479; Score=108.1; E_value=2.6e-29; Accession=PF04563.6; Description=RNA polymerase beta subunit
  Pfam annotation: Domain name=RNA_pol_Rpb2_2; Domain location=251-421; Score=-1.7; E_value=8.5e-05; Accession=PF04561.5; Description=RNA polymerase Rpb2, domain 2
  Pfam annotation: Domain name=RNA_pol_Rpb2_3; Domain location=494-561; Score=48.3; E_value=2.6e-11; Accession=PF04565.7; Description=RNA polymerase Rpb2, domain 3
  Pfam annotation: Domain name=RNA_pol_Rpb2_4; Domain location=597-659; Score=84.4; E_value=3.7e-22; Accession=PF04566.4; Description=RNA polymerase Rpb2, domain 4
  Pfam annotation: Domain name=RNA_pol_Rpb2_5; Domain location=673-720; Score=41.4; E_value=3.2e-09; Accession=PF04567.8; Description=RNA polymerase Rpb2, domain 5
  Pfam annotation: Domain name=RNA_pol_Rpb2_6; Domain location=725 -1102; Score=347.2; E_value=2.9e-101; Accession=PF00562.19; Description=RNA polymerase Rpb2, domain 6
  Pfam annotation: Domain name=RNA_pol_Rpb2_7; Domain location=1104 -1203; Score=129.2; E_value=1.2e-35; Accession=PF04560.11; Description=RNA polymerase Rpb2, domain 7
  Pfam module annotation: Pfam domain module=RNA_pol_Rpb2_1::RNA_pol _Rpb2_2::RNA_pol_Rpb2_3::RNA_pol_Rpb2_4::RNA_pol_Rpb2_5::RNA_pol_Rpb2_ 6::RNA_pol_Rpb2_7; Domain location=67-479::251-421::494-561::597 -659::673-720::725-1102::1104-1203
MGHVGSSKDGTEAGPSAAAMGIDDDEDIDLGDVDLDPTNAEILEELGEDIVKYWCKKASMLFFNEYGLISHQINSFNHFIHTGLQKTFESFGDLVVTPGFDPSKKGENEHFRYASVKFGNVKLDKPMFWGGEGNAQEFKMLPRHARIQRMTYASKVKIQVKVQVYVPKKVRSDKFKTGKAEFLDREVMKEDEREIIIGRLPVMVKSDLCWMKEAEKEDDEFDHGGYFIVKGAEKTFIAQEQLYLKRLWVMNSPGWMIAYKSQMKRNRMVIKLVGNSRGEEVENGDMSLAVYFLSVEVPVWVLFFALGVSSDKEIVDLIGCGNDDVRIQNILFASVRDADEKCGAFRRGRHAVQYLEKCVKSVQFPPSESMQECLEMYVFPGISGLNRKARFLAYMVKGLLLAYTGRRKCDNRDDFRNKRLELASELLDRELKVHIAHARKRMAKALQRDLYGDRDVRPIEHYLDASIITNGLQRAFSTGAWSHPYKRMERISGVVANVGRTNPLQTMAELRRARQQVQYTGKVGDARYPHPSHWGKVCFLSTPDGENCGLVKNLAVTGLVSTDVSAVSEYILPKLLDCGMEELVDDTSTHLGNKDKVLLNGDWVGVCPDSSSFVAELRSRRRRNELPHQVEIKRDQSQHEVRIYSDAGRILRPLLVVGNLLKIKGFKSDCNSFQSLLDKGVIELIGPEEEEDCCTAWGVEYLFGKEGKRSVKYTHCELDMSFLLGLSCSLVPFANHDHARRVLYQSQKHSSQAIGFSTTNPNIRVDTLSHQLHYPQKPLFRTMASDCLGKPDNSLGQNKISKIPPKAEFYNGQNAIVAVNVHLGYNQEDSLVMNRASLQRGMFRSEHIRSYKSEIDNKESSDKKRKPEDIVNFAKLQSKIGRVDSLDDDGFPYVGANLQSGDIIIGKGAESGADNSVKLKHTERGYVQKVVLSSNDEGKNFAVVSLRQVRSPVLGDKFSSMHGQKGVLGFLESQENFPFTRQGIVPDIVINPHAFPSRQTPGQLLEAALGKGIACGGILRQATPFSTPSVDAITEQLHRAGFSRWGNERVYNGRTGEMVRSLIFMGPTFYQRLHHMSEDKVKFRNTGPVHPLTRQPVADRKRFGGIKFGEMERDCLIAHGASANLYERLFTLSDSSQIHICSKCKNVANVILRPVSGGRKIRGPYCRHCESADDIVVAHVPYGAKLLCQELFSMGINLKFETQLC

SEQ ID NO: 135824 - protein, 42 aa, Glycine max
  Coding DNA Sequence Number=SeqID_44139
MAKNVLTGTAYVSEDIPIDDVAEDDDEELPKVDNVETETSNL

SEQ ID NO: 135825 - protein, 520 aa, Glycine max
  Coding DNA Sequence Number=SeqID_44140
  Gene Ontology: Mol. function=catalytic activity; Cellular component =integral to membrane; Biological process=metabolic process
  Homolog annotation: Hit_ID=A7P648; Match level="QueryCoverage=93%, HitCoverage=93%, E-value=0.0, Identity=70%"; Hit description =Chromosome chr4 scaffold_6, whole genome shotgun sequence
  Pfam annotation: Domain name=PLD_envelope; Domain location=267-410; Score=-52.7; E_value=0.00066; Accession=PF08371.2; Description =Phospholipase Dviral envelope
  Pfam annotation: Domain name=PLDc; Domain location=166-193; Score =25.5; E_value=0.0002; Accession=PF00614.13; Description =Phospholipase D. Active site motif
  Pfam annotation: Domain name=PLDc; Domain location=446-472; Score =21.2; E_value=0.0038; Accession=PF00614.13; Description =Phospholipase D. Active site motif
  Pfam module annotation: Pfam domain module=PLD_envelope::PLDc::PLDc; Domain location=267-410::166-193::446-472
MRHTPKIGVHGVFVCYNILVLLLSSFHESTSSSSHCKAWLVQSIPTDMPHLSHVPGTLSTGDVLRWLAANSTTRLHIIAQYWQLLPSPNDPRSGDYGYTQHQMHEFGADQGVSLYQALDAAADRNVSIRLLSHSGVYPTFASEPSKLAFGRPNVENVTLLLEDWWGSGIVHAKVWISDSRDVYIGSANNDWKSLTQVKELGIYFADCPEIAKRVEVYFDNLWTLASLNSSAYTKTVFDQDWQVERKVPCWSHFINHRERCKSPLPQYLETPHIAGYPILSEPYMFKVPFQTPGSNYSTKHPQGSYLSFAPPELLFGKYQADEHAWIDTIKSVGKKETVRISTMDWLGQSEFIDQTIYWSSLSSATSQVVFSKNATVQILVAYWSHSISNTDSYLNSLLYTNNLCSSSKYNTCSGKVEIKYYVVPGFNMTGPAIKGGNRTGNIYPDFTRVNHGKYAVSDVRAHIGTSNLVWDYFYTTAGVSLGTHNTAIISQLREIFNADWNSPYAVPFEEMENVHTRSSI

SEQ ID NO: 135826 - protein, 140 aa, Glycine max
  Coding DNA Sequence Number=SeqID_44141
  Homolog annotation: Hit_ID=A5ATT1; Match level="QueryCoverage=41%, HitCoverage=52%, E-value=1e-10, Identity=55%"; Hit description =Putative uncharacterized protein
MEGVEWIKRESTVLIFSVELWNFLYETKLLWNFLYETKLVELGTAKKERERARGESVHVAPLHADTSSPMWLYSNLNLPHCPGLVEALDGEAKLEKMMADGDKKALLQKAHSAIIFSLGDKVLRQISKETTAAGVWSKLE

SEQ ID NO: 135827 - protein, 345 aa, Glycine max
  Coding DNA Sequence Number=SeqID_44142
  Gene Ontology: Mol. function=catalytic activity; Cellular component =chloroplast; Biological process=metabolic process
  Homolog annotation: Hit_ID=A7P5A9; Match level="QueryCoverage=99%, HitCoverage=87%, E-value=1e-148, Identity=76%"; Hit description =Chromosome chr4 scaffold_6, whole genome shotgun sequence
  Pfam annotation: Domain name=Aminotran_4; Domain location=56-329; Score=30.0; E_value=2.4e-11; Accession=PF01063.10; Description =Aminotransferase class IV
MKAVTNCNQSGCLAYSRTEISDVPLLSCSEAMEKLKSFREKVKGKQQFLAMYSSIFGGITTDPAAMVIPMDDHMVHRGHGVFDTTAIIDGYLYELDQHLDRFIRSASTAKINPPYDRGTIRGILIQTVSASKCRNGTLRYWLSAGPGDFDLSPSGCHKSCLYAITIQDLSPINFRGVKVVTSNVPIKPPQFATTKSVNYLPNVLSKMEAEELGAFVGIWLDSDGFVAEGPSMNVAFVTKEKELVMPLCDKILSGCTAKRVLTLAESLVREGKLCGIRMKNVSVEEGKNADEMMLLGSGIMVRSVVQWDEQIIGCGKEGPITQTLLNLVVEDMKSTLPAVGTPVPY

SEQ ID NO: 135828 - protein, 297 aa, Glycine max
  Coding DNA Sequence Number=SeqID_44143
  Gene Ontology: Mol. function=GTP binding; Cellular component =intracellular; Biological process=barrier septum formation
  Homolog annotation: Hit_ID=Q8LBI3; Match level="QueryCoverage=100%, HitCoverage=100%, E-value=1e-115, Identity=66%"; Hit description =Putative GTP-binding protein
  Pfam annotation: Domain name=MMR_HSR1; Domain location=111-236; Score= 106.2; E_value=1e-28; Accession=PF01926.14; Description=GTPase of unknown function
  Subcellular localization annotation: CTP_CleavageSite=65; ConfidenceScore=5.57e-01
MVLLYLPRFPLYLVTLSHSLPRRTYSKTTLLRPPKSTLTTSQPLTVNPSPTELSLEKLFVPPETTVSLESSRVLNGSNILLSNYANDAQVLQAEFVKSSVKTEDCPSDGIPEFALVGRSNVGKSSLLNSLVRRKKLALTSKKPGKTQCINHFRINNSWYLVDLPGYGYASAPHELRMDWEKFTKDYFLNRSTLVSVFLLIDASIPAKQIDLDYASWLGQNQFFFQIPMTLIFTKCDKRKKKKNGGKRPEDNVNDFQDLIRGFFQSVPPWIMTSSVTNQGRDEILLHMAQLRNYWLKH

SEQ ID NO: 135829 - protein, 357 aa, Glycine max
  Coding DNA Sequence Number=SeqID_44144
  Gene Ontology: Mol. function=hydrolase activity
  Homolog annotation: Hit_ID=A7P5A5; Match level="QueryCoverage=87%, HitCoverage=92%, E-value=1e-108, Identity=63%"; Hit description =Chromosome chr4 scaffold_6, whole genome shotgun sequence
  Pfam annotation: Domain name=Peptidase_S15; Domain location=125-323; Score=-102.5; E_value=0.014; Accession=PF02129.9; Description=X-Pro dipeptidyl-peptidase (S15 family)
  Pfam annotation: Domain name=Peptidase_S9; Domain location=161-355; Score=-73.2; E_value=0.031; Accession=PF00326.12; Description=Prolyl oligopeptidase family
  Pfam module annotation: Pfam domain module=Peptidase_S15::Peptidase _S9; Domain location=125-323::161-355
MNFNPNKIIALNSASFVIYLLFSSCYGGGSHSNCKIQNKLAGKEAIVEAQSQSKLRSEFLQVLRSRRPTQVPLTVKPAKPVKNPLYQMPPPTREEIEILDSTPKADIGNLEELLEEENLYLNIEKGEQGRLPVMILKLKRSNKQRKKPVVVFLHSSYTNKESMRPFLKAYASRGYIAISVDSRYHGERATNTTTYIDVWDLIKLADYLTQRRDIDLSRIGITGISLGGMHAWFAAVADTRYAVVVPLIGVQGFRWAIDNDKWQGRVDSIKPLFEVARADLGKGAIDKEVVEKVWSRIAPGLASQFDSPYSVPTIAPRALLIVNGAEDPRCPLGGLEIPRAKATEAYRKFHCLDNFKV

SEQ ID NO: 135830 - protein, 138 aa, Glycine max
  Coding DNA Sequence Number=SeqID_44145
  Gene Ontology: Mol. function=catalytic activity; Biological process =cellular metabolic process
  Homolog annotation: Hit_ID=A7QWT7; Match level="QueryCoverage=72%, HitCoverage=32%, E-value=2e-21, Identity=53%"; Hit description =Chromosome chr4 scaffold_208, whole genome shotgun sequence
MRTVLSRLIHSTPSISRINATVVSISGRNLFFKVEEAETVNVAPHLFFTFEENGPPPPTEKLVVFGGNRFVAKHIFREALDRGESAGCPTRSGRSSLHDSWARNFYWYKGNLFSTDSLTEALNGATAVLQDVALDFVA

SEQ ID NO: 135831 - protein, 258 aa, Glycine max
  Coding DNA Sequence Number=SeqID_44146
  Homolog annotation: Hit_ID=A4PY46; Match level="QueryCoverage=79%, HitCoverage=54%, E-value=5e-09, Identity=26%"; Hit description =Ankyrin
MVEALSQNIVTLTDLPMILLSESDLTNSLCGVSCYVLLSVPEWFFTNMKVSQFSLANVPLLKEELRAKITFNERIAIYVTRLRKRISDDTRNALLMGAILFVTSTYEAALSPPGGVYQGEASSVTTSKKTRASLLQRDYATPEIVGKVVMKMQTFFWFWSFNTWSFYLSILMICLLMPRGRIRLIVIFPLSIFSGCYVFSMMVISPSLRLNTATVVMPCIFIVFYCWESSIYIRLAQKLKMYGHRQKDALKFSRGNRW

SEQ ID NO: 135832 - protein, 734 aa, Glycine max
  Coding DNA Sequence Number=SeqID_44147
  Gene Ontology: Mol. function=cysteine-type peptidase activity; Cellular component=integral to membrane; Biological process =ubiquitin-dependent protein catabolic process
  Homolog annotation: Hit_ID=A7QJQ5; Match level="QueryCoverage=63%, HitCoverage=98%, E-value=0.0, Identity=70%"; Hit description =Chromosome undetermined scaffold_107, whole genome shotgun sequence
  Pfam annotation: Domain name=UCH; Domain location=168-473; Score =186.6; E_value=6.5e-53; Accession=PF00443.20; Description=Ubiquitin carboxyl-terminal hydrolase
  Pfam annotation: Domain name=zf-HIT; Domain location=53-83; Score =17.1; E_value=0.0036; Accession=PF04438.7; Description=HIT zinc finger
  Pfam annotation: Domain name=zf-MYND; Domain location=57-94; Score =55.4; E_value=1.9e-13; Accession=PF01753.9; Description=MYND finger
  Pfam module annotation: Pfam domain module=UCH::zf-HIT::zf-MYND; Domain location=168-473::53-83::57-94
MLVLGVWDLKWLLQFVFSAFVLAIGLHALLKNTASKYFEIEATFHAMPGPLTDHSLCAVCRNPANKKCSRCKSVRYCSQACQQAHWKSEHKMRCKEFQGSASVMNLDQTEVTNRVFKASAAVNTSTSSIALIPECGRGTSRTIKQPKTVIYPYDEFVKLFNWDKPGFPPCGLKNCGNSCFANVVLQCLSFTRPLIAFLLEKGHHGECCHSDWCFLCEFETHVEKVRLSSQAFSPMNILSRLPNISGTLGYGRQEDAHEFIRFAIDAMQSVCLDEFGGEKVVPPKHQETTLIQHIFGGHLQSEVICTECEKNSNQYENMMDLNVEIHGDAASLEECLDQFTAKEWLHGDNMYKCDGCKGYVKAWKRLTVKRAPNILTIALKRFQSGRFGKLNKRVTFPETLDLSPYMSEAGDGSDIYKLYAVVVHIDMLNASFFGHYICFIKDLCGNWYRIDDWKVSSVELEEVLSQGAYMLLYSRVNARPSGLQSIELSETAEVQTIKSKVQPGWTEQAECLSDMKSETYSYSRGYEAFPSDSSPELKVSCCESVTEMNSEIKREQSKDVDIIDVASESFCNGFETSHMHDSEAVKDLGDIDSDGSNTCSSVLEEISVCMEEQDDNDNDMAKSSPCPHLPNGFSCFDKDSSVSVDYQNTREDSGHKDVTKCKLTSNGFANYSNGYGSANKYDDVPVEDGDGSFSTETPSAKMHQLKERLASENSEVDKGNGVKKVEISANKLII

SEQ ID NO: 135833 - protein, 734 aa, Glycine max
  Coding DNA Sequence Number=SeqID_44148
  Gene Ontology: Mol. function=DNA ligase (ATP) activity; Cellular component=nucleus; Biological process=response to DNA damage stimulus
  Homolog annotation: Hit_ID=A7P4W3; Match level="QueryCoverage=93%, HitCoverage=99%, E-value=0.0, Identity=54%"; Hit description =Chromosome chr4 scaffold_6, whole genome shotgun sequence
  Pfam annotation: Domain name=DRMBL; Domain location=620-718; Score =152.2; E_value=1.4e-42; Accession=PF07522.5; Description=DNA repair metallo-beta-lactamase
  Pfam annotation: Domain name=SAM_1; Domain location=229-292; Score =75.8; E_value=1.4e-19; Accession=PF00536.21; Description=SAM domain (Sterile alpha motif)
  Pfam annotation: Domain name=SAM_2; Domain location=228-294; Score =49.6; E_value=1.1e-11; Accession=PF07647.8; Description=SAM domain (Sterile alpha motif)
  Pfam module annotation: Pfam domain module=DRMBL::SAM_1::SAM_2; Domain location=620-718::229-292::228-294
MGLLTIQILIPRTTSLKTAFLQAIIILPEPKGAERELREEMISTMSWDENNDEFEIPLTQTTTAFHAALASIDDDNNQRPSKKPKRKTSEGGCEIDNCCSLDFIPSTIGCVSACSVQPLGEEDSVSPSSSTASLSELKTKGNYLRNSIESKLVVSRANALNRADADSDSELDLLMNLCDELEEVDSSVRCPLCEVDISNLTEEQRHLHTNNCLDDVAVVPDDNEKGAQQVPKVASVVDWLRGLGLNKYEDVFVREEVDWDTLQWLTEEDLLSMGIAALGPRRKIVHALSELRKGDAAANEKHEDSSAEPRRIRNQKVKLKHDKSERKVDGTGKPVANKLITEYFPGFASKEKKVSASPGEPQEKKNSGLDSGRKHKSKNTPTNRKLRDVPKWCAVQGTPFRVVRVFDKYFYYMQDAFKYLRGDCSHWFLTHFHLDHYQGLTKSFNHGKIYCSSVTARLVNMNIGIPYDKLHVLPLNQKVEIAGVDVTCLDANHCPGSIIILFQPPNGKAVLHTGDFRFSEEMAVNPLMRICPINTLILDTTYCNPQYDFPKQESVIQFVIDAVQAETFNPKTLFLIGSYTIGKERLFLEVARSLRKKVHVTAAKLRILKCLELKEEDMQWFTSNEHESNIHVAPMWTLASFKRLKHISSQYKSQYNLIVAFSPTGWTFGKGKKKSTGRRWQQGTIIRYEVPYSEHSSFTELKEFVRVVSPDNIIPSVNNDGPESSDAMISLLLS

SEQ ID NO: 135834 - protein, 538 aa, Glycine max
  Coding DNA Sequence Number=SeqID_44149
  Gene Ontology: Cellular component=intracellular
  Homolog annotation: Hit_ID=A5C2S2; Match level="QueryCoverage=99%, HitCoverage=99%, E-value=0.0, Identity=67%"; Hit description =Putative uncharacterized protein
  Pfam annotation: Domain name=BRCT; Domain location=191-266; Score =5.6; E_value=1.1; Accession=PF00533.17; Description=BRCA1 C Terminus (BRCT) domain
  Pfam annotation: Domain name=BRCT; Domain location=46-124; Score =46.7; E_value=7.9e-11; Accession=PF00533.17; Description=BRCA1 C Terminus (BRCT) domain
  Pfam module annotation: Pfam domain module=BRCT::BRCT; Domain location=191-266::46-124
  Subcellular localization annotation: CTP_CleavageSite=70; ConfidenceScore=5.43e-01
MGGDGRVEVVSGKGCSRLFSSSIPSFRGLQPLEPMSPASSPLQVPSSTAPFAGLVICVTGLSKEARNQVMEATERLGGQYSPNLHPQCTHLVYSFGGRKFEHALKHGAKNGLFVVTLGWFVDSVRKTVRLSESHYRVKSYGDNNTRLEDFRLLPEYRNAENSCFPARIHQSNQANSVEELQRFTGRESNRNSDSTLSGCSIYVDPGISSELRNKVIETASREGASLVEQWFVGCSVSHVVTEGTSIQRYLGYSSNLITPLWILKTAKEKYVRKLVHMSVDLAKQVGLMLEDIHNDISGKEVIKQKVLNNLPDTESEVSYEERQQIVNSAKNGVRNRRGRRMQTCQTPIRPITPNNLLDSICWSISEPTSTASIYTDSFSVEDPSENHTSIFFDAKGDGKDSEASFSNSTRPLTESEKSELIFKNHFLTILLPIDRFAEMGPSSRTFFSHNGFTCLQVLDHIRAFYQENMSRQEIEAAIHSDSRHADRLRSVYSSKETAESGYVMFKRVEFLGSRTSFEMLKRVTGDNNSNVYELLLRA

SEQ ID NO: 135835 - protein, 1065 aa, Glycine max
  Coding DNA Sequence Number=SeqID_44150
  Gene Ontology: Mol. function=binding; Cellular component=nucleus; Biological process=metabolic process
  Homolog annotation: Hit_ID=A7P4V6; Match level="QueryCoverage=86%, HitCoverage=92%, E-value=0.0, Identity=60%"; Hit description =Chromosome chr4 scaffold_6, whole genome shotgun sequence
  Pfam annotation: Domain name=PPR; Domain location=289-323; Score =30.4; E_value=6.7e-06; Accession=PF01535.11; Description=PPR repeat
  Pfam annotation: Domain name=PPR; Domain location=367-401; Score =13.0; E_value=0.22; Accession=PF01535.11; Description=PPR repeat
  Pfam annotation: Domain name=PPR; Domain location=468-502; Score =29.8; E_value=1e-05; Accession=PF01535.11; Description=PPR repeat
  Pfam annotation: Domain name=PPR; Domain location=570-604; Score =32.6; E_value=1.4e-06; Accession=PF01535.11; Description=PPR repeat
  Pfam annotation: Domain name=PPR; Domain location=671-705; Score =35.7; E_value=1.7e-07; Accession=PF01535.11; Description=PPR repeat
  Pfam annotation: Domain name=PPR; Domain location=772-806; Score =52.4; E_value=1.5e-12; Accession=PF01535.11; Description=PPR repeat
  Pfam annotation: Domain name=PPR; Domain location=807-841; Score=5.1; E_value=2; Accession=PF01535.11; Description=PPR repeat
  Pfam annotation: Domain name=PPR; Domain location=843-876; Score =12.2; E_value=0.27; Accession=PF01535.11; Description=PPR repeat
  Pfam annotation: Domain name=PPR; Domain location=909-943; Score=6.6; E_value=1.3; Accession=PF01535.11; Description=PPR repeat
  Pfam module annotation: Pfam domain module=PPR::PPR::PPR::PPR::PPR::PP R::PPR::PPR::PPR; Domain location=289-323::367-401::468-502::570 -604::671-705::772-806::807-841::843-876::909-943
  Subcellular localization annotation: CTP_CleavageSite=25; ConfidenceScore=5.03e-01
MTTCTKYPFYHQKKGWKPALRVTLRVDTGGNGLALLRECRNPSQIRVNFFRSALFFGSEIVVGTGGGANHRERLFGEDGLAIAGEKSPVSVSNAKKMHLRLRAATSTANPFIPPAHLIHSIPQWFSILRHAIAASDLPLGKRAHARILTSGHHPDRFLTNNLITMYSKCGSLSSARKLFDTTPDTSRDLVTWNAILSAHADKARDGFHLFRLLRRSFVSATRHTLAPVFKMCLLSASPSAAESLHGYAVKIGLQWDVFVAGALVNIYAKFGRIREARVLFDGMGLRDVVLWNVMMKAYVDTGLEYEALLLFSEFNRTGLRPDDVTLCTLARVVKSKQNVLEWQLKQLKAYGTKLFMYDDDDDGSDVIAWNKTLSWFLQRGETWEAVDCFVDMINSRVACDGLTFVVMLSVVAGLNCLELGKQIHGIVVRSGLDQVVSVGNCLINMYVKTGSVSRARTVFWQMNEVDLVSWNTMISGCALSGLEECSVGMFVDLLRGGLLPDQFTVASVLRACSSLGGGCHLATQIHACAMKAGVVLDSFVSTTLIDVYSKSGKMEEAEFLFVNQDGFDLASWNAMMHGYIVSGDFPKALRLYILMQESGERANQITLANAAKAAGGLVGLKQGKQIQAVVVKRGFNLDLFVISGVLDMYLKCGEMESARRIFNEIPSPDDVAWTTMISGCVENGQEEHALFTYHHMRLSKVQPDEYTFATLVKACSLLTALEQGRQIHANTVKLNCAFDPFVMTSLVDMYAKCGNIEDARGLFKRTNTSRIASWNAMIVGLAQHGNAEEALQFFEEMKSRGVTPDRVTFIGVLSACSHSGLVSEAYENFYSMQKIYGIEPEIEHYSCLVDALSRAGRIREAEKVISSMPFEASASMYRTLLNACRVQVDRETGKRVAEKLLALEPSDSAAYVLLSNVYAAANQWENVASARNMMRKANVKKDPGFSWVDLKNKVHLFVAGDRSHEETDVIYNKVEYIMKRIREEGYLPDTDFALVDVEEEDKECSLYYHSEKLAIAYGLMKTPPSTTLRMQIDFIISGVGFALVPSANLPFLGSSLSLTSKVSTS

SEQ ID NO: 135836 - protein, 63 aa, Glycine max
  Coding DNA Sequence Number=SeqID_44151
MKPPQERTTWHPCGTHGYGVIFPGSTILSASAYSKDIQNQYHSPTSEKAIKLRGQGDAKSHGP

SEQ ID NO: 135837 - protein, 287 aa, Glycine max
  Coding DNA Sequence Number=SeqID_44152
  Homolog annotation: Hit_ID=A7P4T1; Match level="QueryCoverage=61%, HitCoverage=40%, E-value=3e-08, Identity=30%"; Hit description =Chromosome chr4 scaffold_6, whole genome shotgun sequence
MQQPHYDMVANTFYEELSLDAFNSSSSLCPNHSAHQYYPQFLHNPRHKQRHEYQHSYQLFQQHPNQFHPSPQHQQQPQYLGALNCHQPQEESTTTVSFWKAFNTVLSDANGKNQEGNENFGELEAVYINARNKKKTDSALAVENTCNVANECQLLATKTTGVDGVRTKKGRKRRRKKQVEEEMGLMGSFFKRLAKRVIKHQEVLQNKLLEAIERMEKERAEWEEGWRVREREIHDREAIVKARERDLASKRDSSIVSNLEKITGQKSFVLVSSGKSSHEQLSTIHEY

SEQ ID NO: 135838 - protein, 71 aa, Glycine max
  Coding DNA Sequence Number=SeqID_44153
MEARLSSMSMCYDRGMIEEEGDDLLEKEKEKRKRVMRAESDTLWNEGEGNSVRDFIKPLIKFWKMQAAVKD

SEQ ID NO: 135839 - protein, 49 aa, Glycine max
  Coding DNA Sequence Number=SeqID_44154
MVVPEVAHAAGYEFSPSLKNFLLSIFAGVLVFLHTFLSVVPSPSYHSVT

SEQ ID NO: 135840 - protein, 376 aa, Glycine max
  Coding DNA Sequence Number=SeqID_44155
  Homolog annotation: Hit_ID=A5AXA9; Match level="QueryCoverage=62%, HitCoverage=63%, E-value=3e-16, Identity=26%"; Hit description =Putative uncharacterized protein
  Pfam annotation: Domain name=RWP-RK; Domain location=269-320; Score =30.4; E_value=2.3e-06; Accession=PF02042.6; Description=RWP-RK domain
MGDDDDNNNNSSRFVPYTCRDPFVSPLLDNFFIEPDPALVYLLPEPNLQNDEQQSLQGGHVSSTGSTIQDQSQQHFCNDNFTIGGGGVPNYQVAGSSKNKRTYPFTDVDIEHQSFRYDLKAGPSNLNQSESGIMGSRNWPPIPRPFFCTCCQVLRQTIHTNGNDFERLEIHGRIGLINHIIIQNQSITPGIILSFTNGTPAEVKGFLEDYIAQKDKLGYIIVEEAFSAFYEALCTKLDWIGKPNLEEEEPEAEPEKRRHKRSRKDQSDRINNMTLNDLSGVFHITMKAAKDVLEMSVTVIKAICRKYRLYKWPQRQLQPLARRLKVLKRALESSQDPVIIQTTNMEVRRIKQEMTQLCGGVTPTGIEIPEVEENSV

SEQ ID NO: 135841 - protein, 50 aa, Glycine max
  Coding DNA Sequence Number=SeqID_44156
MEEDEDGAQISHSTENREKLYFFLYHFLLLPWEFFLLLGVAVYFSGQSYM

SEQ ID NO: 135842 - protein, 887 aa, Glycine max
  Coding DNA Sequence Number=SeqID_44157
  Gene Ontology: Mol. function=membrane alanyl aminopeptidase activity; Cellular component=cytoplasm; Biological process=proteolysis
  Homolog annotation: Hit_ID=A7P4P1; Match level="QueryCoverage=100%, HitCoverage=100%, E-value=0.0, Identity=76%"; Hit description =Chromosome chr4 scaffold_6, whole genome shotgun sequence
  Pfam annotation: Domain name=Peptidase_M1; Domain location=10-398; Score=591.5; E_value=8.2e-175; Accession=PF01433.11; Description =Peptidase family M1
MDQFKGKPRLPKFAVPKRYDLRLKPDLVAHRFAGSVAVHLDIVPATSFIVLNAAELSVSNDAVSFTNQDSSKVIKPSRVELFENDEILVLEFPEELPIGFGVLSIRFEGILNDRMKGFYRSTYEHNGEKKTMAVTQFAPADARRCFPCWDEPSCKILQASFKITLDVPSELVALSNMPIVEEITDGNLKTVSYQESPIMSTYLVAVVVGLFDYVEDHTSDGVKVRVYCQVGKANQGKFALDVAVKSLELYKGYFATPYSLPKLDMIAIPDFAAGAMENYGLVTYRETALLYDDQHSAAANKQRVATVVAHELAHQWFGNLVTMEWWTHVWLNEGFATWVSYLATDNCFPEWKIWSQFLHESTEGLRLDGLAESHPIEVEINHACEIDEIFDAISYKKGASVIRMLQSYLGAECFQRSLASYIKRHACSNAKTEDLWAALEEGSGEHVNKLMTSWTKQKGYPVVSVKVNDQKLEFNQSQFLSSGAQGEGHWIVPITLCFGSYDVCKSFLLQSKSETHEVKEFLGSTDKGVNCWIKLNVDQAGFYRVKYDELLAARLRYAVEKQLLSASDRFEKENTNNLQLTGILDDSFALCMACQESLPSLINLMGSYREEVDYTVLSNLITISLKVQRIAADAVPDLLEYFKQFFINLFQYSAERLGWEPKPGESHVDAMLRGEILTALAMFGHNLTLDEASKRFLAFLENRNTPLLPPDIRKAAYVAVMQRASKSNRSDYESLLKVYRETDLSQEKTRILGSLASSRDPDLILEALNFMLSSEVRSQDAVFGLAVTQEGRNVAWAWLKENWEHLIKTYGSGFLITRFVSAVVSPFASFEKAKEVEEFFASHAMPFIARTLRQSLERVNINANWVQNVQNENRLGDAVKELAYRKY

SEQ ID NO: 135843 - protein, 86 aa, Glycine max
  Coding DNA Sequence Number=SeqID_44158
MQKRPLEGSSALYSDDVTVANRTSPMNQAFKIHKNKLLINLVSFIWTEVGGARRNPEGEDQLATSCSANVVFHGSLISESYMPKCI

SEQ ID NO: 135844 - protein, 1046 aa, Glycine max
  Coding DNA Sequence Number=SeqID_44159
  Gene Ontology: Mol. function=glycine dehydrogenase (decarboxylating) activity; Cellular component=mitochondrion; Biological process =glycine metabolic process
  Homolog annotation: Hit_ID=A9PL02; Match level="QueryCoverage=100%, HitCoverage=100%, E-value=0.0, Identity=78%"; Hit description =Mitochondrial glycine decarboxylase complex P-protein
  Pfam annotation: Domain name=GDC-P; Domain location=65-515; Score =979.5; E_value=1.3e-291; Accession=PF02347.7; Description=Glycine cleavage system P-protein
MERARRLANRAILKRLISTAGDNSHSLLRPKPENSILGSNRKLSHYVPSRSISLAALKPSDSFPRRHNSATSEEQTKMAQTCGFDTLDSLIDATVPKSIRLSDMSFSVFNEGLTESEMMSHMNSLASKNKCFKSYIGMGYYNTHVPPVILRNIMENPAWYTQYTPYQAEISQGRLESLMNFQTVISDLSALPMSNASLLDEGTAAAEAMSMCNNIHKGKRKTFIIANNCHPQTVDVCVTRAAGFGIKVVTVDVKDVDYKSGDVCGVLVQYPGTEGEVLDYGEFVKEAHAYGVKVVMATDLLALTVLKPPGEMGVDIVVGSAQRFGVPMGYGGPHAAFLATSQEYKRMMPGRIIGVSVDSGGKPALRMAMQTREQHIRRDKATSNICTAQSVGNGLVLVLGHSGNHVLVLFELALLANMAAMYAVYHGPEGLKTIAQRVHGLAGVFAQGLKKLGTVEVQDHPFFDTVKIKTANAHAIADAARKNEINLRVVDGNTITVAFDETTTLEDVDNLFKVFSDGKPVSFTAASLAPEVQTAVPSGLTRNSPYLTHPIFNTYHTEHEVLRYIHRLQSKDLSLCHSMIPLGSCTMKLNATTEMMPVTWPSFANIHPFAPIEQAQGYQEMFENLGKLLCTITGFDSFSLQPNAGAAGEYAGLMVIRAYHLARGDHHRNVCIIPVSAHGTNPASAAMCAMKIVSVGTDAKGNINIEELRKAAETHKDNLAALMVTYPSTHGVYEEGIDEICKVIHDNGGQVYMDGANMNAQVGLTSPGWIGADVCHLNLHKTFCIPHGGGGPGMGPIGVKKHLAPFLPSHPVVSTGGIPAPGKSQPLGTISAAPWGSALILPISYSYIAMMGSKGLTEASKTAILNANYMAKRLENHYPVLFRGVNGTVAHEFIVDLRGFKNTAGIEPEDVAKRLMDYGFHSPTMSFPVPGTLMIEPTESESKSELDRFCDALISIRQEIAEIEKGKADINNNVLKCAPHPPPVLMGDAWTKPYSREYAAFPASWLRVSKFWPSTGRIDNVYGDRNLVCTLLPTSQAVEEQAAATA

SEQ ID NO: 135845 - protein, 131 aa, Glycine max
  Coding DNA Sequence Number=SeqID_44160
IALARHSMDPEKSNRVLGFPALITGLCQFYGVPIAPSKVIRPPTNRAFIKKYCALMQAQGETPQQPGDGRQQATDKQPPPPEPLSSSTTAGALPMTRGRPVGDQVQSQRKAKVPVTNKSSRVRLKILKKRY

SEQ ID NO: 135846 - protein, 272 aa, Glycine max
  Coding DNA Sequence Number=SeqID_44161
  Homolog annotation: Hit_ID=Q2HT49; Match level="QueryCoverage=32%, HitCoverage=7%, E-value=3e-08, Identity=35%"; Hit description =Integrase, catalytic region
MGIANHCQYQEYCSVTVVVVASDLERENGFDMEENASSTEALTRKLDEILTETENDAGQFCFKEETVEKFMQELYKEIIASPPTPSNAVQVQNDSVGLQVVIGEDKTDEGHFDEDDWLARVLRWGQTLCDLIWIVPVQTSAVCDMLKLVKKYKDAEHVICFLKSLGDSYNIAKTQILLMEPLPSIDHVFCLVLQQERQLNGTILGGPEVLLNSTITGRNIRWKQSQGQGTIKWQRQRQVAGSVSEQQNREDEFGHRLQCHLAEYVRNTNHGP

SEQ ID NO: 135847 - protein, 438 aa, Glycine max
  Coding DNA Sequence Number=SeqID_44162
  Gene Ontology: Mol. function=serine carboxypeptidase activity; Cellular component=extracellular region; Biological process =proteolysis
  Homolog annotation: Hit_ID=A7P3L9; Match level="QueryCoverage=90%, HitCoverage=90%, E-value=1e-160, Identity=70%"; Hit description =Chromosome chr1 scaffold_5, whole genome shotgun sequence
  Pfam annotation: Domain name=Peptidase_S10; Domain location=35-431; Score=391.0; E_value=1.9e-114; Accession=PF00450.13; Description =Serine carboxypeptidase
  Subcellular localization annotation: CTP_CleavageSite=58; ConfidenceScore=5.43e-01
MESATKNQVFFCFFLCLLLVSASSLSASKSTHTFPKKALPTKHGHLPISPTSTSSIFYAFYEAQNSTLPLSRTPLLIWLQGGPGCSSMIGNFYELGPWRVTESLTLQRNHGAWNRIFSLLFLDSPIGTGFSVASTRQEIPTDQNHVAKHLFAAITRFVQLDPLFKHRPIYITGESYGGKYVPAIGYHILKKNAQLHVSQRVNLAGVAIGDGLTDPETQVVTHALNAYYVGLINEKQKNELEKAQLEAVRLAQMGNWSEATDARNNVMNMLRNMTGLATLYDYTKKARYQDYLVEKFLNIAKVKKALGVNESFVYELCSDVVEAALHADVMKSVKYMVEYLVRRSKVLLYQGQNDLRAGVVQSEVWVKTMKWEGIVEFVNAERKIWKVNGELAGYVQNWKSLTNVVVLGAGHILPADQVVRSQAMIEDWVLERGLFKSV

SEQ ID NO: 135848 - protein, 107 aa, Glycine max
  Coding DNA Sequence Number=SeqID_44163
TLVTTATPLAHEFIPQVKEVLDEGLVCKSLNSCALLVPKIGVPMNPKRIKVIPEWPTPPSIRKIWGFHDLTRSGNGSFRSQCKIQIHIAKNNFYGFLPDLKICFIQH

SEQ ID NO: 135849 - protein, 96 aa, Glycine max
  Coding DNA Sequence Number=SeqID_44164
  Gene Ontology: Mol. function=sequence-specific DNA binding; Cellular component=nucleus; Biological process=regulation of transcription, DNA-dependent
  Homolog annotation: Hit_ID=A7P3L1; Match level="QueryCoverage=100%, HitCoverage=41%, E-value=6e-32, Identity=74%"; Hit description =Chromosome chr1 scaffold_5, whole genome shotgun sequence
  Pfam annotation: Domain name=HALZ; Domain location=3-41; Score=27.8; E_value=4.1e-05; Accession=PF02183.9; Description=Homeobox associated leucine zipper
MECEYLKRWFGSLTEQNRRLQREVEELRAMKVGPPTVISPHSCEPLPASTLSMCPRCERVTSTADKPPSAAAAAAAAATLSPKVPPTQSRQPSAAC

SEQ ID NO: 135850 - protein, 67 aa, Glycine max
  Coding DNA Sequence Number=SeqID_44165
MSKLGPIGFTNPLKKKKVEGCAKIGLRKGEIMWETKAECQTGNDQDAMRHKGLLFSASLQSAQKQHY

SEQ ID NO: 135851 - protein, 55 aa, Glycine max
  Coding DNA Sequence Number=SeqID_44166
MAIYGYGAAAHEKSKVTNIYRILECKFGVLRVETWNLNNALTGQSEGYNRTEACK

SEQ ID NO: 135852 - protein, 266 aa, Glycine max
  Coding DNA Sequence Number=SeqID_44167
MSFEKTLAVVGQTNSSRRCINNNKNVSKGSSDDDNSDDVHDNIGSGVNVVGGSSSNDNTNNDDNNIVVVVVEVQVECNDISTSDDNGGDSDDDDNDNDGGGDNVLVVVAMLVEVVTMLMDKAGWRSWPISPLCPVSPNPPTYWAKGKVGRSFCFFYGRVSPLARQLTFRWWRQYNDGDDNNVLVLVVMLVEVVTMLVVDVATMVMMMHVEVVVAIVVVAKALAIMTMIVVTVTMLCQRWGWPCCVGDDGACGGGDAGVGFFLISIC

SEQ ID NO: 135853 - protein, 109 aa, Glycine max
  Coding DNA Sequence Number=SeqID_44168
MFWSKPELVCQVRGLWFQDLGDVRFGFGNVSLIKGKSRSFCERKCLRDCGCGGLSFDEGSGVCRNFYGLLSDFDRKVVKKKRGGGKNGLEEEEDEFVLVLNLKDVVRSF

SEQ ID NO: 135854 - protein, 116 aa, Glycine max
  Coding DNA Sequence Number=SeqID_44169
  Gene Ontology: Mol. function=DNA binding; Cellular component =chromatin; Biological process=regulation of transcription, DNA -dependent
  Homolog annotation: Hit_ID=P93704; Match level="QueryCoverage=38%, HitCoverage=31%, E-value=1e-15, Identity=86%"; Hit description=HMG-1
  Pfam annotation: Domain name=HMG_box; Domain location=2-40; Score =10.2; E_value=0.0015; Accession=PF00505.10; Description=HMG (high mobility group) box
MVGKAGGDKWKSLSDAEKAPFVATAEKKKQEYEKTILAYNKKLEGKNSEEDESDKSKSEVNDDEEDEREREIERIQPHWKAMLGELGETQISVYRSTPKSTLSKNPVLNYQSISNT

SEQ ID NO: 135855 - protein, 220 aa, Glycine max
  Coding DNA Sequence Number=SeqID_44170
  Gene Ontology: Mol. function=ferric-chelate reductase activity; Cellular component=integral to membrane; Biological process=electron transport
  Homolog annotation: Hit_ID=A7P3Z6; Match level="QueryCoverage=98%, HitCoverage=96%, E-value=8e-56, Identity=51%"; Hit description =Chromosome chr1 scaffold_5, whole genome shotgun sequence
  Pfam annotation: Domain name=Cytochrom_B561; Domain location=13-220; Score=171.8; E_value=1.8e-48; Accession=PF03188.7; Description =Cytochrome b561
MARGFQVRATSVTIFAHLLFIAIATLVLVWLLHFREGVAFFSSSNPVKIFNLHPLLMVIGFILVGGEAIMIYKSVPEKRRSVKVVHLLLHLIALVAGIIGIIAVFKSKKEAGLADMYTLHSWLGMSAISLFGLQYIFGFFAYFFPGAEMSARASLLPWHRFMGMAIFLLAVATAETGLVEYFQFLQLFRTQEALIINSTGLLLFLFAVFVTLSVILQRNY

SEQ ID NO: 135856 - protein, 337 aa, Glycine max
  Coding DNA Sequence Number=SeqID_44171
  Gene Ontology: Mol. function=hydrolase activity, hydrolyzing O -glycosyl compounds; Cellular component=cell wall; Biological process= carbohydrate metabolic process
  Homolog annotation: Hit_ID=A2TEJ2; Match level="QueryCoverage=83%, HitCoverage=84%, E-value=1e-142, Identity=82%"; Hit description =Xyloglucan endotransglycosylase/hydrolase XTH-39
  Pfam annotation: Domain name=Glyco_hydro_16; Domain location=34-219; Score=314.0; E_value=2.8e-91; Accession=PF00722.12; Description =Glycosyl hydrolases family 16
  Pfam annotation: Domain name=XET_C; Domain location=245-292; Score =61.7; E_value=2.6e-15; Accession=PF06955.3; Description=Xyloglucan endo-transglycosylase (XET
  Pfam module annotation: Pfam domain module=Glyco_hydro_16::XET_C; Domain location=34-219::245-292
MGWFLFCCCSSSLLFFVASSSSVSPRRNLPIIAFEDGYTPLFGDHNLAIHRDGKSVHLSLDERTGSGFVSHDLYLHGYFSASIKLPADYTAGVVVAFYMSNGDMFQNNHDEIDFEFLGNIRGKDWRIQTNVYGNGSTSIGREERYGLWFDPAEDFHQYSILWTDSKIIFYVDDVPIREVKRTESMGGDFPSKPMTLYATIWDASDWATNGGKYRVNYKYAPYVAEFSDLVLHGCAVDPIEHVAKCDSALGSEEVPSGVTQVQITKMRNFRLRHMTYSYCYDTVRYKVPPPECVISHQEAERLRKFDPITFGNGRRHRGKRHHHSSRGSQEEITASSF

SEQ ID NO: 135857 - protein, 313 aa, Glycine max
  Coding DNA Sequence Number=SeqID_44172
  Gene Ontology: Mol. function=oxidoreductase activity; Cellular component=cytoplasm; Biological process=metabolic process
  Homolog annotation: Hit_ID=A9PJN2; Match level="QueryCoverage=65%, HitCoverage=56%, E-value=6e-81, Identity=71%"; Hit description =Putative uncharacterized protein
  Pfam annotation: Domain name=ADH_N; Domain location=81-170; Score =29.1; E_value=3e-06; Accession=PF08240.3; Description=Alcohol dehydrogenase GroES-like domai
  Pfam annotation: Domain name=ADH_zinc_N; Domain location=201-313; Score=22.4; E_value=1e-05; Accession=PF00107.17; Description=Zinc -binding dehydrogenase
  Pfam module annotation: Pfam domain module=ADH_N::ADH_zinc_N; Domain location=81-170::201-313
MTMKKKKKKELTDNCERNEMKEPTWAEITGEAVMVVNNSNGVVVGLVVSQNALNGIQGGLCHKPNHPFGHRTPTCNQNPKFATKGDNYSGEIVGEVTEVGSKVDQFKVGDKVAVGCLVGSCKSCQNCVNNVENYCQLNIPTYDAKYVDGAITYGGFSDFMVADEHFVVSIPSDLPLDIAAPLLCAGITVYGPLRYLGLHKPDMHLGVVGLGGLGHLAVKFAKALGLKVTVISTSPNKKKEAIQNLGADSFVVSRDQDQMQAAMCTLDGIIGTVSAVHPLMPLIDMLKCHGKLVMVGTPEKPLELLLPSLIMAG

SEQ ID NO: 135858 - protein, 186 aa, Glycine max
  Coding DNA Sequence Number=SeqID_44173
  Gene Ontology: Mol. function=DNA binding; Cellular component=nucleus; Biological process=regulation of transcription
  Homolog annotation: Hit_ID=A7QNL8; Match level="QueryCoverage=89%, HitCoverage=59%, E-value=2e-53, Identity=67%"; Hit description =Chromosome undetermined scaffold_133, whole genome shotgun sequence
MSYNLRINDCICVDFTVLWLFLLGLDKYGKGDWRSISRNFVVTRTPTQVASHAQKYFIRLNSMNKDRRRSSIHDITSVNNGDISAPQGPITGQTNGSAGNFTAKAAKAATPASTGVPGVGIYAAPTIGQPIGGPLVSAVGTTVNLPAPAHMAYGVRAPVPGAVVPGAPVNMGPVTYPMQHTSVPHR

SEQ ID NO: 135859 - protein, 184 aa, Glycine max
  Coding DNA Sequence Number=SeqID_44174
  Homolog annotation: Hit_ID=A7PL97; Match level="QueryCoverage=71%, HitCoverage=85%, E-value=3e-31, Identity=54%"; Hit description =Chromosome chr7 scaffold_20, whole genome shotgun sequence
  Pfam annotation: Domain name=DUF1685; Domain location=14-111; Score =144.1; E_value=4e-40; Accession=PF07939.2; Description=Protein of unknown function (DUF1685)
MSRRPHAAPPPPPRSLHKQQSWSPDMLRDEAWQRRKDNNHPVNRRQHRLSKSLSEDDLDELKACFELGFGFDSPEIDPKLSNTIPALELYHAVNKQYNHHSLSRSSSSSSLVSDSDTTSPTTIFNPGDDLAAKKTRLKQWAQVVACSVWESSSSSCSNPSDQIFTQVTNLLIGCVKNKRKENTK

SEQ ID NO: 135860 - protein, 215 aa, Glycine max
  Coding DNA Sequence Number=SeqID_44175
  Gene Ontology: Mol. function=ribonuclease H activity; Biological process=regulation of epidermal cell division
  Homolog annotation: Hit_ID=A7QPZ1; Match level="QueryCoverage=77%, HitCoverage=100%, E-value=3e-64, Identity=70%"; Hit description =Chromosome undetermined scaffold_139, whole genome shotgun sequence
  Pfam annotation: Domain name=GRAM; Domain location=95-173; Score =33.4; E_value=8.3e-07; Accession=PF02893.11; Description=GRAM domain
MDTTLLHSLSIATYNQLHKSILNKFLPDPANERQLSTTTSKQSRIYSIINKLGRKADNFSQEVREHVRLGPTITETVMGKLRLGARILQVGGVKRVFNQFFTVRQGEKLLKSSQCYLSTTSGPLAGLLFISTDKVTFCSERSMKVFSSKGEMCRIRYKVSIPLKRIKYVNQSRNVEKPTQKYIEIVTEDNFEFWFMGFLKYQKTFNYLELAISQA

SEQ ID NO: 135861 - protein, 49 aa, Glycine max
  Coding DNA Sequence Number=SeqID_44176
MAKCCKELYSTAHKEAKLSSSSHPIPRRHQPRKPKTVAARNRLSSNGTQ

SEQ ID NO: 135862 - protein, 659 aa, Glycine max
  Coding DNA Sequence Number=SeqID_44177
  Gene Ontology: Mol. function=catalytic activity; Cellular component =external side of endosome membrane; Biological process=metabolic process
  Homolog annotation: Hit_ID=Q2R2L5; Match level="QueryCoverage=97%, HitCoverage=91%, E-value=0.0, Identity=62%"; Hit description=AMP -binding enzyme family protein, expressed
  Pfam annotation: Domain name=AMP-binding; Domain location=94-586; Score=263.2; E_value=5.4e-76; Accession=PF00501.19; Description=AMP -binding enzyme
MPEVYTVKVEEGRLATDGKPSVGPVYRSIYAKDGLLEVPSDFKSPWDFFRKYTSLIRSFNASFGRDSVKRNPNNNMLGRRQKTESKLGSYTWLTYQDVYDAAMKMGSAIRSRGVNPGDRCGIYGSNCPEWIIAMEACNSCAVSYVPLYDTLESVDTNWSIYHQLGNDFDLGLYLPGPNAVEFIINHAEVSIAFVQEKKIPSVLSCLAQCSSNLKTIVSFGSVSTTQKKEAEGHGASCFSWGEFLQLGCLDWDLPSKKKTDICTIMYTSGTTGDPKGVVIKNEAFMAEVLSVDHIIMLTDRVAGEDDVYFSFLPLAHVYDQIMETYCISKGSSIGFWQGDVRFLLEDIQELKPTIFCGVPRVFDRIYAGIKSKVSSAGPLQSTLFQCAYNYKLKYLEKGLPQHKAAPLFDRLVFDKTKLALGGRVRILLSGAAPLPRHVEEFMRVTSGSTLSQGYGLTESCAGCFTAIGDVYSMTGTVGVPMTTIEARLESVPEMGYDALSNVPRGEICLRGNTLFSGYHKREDLTKEVMVDGWFHTGDIGEWQSNGAMKIIDRKKNIFKLSQGEYIAVENIENKYLQCPLIASIWVYGNSFESFLVAVVVPERKAIEDWAKEHNLTDDFKSLCDNLKARKHILDELNSTGQKHQDHIDQLYKEAKGAMV

SEQ ID NO: 135863 - protein, 470 aa, Glycine max
  Coding DNA Sequence Number=SeqID_44178
  Gene Ontology: Mol. function=serine carboxypeptidase activity; Cellular component=extracellular region; Biological process =proteolysis
  Homolog annotation: Hit_ID=A7P3L9; Match level="QueryCoverage=72%, HitCoverage=92%, E-value=1e-116, Identity=55%"; Hit description =Chromosome chr1 scaffold_5, whole genome shotgun sequence
  Pfam annotation: Domain name=Peptidase_S10; Domain location=49-376; Score=205.0; E_value=1.9e-58; Accession=PF00450.13; Description =Serine carboxypeptidase
  Subcellular localization annotation: CTP_CleavageSite=72; ConfidenceScore=5.38e-01
MHAHTQRPPFPSKGLTTSFRFTLKTLLFLCFCFFHLPLSTSSEPTHSFPKEAFPAKHGYLPISPTSTSSIFYAFYEAQNSTLPLSQATLLIWLQGGPGCSSMIGNLYELGPWRVTESLTIQPNPGTWNRIFGLLFHDSPIGTGFSVASTPQEIPKDQNTVAKHLFAATTSFLQLDPVFKNSPIYITGESYAGKYVPAIGYYILEKNANLKVSERVNLAGVAIGDGLTDPETQVATHALNAYYVGLINERQKHELTQMRNWSEATDARNKVLRMLQNMTGLATLYDYTTKVKKALGVNELFVYEICSDIVGATLHADVMKSVKYMVDYLTMKWEGIVEFLNAERKIWKVNGELAGWASLPADQHVNSLAMIEDWVLERAILLGIKLAWSRGYRRIRVDSDSPVAINLVTKGCCMLHPYFNHVKEIHAVHSYEGDVTWSHILREANQVAKQVVIALVPFQVFNFPLGVLSMC

SEQ ID NO: 135864 - protein, 325 aa, Glycine max
  Coding DNA Sequence Number=SeqID_44179
  Gene Ontology: Mol. function=protein dimerization activity; Cellular component=nucleus; Biological process=regulation of transcription, DNA-dependent
  Homolog annotation: Hit_ID=A9PIG9; Match level="QueryCoverage=99%, HitCoverage=90%, E-value=2e-24, Identity=31%"; Hit description =Putative uncharacterized protein
  Pfam annotation: Domain name=MFMR; Domain location=1-159; Score= -70.9; E_value=0.048; Accession=PF07777.2; Description=G-box binding protein MFMR
  Pfam annotation: Domain name=bZIP_1; Domain location=256-319; Score =53.3; E_value=8.4e-13; Accession=PF00170.12; Description=bZIP transcription factor
  Pfam annotation: Domain name=bZIP_2; Domain location=256-310; Score =28.9; E_value=1.8e-05; Accession=PF07716.6; Description=Basic region leucine zipper
  Pfam module annotation: Pfam domain module=MFMR::bZIP_1::bZIP_2; Domain location=1-159::256-319::256-310
MGTQKSNMFDAPFKYMVPEDKEIPDRPLPSHWTPSMQAYNTSGSTPTPFLNQQAAGSHMPLYMWVNQVNNTLLQSDALHDPRMLSSKPTVAGDAVLAFSEIVHRTFGEQNLNSIKKCARNLQPKSLITKESTENGSKSSIMKTNRDGVLCSEANGNKGSPDEDHITNDFPSTKKQHCNLMLENGDVGQNTSPHTQHNKGAGGCNEDSPKRLQLRQFSNTNNLPSHHSAASSTKLNQDLETGLDASDANAQLVNLEKDEIRRERKRQSNRESARRSRMRKEKECEELHKQMEMLKDENSVLTQRLKSLSEECLEICNENDAIEVRH

SEQ ID NO: 135865 - protein, 212 aa, Glycine max
  Coding DNA Sequence Number=SeqID_44180
  Homolog annotation: Hit_ID=A5AG09; Match level="QueryCoverage=40%, HitCoverage=8%, E-value=5e-07, Identity=29%"; Hit description =Putative uncharacterized protein
MDPISIKLDDDNYSAWKAEALGKIKESSLEKFITMKDFGGQPPMLSEEYKSWIEQDQVLYTWLLDSLHPKLLHRIERCECALEFWKVIEVETLVLEGRPRPLLPLSLDWGACSGNRKVPHHLRVEEGLESLLADSSPSLDWVACSGSRKLEIEEIRQQYKRNLEETAMVQLMRMNLDAECPETSNEDMAIEEELGPESAAADILLSLKPGTS

SEQ ID NO: 135866 - protein, 1501 aa, Glycine max
  Coding DNA Sequence Number=SeqID_44181
  Gene Ontology: Mol. function=cAMP-dependent protein kinase regulator activity; Cellular component=intermediate filament; Biological process=intracellular signaling cascade
  Homolog annotation: Hit_ID=A7QPI8; Match level="QueryCoverage=45%, HitCoverage=98%, E-value=1e-105, Identity=47%"; Hit description =Chromosome chr18 scaffold_137, whole genome shotgun sequence
  Pfam annotation: Domain name=S-antigen; Domain location=598-838; Score=-255.4; E_value=0.057; Accession=PF05756.2; Description=S -antigen protein
MTEEQVVNVRGEVSDSVTDHRSVKANGVAHGVGGDLDLAADNNGAALSEKICKDAVSNGTAEEVSETAMVNVVSRDDELKCADGQNDTGSVQNGVVENDDKSANAVAEELVTDHDEYVVVGDSDVQNGDDVNANANGVEECEMLDGAEGSGDENGVVVSAVEGDADVNHSDREFECVDVHNDVAVETVEEEVTATTDQNVGNGNDVQGRSESVSDEDVDKSGESVNVVSADVLDEKDIVTDGDHDAEEVLEKNEILVDADGVSATTDLKQCEPEDARNSSEKGQVESVSGLAKPEPSECTEENEIAVEGEPGSKLERSEEEAGSEIVPQGENLTALNSTDVTGDGDVVSDIAVESKDEPSVDVCELKSIAVENDVDVQELKNGAVQSEIVSEMKNNTEESVAEPSNGAVESEAEPSNGAVESEADPSNGAVEWETEHSNGAVERETEHSNGAVESVAEPSNGAVESVAEPSNSAVDREDEPSNGAVDKEAEPSNGAVDKEAEPSNGAVDKEAEPSNGTVEREAEPSNGAVQSEAEPSNGAVGSVAEPSNGAVGSVAEPSNVAVESETDPSNGALESETDPSNGAVESEAEPSNGAVESVAELSNGAIESVAKLSNSAVDSEAEPSNGAVDSEAEPSNGAVDKEAEPSKGTVESEAGPSNGAVESEAEPSNGAVESEAEPSNGAVRCVAEPSNGAVESEAEPSNGAVAREAKPSNGAVESEAEPSQGAVDSEAEPSNGAVESEVKPSQGAVESEAEPSQDAVESEAELSNGAVNREAETASGAVESEAKTSSGAVETEVKPSHGVVESEAKPSNGVAESESEPSVDVCETKNDVVNSEAETSSGALQSEREACVVSEMKNNAVESEAQPSVDVSEKKTNAVDSEAELSVKGGLSVESEGSNQGDEDSRPASDALDGQNVGTEVVKKPFYYLIRVPRYDDDENIKEKIKNALHQVEEKTKIRDAIRIESQTIKASCKDFDQEFRAAIAAHRAARDLLKSKRQEIDSVQSTMNRLNNAISVGDIDDKIRSMEHMIQHETLPLNKEKQLIREIKQLKQNREELSSNMKKQDQSQQSVDNKDDNIEEHFKHLQLLKKEMEVLRNNVLKSDTETKAAKKKYNDECDKLNELLARFRAADDSRQEAYAKLLALKKQLHEKSKNFWEYRDAANKAQELAAGGKKEELQCFCVDQVERIMELWNKNDGFRRDYVRCNTRSTLRRLQTLDGRSLGPDEEPPVIPNVITERASKNIPMVLQSTLEQEKKSTPTESVNVKDEPVSKVVVQRTETSQTTKAKKPTKPAPLEKHVARWGDESDEDEVKKEEPVRTKEEEELILKAEKARMEEEEAKLKEKRRLEEIEKAKEALLRKKRNAEKAQQRAALKAQKEAELKEKEREKRAKKKERRKAGSAVTAENTEQESAPIPETLTRSVEEFEQTEKTAEVTKKPQKTSQFTRQTKVKSVPAALRNRGKRRIQPWVCVLIALVVAVALFYVGHNCSLRSSLEGFGY

SEQ ID NO: 135867 - protein, 120 aa, Glycine max
  Coding DNA Sequence Number=SeqID_44182
  Subcellular localization annotation: CTP_CleavageSite=44; ConfidenceScore=5.30e-01
IKCYGVKEPISAQGENYDQNRQFCSPCPPPKTSSLLCSTTSVLSLATTRHWLLRSSTSNFLRVLLVSLTHFIAMVVSIMNYHRCALHLSAPFTIAEEEEEETPLQTLFGFGFEACGKKTG

SEQ ID NO: 135868 - protein, 132 aa, Glycine max
  Coding DNA Sequence Number=SeqID_44183
MKEGCFGKEKRGRGRWKLGGIGRWERRRRRNVTSKRGRRSSAQVIVETTSFQFETILILEITISFLSRSRSTPPLRSPTSPSFLLLTISLSVSHSLTFYTVARQRPTYLSFLPLVMALCYCHLLCCHLQSRS

SEQ ID NO: 135869 - protein, 359 aa, Glycine max
  Coding DNA Sequence Number=SeqID_44184
  Gene Ontology: Mol. function=two-component response regulator activity; Cellular component=intracellular; Biological process=two -component signal transduction system (phosphorelay)
  Homolog annotation: Hit_ID=Q1LCE1; Match level="QueryCoverage=55%, HitCoverage=90%, E-value=2e-52, Identity=55%"; Hit description=Two component transcriptional regulator, winged helix family
  Pfam annotation: Domain name=Response_reg; Domain location=1-103; Score=70.0; E_value=8e-18; Accession=PF00072.15; Description =Response regulator receiver domain
  Pfam annotation: Domain name=Trans_reg_C; Domain location=135-203; Score=51.0; E_value=4.1e-12; Accession=PF00486.19; Description =Transcriptional regulatory protein, C t
  Pfam module annotation: Pfam domain module=Response_reg::Trans_reg_C; Domain location=1-103::135-203
MIGANLQQALEAAGWSVDWVRDGVFASNAWQEGGYTCVLLDLGLPREDGINVLRRARTRGDMTPVLVLTARDTVQQRIQGLDSGADDYLLKPFDLQEVLARMRAITRRRHGAADSLLGNGDVQLDMMTREVLYKGQREQLTAREYALLYALLERPGAILSREQLENRIYGWGEEVTSNAVDVLIHGMRRKLDNEVIRNILYVYAVAAQQTAGHAGAAASGDDRRCHLDDQLAKIADAWSSSQRMPALMPMVMQQEKLKSAAQRRLHEEPDGETRTLRHHSAHPDDAAVAAGDLAGGAGHYARSARGLAPDCGAGNPASAQRVAGRSAGRSAAAAGSGRHAHAPSGDAVAEYLTTGGSVR

SEQ ID NO: 135870 - protein, 1006 aa, Glycine max
  Coding DNA Sequence Number=SeqID_44185
  Gene Ontology: Mol. function=quinoprotein glucose dehydrogenase activity; Cellular component=outer membrane-bounded periplasmic space; Biological process=electron transport
  Homolog annotation: Hit_ID=A0FP69; Match level="QueryCoverage=78%, HitCoverage=98%, E-value=0.0, Identity=71%"; Hit description=Pyrrolo- quinoline quinone
  Pfam annotation: Domain name=PQQ; Domain location=393-430; Score =40.4; E_value=6.5e-09; Accession=PF01011.12; Description=PQQ enzyme repeat
  Pfam annotation: Domain name=PQQ; Domain location=457-494; Score =20.8; E_value=0.0052; Accession=PF01011.12; Description=PQQ enzyme repeat
  Pfam annotation: Domain name=PQQ; Domain location=522-560; Score =29.6; E_value=1.1e-05; Accession=PF01011.12; Description=PQQ enzyme repeat
  Pfam annotation: Domain name=PQQ; Domain location=600-638; Score =28.1; E_value=3.2e-05; Accession=PF01011.12; Description=PQQ enzyme repeat
  Pfam annotation: Domain name=PQQ; Domain location=656-693; Score =24.8; E_value=0.00032; Accession=PF01011.12; Description=PQQ enzyme repeat
  Pfam annotation: Domain name=PQQ; Domain location=831-869; Score =29.1; E_value=1.6e-05; Accession=PF01011.12; Description=PQQ enzyme repeat
  Pfam annotation: Domain name=PQQ; Domain location=888-926; Score =41.9; E_value=2.3e-09; Accession=PF01011.12; Description=PQQ enzyme repeat
  Pfam module annotation: Pfam domain module=PQQ::PQQ::PQQ::PQQ::PQQ::PQ Q::PQQ; Domain location=393-430::457-494::522-560::600-638::656 -693::831-869::888-926
MENNSYHPYVTERVCRFDGTPIGACYSASLMHCVPERDALLHEGEIITQHYQSADAAGLIIIPLAGNSVMSFLHDVDNYSSLQHENVRLAINYATLRQAGSALRAVASRFSFWLYDLAPPGTEWKNITDFPFSGIVLSDDFFRENYLKFSFPFLLASLRETQAEVNIMGKASSSFGVIRFLTVLFALLTGAFMLIGGVWLAAIGGSWYYVIGGVIMLITAVLLWRRSGSALLLYALLLLATLVWGVWEVGFDFWALAPRTDVLVIFGIWLILPFVYRGLNHAGKGALGAMAVALVASVLVLAWAVFHDPQELNGNLPEAANVPQAQPLSNINDADWPAYARDQQGTRFSPLKQINTSNVKELQVAWQFQTGDLKTANDPGEITDEVTPIKIRDTLYLCSPHQILFALDATTGKQKWKFDPGLKPNPTFQHVTCRGVSYHEVPAAADAANSQPALCSRRIYLPVNDGRLFALDADTGARCPSFGNNGELDLQHKQPVQTPGQYEPTSPPVITDTTIVIAGAVTDNYSTREPSGAIRGFDVNTGKLLWVFDPGAKDPNAIPADEHTFTMNSPNSWAPAVYDPKLDTVYLPMGVSTPDIWGGNRTPEQERYASSVLALNATTGKLVWSYQTVHHDLWDMDLPSQPTLADITDKDGNTVPVIYAPAKTGNIFVLDRRTGKPVVPAPETPVPQGAAKGDHVAPTQPYSELTFRPKQNLTDKDMWGATMYDQLVCRVIFKRLRYEGPFTPPSEQGTLVFPGNLGMFEWGGIAVDPHRQIAIANPMALPFVSKLIPRGPGNPIEPPQGAEGGSGTETGIQPQYGVPFGVELNPFLSPFGLPCKQPAWGYVSAIDLKTNETVWKKRIGTVRDSAPVPLPFKMGMPMLGGPITTAGNVFFIGATADNYLRAFDTNTGEMLWQARLPAGGQATPMTYEVNGKQYVVIAAGGHGSFGTKLGDYVIAYALPDANTRAFNSAHSAIITQVARNTGRIPNAPPIKPPNSGPLTWPTYWAE

SEQ ID NO: 135871 - protein, 356 aa, Glycine max
  Coding DNA Sequence Number=SeqID_44186
  Gene Ontology: Mol. function=lipopolysaccharide 3-alpha -galactosyltransferase activity; Biological process=lipopolysaccharide biosynthetic process
  Homolog annotation: Hit_ID=Q9ZIS5; Match level="QueryCoverage=82%, HitCoverage=88%, E-value=7e-32, Identity=28%"; Hit description=UDP -glucose:(Glucosyl) LPS alpha1,3-glucosyltransferase WaaO
  Pfam annotation: Domain name=Glyco_transf_8; Domain location=56-296; Score=164.4; E_value=3.1e-46; Accession=PF01501.11; Description =Glycosyl transferase family 8
  Pfam annotation: Domain name=Glyco_transf_8N; Domain location=300 -354; Score=-1.1; E_value=0.012; Accession=PF08437.1; Description =Glycosyl transferase family 8 C-termi
  Pfam module annotation: Pfam domain module=Glyco_transf_8::Glyco _transf_8N; Domain location=56-296::300-354
MGEADYVSSAKTPGLSCYAFFGFTKMRSAAEKRAMNHDVLQEINAEPLFPVQSDQHIVFGVDGKFKAHALITILSIMKHAGDRVYHFHLISSELTPADNPRLARLFQGSRHGVTLHHLPDQLFATLPVTELFTRATYYRFLAPLILPQAEKLLYLDADMVCINPLNELWQIPTGPEAVALVVGEIASLQPVLAKNAGLRGERYFNAGMMLIDVAQWRADNISERAFTLLSEHGRNFQYLDQDALNILLEDKVTFISPRFNTLTMLAHDDHGYTLDVPAETCLIHYAGADKPWQVWNQQFVVHHYRDIYQDSPLSTMAFDQPANAQQAKRMYKSLFRQKRWWQAMLWRLKHIKMRYC

SEQ ID NO: 135872 - protein, 280 aa, Glycine max
  Coding DNA Sequence Number=SeqID_44187
  Homolog annotation: Hit_ID=A8AJQ2; Match level="QueryCoverage=80%, HitCoverage=60%, E-value=2e-80, Identity=64%"; Hit description =Putative uncharacterized protein
MTASPDGSVLYITNTLDGGVTKVDARSGKVLQRLLFGLKNDKGNPIGAREILLHDGLLYIGAIENPAMIWVVDANTLRLKTTIKNAGKWVTGLLYSASTDRIYAANGSGEVLVINPRTHKIEQRWTPGDGKEYLLLNLAEDAANGRLYVTDNSKGKTTLVFDERSGKVIKRLDVGDSLGIKFNAKRNEIYISQRLGGKVLQLDATTYAVKNSWTLPTHPNSLLVGSIKIARRKGRIAWCGLRWINRDGFNRGARDRAADNPCLATGYVIHYATPFTSSTR

SEQ ID NO: 135873 - protein, 145 aa, Glycine max
  Coding DNA Sequence Number=SeqID_44188
  Subcellular localization annotation: CTP_CleavageSite=44; ConfidenceScore=5.76e-01
MASPPASPPPPPPSPLSDASTSSSVVKRTRKASRLRSLCTRPPSAERLVVDVTYENMKEDGVDDIVCEKYGISKEKWAQFCQTRRDPSWEAIQKQNTAPHVLSRGGYEYLKQKLLAEKTKKKLKEAAQSGSVDGVIDSPSPVRRH

SEQ ID NO: 135874 - protein, 259 aa, Glycine max
  Coding DNA Sequence Number=SeqID_44189
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIGDERVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135875 - protein, 150 aa, Glycine max
  Coding DNA Sequence Number=SeqID_44190
  Subcellular localization annotation: CTP_CleavageSite=94; ConfidenceScore=5.06e-01
APVAIMVSISCPSCSATDGVVPLTIRHTSIPSRNISGKCSRGADAELTHTPVNAAAQGALSHSKPALRADVCNWRLLCWALMQGDSYVREFLALSSLRSVVDCGEREQWIPTTGRNSIGNAEIPLGNDLELALAKPFFHRLRPPDKHHEI

SEQ ID NO: 135876 - protein, 158 aa, Glycine max
  Coding DNA Sequence Number=SeqID_44191
  Subcellular localization annotation: CTP_CleavageSite=60; ConfidenceScore=5.11e-01
MHALTSRGLHVLALRGLHALTLGTSYPHRQRTTRPRLERTTRPHHQRAARPHLQRTISPRLERATRPHLGGTTRPRRQRVMCLHLCRATCPHLREDYTSSPLRGLHVLAIRGLHCSTIFKGGHALTFRGLHAFTIRGLHVLALRGPHALTLGTSYPHC

SEQ ID NO: 135877 - protein, 142 aa, Glycine max
  Coding DNA Sequence Number=SeqID_44192
MTLPVVWSPRCTYQVLHQRQAQGDAPQAAGTPPPPHQASPAGSFDMEQYLRHLVRQQVANHRAHVQTHDCLYQLSLSMQSQGFASFSCPTPDQFRAEVAWPGDWPEAQAGEAPPEAPGDGEEAHEDEEMTDLLDFLGGSGAT

SEQ ID NO: 135878 - protein, 110 aa, Glycine max
  Coding DNA Sequence Number=SeqID_44193
MSGFTRNSPQISASPHQLDLAPYASEPYHAQWNAPGLLHDKHTLHLSHILGEMEVDEPWLGLWLPLNYQVDMGASQHMTTEFGVVFVIGSAVDRPCGDLGMAFVDNWVVG

SEQ ID NO: 135879 - protein, 111 aa, Glycine max
  Coding DNA Sequence Number=SeqID_44194
  Homolog annotation: Hit_ID=A5AZI7; Match level="QueryCoverage=56%, HitCoverage=13%, E-value=5e-12, Identity=59%"; Hit description =Putative uncharacterized protein
MADILRMNKHLVLLQSFFKNMRLLPSTLCLVLQIRMVWQKEGIEHYWTWIVESRNAKFLENDLINESDQLRDLGFEIDCIKSQPFTSSERLFVIHTPQVQRDDEQHMIDIP

SEQ ID NO: 135880 - protein, 175 aa, Glycine max
  Coding DNA Sequence Number=SeqID_44195
MDSIVSGWQKGVRITISCLRMSSGSPPLDDKRCRMTIICLCVPLDSIVSGWQKDVRITIICLRMSSGSPPLVEKGCNCDNNLSLRAIGLNRLWMAKSCADYHNLSPHVIGARRLWMTKGAETIMLAAIDHLWMAKRCADYHNLSPHVIGLAALDDKRCRSDHNLSPHAIGLAACG

SEQ ID NO: 135881 - protein, 222 aa, Glycine max
  Coding DNA Sequence Number=SeqID_44196
MGDQEETQEQMKADMSALKEQMASMMEAMLSMKQLIEKNAATAAAVSSAAEADPTLLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAAPPIVLSTEGPPPATEERRKLDLLEERLRAVEGFGDYPFADMTDLCLVPDVVIPSKFKVPDFD

SEQ ID NO: 135882 - protein, 91 aa, Glycine max
  Coding DNA Sequence Number=SeqID_44197
MLLVEVLDTTFPTSMQWHSRFWDSGQIEKSFASQALQGKVVEEPQLLAVSGAVAVVADGLVEERIVCLGQQHSKNKVVVVVVAAVVKDSTI

SEQ ID NO: 135883 - protein, 63 aa, Glycine max
  Coding DNA Sequence Number=SeqID_44198
MDNIRFTAPFRVQKLLLQVPFTYHRQWLRNYPKYVLFHYDGEIHFIRKGTQPPRKHDSTFGRR

SEQ ID NO: 135884 - protein, 76 aa, Glycine max
  Coding DNA Sequence Number=SeqID_44199
MHNSSFFQILPCAQPRSVALSGWLAKPEDWLSERVFIHKSLGRIHRLTNSPKFTVLLVLKQRIEQLTGSPSNNNIQ

SEQ ID NO: 135885 - protein, 66 aa, Glycine max
  Coding DNA Sequence Number=SeqID_44200
  Gene Ontology: Mol. function=aspartic-type endopeptidase activity; Biological process=DNA integration
  Homolog annotation: Hit_ID=A5C737; Match level="QueryCoverage=100%, HitCoverage=15%, E-value=1e-18, Identity=54%"; Hit description =Putative uncharacterized protein
MKKKCPKYATWRVKKDTWWVDFGATTHLSVTMSGCLWSQLPSGDERFIFVGDGKKVAVEAIGAFRL

SEQ ID NO: 135886 - protein, 125 aa, Glycine max
  Coding DNA Sequence Number=SeqID_44201
MQMTTLVSACPSGLGSPNDGVRITGRCLCMLPDSWVMIAKGGAVDKSEAVAPTYPQFVMRNSDLCLGSPNDGVRITGRCLHMLPDSWVMIAKDGAVDKSEAFAPTYPQFVMRNSDLRSSFFVRLK

SEQ ID NO: 135887 - protein, 143 aa, Glycine max
  Coding DNA Sequence Number=SeqID_44202
MATQLIHDCVVMECLEGVWETLEGNKRCRFCGMIRLLATSLVHPEEPARTLQQPVEWILPTPTPYRLVEPVQVIEVSSSEEDPEEDQEELPPEPAVDDLDLPEDDEDPLSDVDSPEDIMSASKADSTEEIGPGGTTNSEDSSS

SEQ ID NO: 135888 - protein, 138 aa, Glycine max
  Coding DNA Sequence Number=SeqID_44203
  Gene Ontology: Mol. function=transcription factor activity; Cellular component=intracellular; Biological process=regulation of transcription, DNA-dependent
  Homolog annotation: Hit_ID=A8GKV5; Match level="QueryCoverage=89%, HitCoverage=36%, E-value=1e-60, Identity=95%"; Hit description =Transcriptional regulator, LacI family
  Pfam annotation: Domain name=HTH_3; Domain location=8-62; Score=15.7; E_value=0.088; Accession=PF01381.13; Description=Helix-turn-helix
  Pfam annotation: Domain name=LacI; Domain location=18-43; Score=37.5; E_value=5e-08; Accession=PF00356.12; Description=Bacterial regulatory proteins, lacI fa
  Pfam module annotation: Pfam domain module=HTH_3::LacI; Domain location=8-62::18-43
MTAHSRLVSSLIMKKKRPVLQDVADKVGVTKMTVSRYLRNPDQVSAALQQKIAVALDELGYIPNRAPDILSNATSRAIGVLLPSLTNQVFAEVLRGIESVTDAHNYQTMLAHYGYLPEREEERLDLAAFLQYRRPDPV

SEQ ID NO: 135889 - protein, 224 aa, Glycine max
  Coding DNA Sequence Number=SeqID_44204
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=100%, HitCoverage=49%, E-value=1e-109, Identity=86%"; Hit description=ATP synthase subunit alpha
  Pfam annotation: Domain name=ATP-synt_ab; Domain location=123-224; Score=-3.3; E_value=8.7e-08; Accession=PF00006.16; Description=ATP synthase alphabeta family, nucleotide-binding domain
MVTIRADEISKIIRERIEQYNTEVKIVNTGTVLQVGDGIARIYGLDEVMAGELVEFEEEGSSVKATGRIAQIPVSEAYLGRVINALAKPIDGRGEISASESRLIESPAPGIISRRSVYEPLQTGLIAIDSMIPIGRGQRELIIGDRQTGKTAVATDTILNQQGQNVICVYVAIGQKASSVAQVVNTLQERGAMEYTIVVAETADSPATLQYLAPYTGAALAEYF

SEQ ID NO: 135890 - protein, 101 aa, Glycine max
  Coding DNA Sequence Number=SeqID_44205
  Homolog annotation: Hit_ID=Q8S603; Match level="QueryCoverage=80%, HitCoverage=12%, E-value=3e-09, Identity=38%"; Hit description =Putative transposon
MTIFAHPSKVLDPVKFDELEIEAAIILCQLEMYIVEEAIEFCSKYIEKAKPIGLPESRHDERVGSKGSRGLHVITPTIEDLQQAHLYVLPKFCHTYFGMKV

SEQ ID NO: 135891 - protein, 78 aa, Glycine max
  Coding DNA Sequence Number=SeqID_44206
MVKVGDLTCRSTSHFRQKLAQGEGGPHVNRVWHRDQAYFEYPSTSGCVRFPVGKPVVPLLRIGQRAGDRGGLCYYARR

SEQ ID NO: 135892 - protein, 188 aa, Glycine max; identical to SEQ ID NO: 101403
  Coding DNA Sequence Number=SeqID_44207

SEQ ID NO: 135893 - protein, 69 aa, Glycine max
  Coding DNA Sequence Number=SeqID_44208
QGIKENSPNKKIEEAKEHHLDEDALIPHDVAPCGACRPWIFFINGFLCFMRSDCSGMEKEKDEWRCHFN

SEQ ID NO: 135894 - protein, 45 aa, Glycine max; identical to SEQ ID NO: 130407
  Coding DNA Sequence Number=SeqID_44209

SEQ ID NO: 135895 - protein, 93 aa, Glycine max
  Coding DNA Sequence Number=SeqID_44210
MEAMKDQMTTMVEAMMSMRKMMEVNAATVVATSIATEVDPTHPSSLDQVPQPIGETHEVPRGHSLADFEPYLRYATEGQTFGGIPLPNTLGAP

SEQ ID NO: 135896 - protein, 60 aa, Glycine max
  Coding DNA Sequence Number=SeqID_44211
  Homolog annotation: Hit_ID=A0ST23; Match level="QueryCoverage=45%, HitCoverage=55%, E-value=2e-08, Identity=100%"; Hit description =Putative reverse transcriptase
MVDFCLFYIKLIDTVDLEGGPVGKPVVPAALMNRPTRGERRFAYWALAECILAYYVGTDE

SEQ ID NO: 135897 - protein, 62 aa, Glycine max
  Coding DNA Sequence Number=SeqID_44212
MSQLVDGITKVTTNKWMDITDMGHVIASRYNAKPWPNPYISRMQHFKSFVMFKRDYVDINDD

SEQ ID NO: 135898 - protein, 153 aa, Glycine max
  Coding DNA Sequence Number=SeqID_44213
MAPTRHPLDPDKSNRALGFPALITGLCQSFGVPVTPSKVIRPPITRAFIEKYCTQRQVQGDAPQAADAPPPHQAGPAGLFDTEQYLRHLVRQQAANHRAQFRAEVAWPGDWPEAQAGEAPAGAPAEAPDEADEAREDEEMTDLLDFLGGNGAT

SEQ ID NO: 135899 - protein, 49 aa, Glycine max
  Coding DNA Sequence Number=SeqID_44214
MKLGGRRRYPSGYPYKHFFAICQTQSSGQANPLTRGDLRRLLHLCHPDP

SEQ ID NO: 135900 - protein, 90 aa, Glycine max
  Coding DNA Sequence Number=SeqID_44215
  Homolog annotation: Hit_ID=A5AIZ8; Match level="QueryCoverage=48%, HitCoverage=5%, E-value=2e-14, Identity=79%"; Hit description =Putative uncharacterized protein
MAKGKILVKIQSSVTLIQLACGADSATVAITTTDLVSKSVAIESLGQGYSLHADIQYLDARWEVLVVLPLRDCFAQDINMLCHLDGFVVL

SEQ ID NO: 135901 - protein, 174 aa, Glycine max
  Coding DNA Sequence Number=SeqID_44216
MTQELVARGDTLRLSAPRHSVTPSVIDEQRPMWSSTPFPEMSAFSDGDFSSLTSYLELRRGGGPDDTRRYLTVIRTLVSSRGGGPMTSRDKIWSFSCIQAAGPMIRGDTLRLSAPFCHPEAAGPMTSRDKIWSFCTLVSSRGGGPDDTRKYPSGYPYKHSFAICKTERLIACRG

SEQ ID NO: 135902 - protein, 95 aa, Glycine max
  Coding DNA Sequence Number=SeqID_44217
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=28%, E-value=2e-10, Identity=100%"; Hit description=LacZ protein
HPPFASWRNSEEARTDRPSQQLRSLNGEWDAPCSGALSAAGVVVTRSGTATLASADVRRGFCRYAPPPSVAEQEGQLIETEATGAPQKHHHTLNQ

SEQ ID NO: 135903 - protein, 148 aa, Glycine max
  Coding DNA Sequence Number=SeqID_44218
TAHEHRIADDYAQVYAEKEARGRVIDSLHQEATMWMDQFALTLNGSQELPRLLAKPRSKSRTMGDQEETQEQMKADMSALKEQMASMMEAMLGMRQRMEKNAATAAAVSLAAEANPTLFATVHHPPLNIVGRGRDTLGHDGNPHLGYN

SEQ ID NO: 135904 - protein, 148 aa, Glycine max
  Coding DNA Sequence Number=SeqID_44219
MVKEECQDTLVSIATPLGLEFIPQVKELLNEGLVRKSLNPCALLVPKIGIISHQIPKIGCMINVLSGATLFCKITHAPNIFMICVHRDSLGSDQGVPMNPKRIKVIPEWPTPPSVEKKSPEFQEPRDLRSNPFQGGGNDAILPHKSIG

SEQ ID NO: 135905 - protein, 66 aa, Glycine max
  Coding DNA Sequence Number=SeqID_44220
VVDSNDKGSINLRTNPLQEGGDDAILPKRGPITRSIARRLQEDWVRDAGEGSRVLMSLKVDFGPMS

SEQ ID NO: 135906 - protein, 283 aa, Glycine max
  Coding DNA Sequence Number=SeqID_44221
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDLQIVYGLKSGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135907 - protein, 187 aa, Glycine max
  Coding DNA Sequence Number=SeqID_44222
VYGIKMVIDQSLFYDLTRLSSEGVPFEGTLDDDWKFDFSMHDARRLVCTNQADMTGRLLAGSLALESRILHYLTPKIFKPCTVTFFLQHFNIPFDSEPYVLIKRSFLIDAAVVASFGYRKERDGSWVKNGAQPNDDEGQLLVEVDSSLLQSILDRFNGLQTYVGERFDALERQVDTRFDEMDSRITK

SEQ ID NO: 135908 - protein, 152 aa, Glycine max
  Coding DNA Sequence Number=SeqID_44223
  Homolog annotation: Hit_ID=Q84VI1; Match level="QueryCoverage=75%, HitCoverage=26%, E-value=4e-30, Identity=49%"; Hit description =Envelope-like protein
  Subcellular localization annotation: CTP_CleavageSite=86; ConfidenceScore=5.02e-01
KLSAGKLSVKYAILHRIGAANWVPTNHTSTVATESFAIKLPIAFPTGHMSQTLSRPPPPTSGKAAASGAVSKDALIAELKDTCKVLEATIKATTEKKMELELLIKRLSESGIDDKEAAEEEGEAAEEEEEAAEEEEDATEETESDDDSEATP

SEQ ID NO: 135909 - protein, 167 aa, Glycine max
  Coding DNA Sequence Number=SeqID_44224
MTDRLLAGSLTFDNRIMHYIIVRILLPRSSNLAQASEEDLILMWAFLTGHQIDWAHLIPLDDEPFVQVKQSFSIGAGVVTSFGYRKDVDGQWIHKQDLPPPIPDEHTPSPPPQRVDSSSLLTEVFIELRGLRAFVGEQFDAMDTRLNAMDARFDGMDTRGSLVSKMI

SEQ ID NO: 135910 - protein, 100 aa, Glycine max
  Coding DNA Sequence Number=SeqID_44225
  Homolog annotation: Hit_ID=A5AIZ8; Match level="QueryCoverage=62%, HitCoverage=8%, E-value=3e-16, Identity=64%"; Hit description =Putative uncharacterized protein
MTQKRKKRSGGGLAEFAVAKKNILINAALGGVGSMGNVGSCTKINRPVDIITVVGGQGYSLPADTEYLDARWEVHVMLPLRDCFAQEINMLCRLDGFTLL

SEQ ID NO: 135911 - protein, 126 aa, Glycine max
  Coding DNA Sequence Number=SeqID_44226
MGEVEEIQEKMKADMEAIKEKMATMMEAMMSVKKIMEANAVAIAATSVVAKAHISQTIGETHEIPHHNLADFEPWLGYATEGQAVGGIPFENPLEGPQYHPQLHLLHSTAVKNPHDYGRNGKVGII

SEQ ID NO: 135912 - protein, 99 aa, Glycine max
  Coding DNA Sequence Number=SeqID_44227
MGANAVALAATRAVAKVNPMPPSDLNQMNHPTSDMGPQYHPQLHLLHSTTSKNPHAMEELGKLDHLEERLRATEGGEDYTFANLDELFLVPNIITPPKF

SEQ ID NO: 135913 - protein, 209 aa, Glycine max
  Coding DNA Sequence Number=SeqID_44228
MDMNLGYLISHQISLTAQHDTSRLVFPTLITALCKARGKNCWNLDDPTVTFRGPRKDRGKRSEVPTTSAPPETTAPSSSTTPMLHSMLQSLHRGQSIIMQSLQGLGLPSIMSMDDFDAQEPKPEEPAAEGEDELTPPEPFYFDVGVHMAQEEETSTDHILESSLTPIPNDAIPSAPASELEQPISQDSPAAQVLVLNEHAQEQPQEQDI

SEQ ID NO: 135914 - protein, 67 aa, Glycine max
  Coding DNA Sequence Number=SeqID_44229
MVEVSTKAIASLAQYYDQPLRCFTFGDFQLSPMVEEFEEILGCPLGGRRPYRLKTRKKGGACRPEAS

SEQ ID NO: 135915 - protein, 37 aa, Glycine max
  Coding DNA Sequence Number=SeqID_44230
  Homolog annotation: Hit_ID=A5AKU4; Match level="QueryCoverage=94%, HitCoverage=7%, E-value=2e-08, Identity=80%"; Hit description =Putative uncharacterized protein
MAGGAISWRSVKQTLTAISTMKAELVSYFEATSHGAH

SEQ ID NO: 135916 - protein, 218 aa, Glycine max
  Coding DNA Sequence Number=SeqID_44231
MAKFDPDMVLEFYANAWPTEEGVRDMRSWEGQECDFSQRRNRADGFDEEAIAQLLCISGQDFARTAAGRRVRIMRTSMTTLTQMWMTLLLSNVLPSDHNSDLPLPKCQLVYAILTRMSVHVAQLIVDAIYLFAGMPPTRHPLDPDKSNTALGFPVLITSLCQSFGEPVTPSKVIQPPITRAFIEKYCTPRQAQGDAPQATDAPPPPHQADPAGSFGMQ

SEQ ID NO: 135917 - protein, 270 aa, Glycine max
  Coding DNA Sequence Number=SeqID_44232
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSGGLDTHQARIQCILDVAFQDAVLDQDIRLRGAAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135918 - protein, 71 aa, Glycine max
  Coding DNA Sequence Number=SeqID_44233
MGGMDECMRKYDTDAIYEYGSPRNCFLVGYNVPTYVFKKVTRTLRRFAKVRGSKTKPTHDAYAKGTTRGCT

SEQ ID NO: 135919 - protein, 195 aa, Glycine max
  Coding DNA Sequence Number=SeqID_44234
  Homolog annotation: Hit_ID=A0ST23; Match level="QueryCoverage=12%, HitCoverage=51%, E-value=5e-07, Identity=100%"; Hit description =Putative reverse transcriptase
  Subcellular localization annotation: CTP_CleavageSite=42; ConfidenceScore=5.14e-01
WNSYVPINVSFSPKVGPGLPAVPPVQLLTGWCVTAKAPPDISAGKCSGRVPFAIQAAQLLGRAIGAGLFAITPAGERGMCCKAIKLGNARVFPGPRMVRDVFRLDQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 135920 - protein, 67 aa, Glycine max
  Coding DNA Sequence Number=SeqID_44235
MKHGSKLFGGGCMNEIAIHRAPKKGREWRIALSNHYAWLQTRCMNENGIHGGSEKGERMEDCTRDPH

SEQ ID NO: 135921 - protein, 59 aa, Glycine max
  Coding DNA Sequence Number=SeqID_44236
MCAQEMAPKKLSVKRSRRDAAAEGTSAALEFDSHRFRSAEHQQHFEAIKGWSFHKERPV

SEQ ID NO: 135922 - protein, 120 aa, Glycine max
  Coding DNA Sequence Number=SeqID_44237
  Subcellular localization annotation: CTP_CleavageSite=44; ConfidenceScore=5.28e-01
MMEAMMSMKKIMEANAVTIVATSTVAKVNPMPPSGLNQMNHPTLAMPMWRTLPMRMSITPLLYSLRANNLNLIMHMSLDPWGEAHKIPHHNLADFKPCLRYATEGQAVGDISLQNTLEGP

SEQ ID NO: 135923 - protein, 91 aa, Glycine max
  Coding DNA Sequence Number=SeqID_44238
MHPIDSSNTVMYRKRGLPVTGGMSTGGFTRLCLIFSKASWQSLFHRKPHDVIQPAQETSNLLLRAWLWHFKNGLHFLGIYLYPFLAHDKSQ

SEQ ID NO: 135924 - protein, 93 aa, Glycine max
  Coding DNA Sequence Number=SeqID_44239
MTPVNRKAGTGERTREPPGGNAGIFIVLSGFATTDLSVRFRDACQGGGASWKNSWNYAATPSHLDRIPGFPGNPPTSSRAVPHHRRWSSQFAL

SEQ ID NO: 135925 - protein, 233 aa, Glycine max
  Coding DNA Sequence Number=SeqID_44240
  Homolog annotation: Hit_ID=A1IW39; Match level="QueryCoverage=29%, HitCoverage=98%, E-value=4e-17, Identity=69%"; Hit description =Putative uncharacterized protein ophh-69
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNNGYLYPKPTQVGVAVTRPGRLFTKNTGLRKVVRPCMGADACPVPEGEPTTEAPVNGGRNYNGPKVAKFLVGLGEIDMSVKMRTTCTWTERPYEASLFPGIGFGLFLRSLGGGQRRPPSGGARAI

SEQ ID NO: 135926 - protein, 114 aa, Glycine max
  Coding DNA Sequence Number=SeqID_44241
MEIWIRWLRPRLDTTIENRPRINTSVLYENGRYCAKNSAQAQDHRAVGGVRHQRAAAGAQLEQAQVNQRQAHAGDQTGQNGVAGQQTGVFHAARARRVDDNDAEYQRAQRIHGQ

SEQ ID NO: 135927 - protein, 45 aa, Glycine max
  Coding DNA Sequence Number=SeqID_44242
EPIGKITKTTFPVIGGSALDGGGRMNSARQSIHGSPKDWRMEDGG

SEQ ID NO: 135928 - protein, 112 aa, Glycine max
  Coding DNA Sequence Number=SeqID_44243
  Homolog annotation: Hit_ID=Q6WAY3; Match level="QueryCoverage=62%, HitCoverage=3%, E-value=2e-07, Identity=47%"; Hit description =Gag/pol polyprotein
MSYANLLPYLLDNLIVAITPAKVHQPPFLREYDSNASCACHGEAPGRSIEHCRALKHKVQGLIDAGWLKFEDNRVIFNFHRKWVQAIGLFAQATCAPEFGLPRPFNQRYSSC

SEQ ID NO: 135929 - protein, 277 aa, Glycine max
  Coding DNA Sequence Number=SeqID_44244
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSETFGNLLLLYIKYEYVDSAADLLADNSHLAASHLSPVRHLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135930 - protein, 285 aa, Glycine max
  Coding DNA Sequence Number=SeqID_44245
AQGLKVIQRIHKAWRSPLRKDKELRGIRNGVIGGYHGWLRIHTRGLGWLSKLKVVDEENFEAPEEDEEVRALKLELGKARLAKEKFKSAATHIRKECTELQEENAATARALEQETKRARKEEHGREKFRGALWGSNNELKLRREDRDRSRVHGMILKEELVACARSKRSLALHLEATEQSMLAIIGQYKEELNQSMAHEQKLVEDFAQVYAEKEARGRVIDALHQEATMWMDRFTLTLNGSQDLLRLLAKAKSMAEVCTAPEEIHGLINYCQHMIDLMAHIIRNR

SEQ ID NO: 135931 - protein, 83 aa, Glycine max
  Coding DNA Sequence Number=SeqID_44246
MAEEDALPPQDEHTPSPPPRREDSALLNEVLTELRGLRSYVGEHFDSLDTRFASMDIRLTQVEEDVSFIRTCFDPPPPPPSSS

SEQ ID NO: 135932 - protein, 97 aa, Glycine max
  Coding DNA Sequence Number=SeqID_44247
MSPDFTGQDAKWCQKMMLVSDAPTGLVCPWLTKGAGNPACHFTSRVKPEKGAEDDVESPRANRLICPWLTKGAGQQKVQTTMLVLARQQARLTLVDQ

SEQ ID NO: 135933 - protein, 269 aa, Glycine max
  Coding DNA Sequence Number=SeqID_44248
MEGLVDLAAIDAFLAFHHGKESPVVAILAMYDTFDWGCEKSGARIEGRIRILSSCEGCPMRGVPSDESITPFIARGFSDHNARDRELRGSSNGIIGGYHKWLRVRTQGLDWLPNLKTVRDDEVKASKESDEVQALKAELERAWVVEEKFKAAIVSSSSEEVKGIITGQRHDLEGRAKGNMWAIIDKYKEKLNLAATHKQRLEDEYAKISAEREARERVIDSLHQEATMWTDRFALTLNRSQELPPLLAKAKAVADTYSAPEEIHGLLSY

SEQ ID NO: 135934 - protein, 85 aa, Glycine max
  Coding DNA Sequence Number=SeqID_44249
  Homolog annotation: Hit_ID=A5BEV8; Match level="QueryCoverage=89%, HitCoverage=9%, E-value=2e-07, Identity=40%"; Hit description =Putative uncharacterized protein
MGEDSWSVVRNHMLKELAKFSEDYIKLFGGTERFEKLRMLLLVDGLTKVTTDKWMDITDMRHVIASRYNVIAVSLSKHKHDIFSS

SEQ ID NO: 135935 - protein, 60 aa, Glycine max
  Coding DNA Sequence Number=SeqID_44250
MLKKRKIVGAGQLGHTNCGKTSAKARGNWKGGLVSSLEEFESRSKGPTTLRAIGLRNTPN

SEQ ID NO: 135936 - protein, 46 aa, Glycine max
  Coding DNA Sequence Number=SeqID_44251
  Subcellular localization annotation: CTP_CleavageSite=43; ConfidenceScore=5.14e-01
MCFRGENPSRGASVTLPRHFHKRFCGDSSSFFTVLRSFFVVLRSST

SEQ ID NO: 135937 - protein, 20 aa, Glycine max
  Coding DNA Sequence Number=SeqID_44252
GGDVGGGGDLGGVAMGPAKI

SEQ ID NO: 135938 - protein, 120 aa, Glycine max
  Coding DNA Sequence Number=SeqID_44253
  Homolog annotation: Hit_ID=Q6L477; Match level="QueryCoverage=84%, HitCoverage=16%, E-value=2e-10, Identity=30%"; Hit description =Putative uncharacterized protein OSJNBa0009L15.8
MTMSISHSLILLRTYLGIVARDKVDITYENWKEFPTAQKDLIWEDIQAEFDILEASYSRTKRKLLQTVGERWRQFKSDLTRKWAHAADQDGVEDTVCDKYSINKGKWVQFCQTRRDSSWE

SEQ ID NO: 135939 - protein, 249 aa, Glycine max
  Coding DNA Sequence Number=SeqID_44254
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLELQWVTVTLKTATLKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGK

SEQ ID NO: 135940 - protein, 80 aa, Glycine max
  Coding DNA Sequence Number=SeqID_44255
VSLHMLVSYNCKGRGCDEDMIKSKGKDPLEGLGGPMTRARARKAKEALQQVLSILFEYKPKFQGEKSKVVSCIMAQMEED

SEQ ID NO: 135941 - protein, 170 aa, Glycine max
  Coding DNA Sequence Number=SeqID_44256
MPTGREAISSLGSIPHDKSCQGSENLSTRVGPCKAKQEWDSRSTKEVFGGKGKGLGKSRRMGFLLSDCCVLIFEGELIPLETIKRDMTTLGVITKSLSGVLRIVLPCCATLRHMHHGGVSSVEMSLDFSKPRKEESRFFLKHSLKDVPAAQRTLLSDKKQFLSSRIQIRI

SEQ ID NO: 135942 - protein, 94 aa, Glycine max
  Coding DNA Sequence Number=SeqID_44257
  Homolog annotation: Hit_ID=A6FJQ2; Match level="QueryCoverage=40%, HitCoverage=84%, E-value=2e-10, Identity=89%"; Hit description=50S ribosomal protein L5
MTVKTSDTGSSRRRSQLVCNRIPGPDKPVRALHRFLPMRKEKIPHQAPFAIQAAQLLERAIGAGLFAITPAGERGMCCKAIKLGNARVFPVTTL

SEQ ID NO: 135943 - protein, 263 aa, Glycine max
  Coding DNA Sequence Number=SeqID_44258
  Homolog annotation: Hit_ID=Q6WAY4; Match level="QueryCoverage=27%, HitCoverage=13%, E-value=7e-08, Identity=43%"; Hit description =Putative uncharacterized protein
MGLSQAFLLKKRFYQVKVKSLGVTSLKELGQLMGQLQRQAFHKAYGKIWDLAVAEVSTEAIASLAQYYDQPLRCFTFGDFQLSPTVEEFEEILAAIDEEVQALRTELKQAQTVKERFKSATLKIRKENTELRDVNVATTKALERETKRACREEHGRNKFRRALWGSNSELKLRREEKDQSRVDNLILKDELKACSRSKRSLSQRLCETETNMLAIITKYQEELSLATAHEHRVADEYAQVYAEKEARGRVIDSLHQEATMWMD

SEQ ID NO: 135944 - protein, 278 aa, Glycine max
  Coding DNA Sequence Number=SeqID_44259
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSITHCAIFVAIRTQGQRELFLPCGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135945 - protein, 151 aa, Glycine max
  Coding DNA Sequence Number=SeqID_44260
MEGLVDLAAIDAFLAFHHGKESPVVAILAMILSSCEGCPMRGVPSDESITPFIARGFSDHNARDRELRGSSNGIIGGYHKWLRVRTQGLDWLPNLKTVRDDEVKASEESDEVQALKAELERARVVEEKFKSIAIKGSNSKLKLRRGERNHH

SEQ ID NO: 135946 - protein, 110 aa, Glycine max
  Coding DNA Sequence Number=SeqID_44261
  Subcellular localization annotation: CTP_CleavageSite=54; ConfidenceScore=5.35e-01
MHHLLFSVTTTQVDVPSTCTTKDVPSNVLRQSSQVVSPLNLCKGETKDILGEFSLAEEQGLKNRKLRKLLSKGRRRRKMSRKGFKISENIFKEVQKLYEDVEMQVKVLLL

SEQ ID NO: 135947 - protein, 232 aa, Glycine max
  Coding DNA Sequence Number=SeqID_44262
  Homolog annotation: Hit_ID=Q1J7G7; Match level="QueryCoverage=20%, HitCoverage=78%, E-value=2e-08, Identity=58%"; Hit description =Transposase
KVGTSLRARSTSHFRQKLAQGFPGINRDTRIYLLCEVISVTVLQWLLFLSAVPPVQLLTGWCVTAKSTAGTSALGKCSGHAAWARPIRHSRLRNCWEGRSVRASFAITPAGERGMCCKAIKLGNARGELELHRGGGRSRTSGSPGLQEFDPGIDQVEEVVEAGAGRGQHLRDRFGRRPPLAPVGSDPLRAVEARGVEARAPGEARGGEASSLSIPSTSRGGPVPAFVPFSEG

SEQ ID NO: 135948 - protein, 116 aa, Glycine max
  Coding DNA Sequence Number=SeqID_44263
MVKVGTSYVPINVSFSPKVGPGLPGIQQGHQDLFYTGTVPPVQLLTGWYPPARLSSSGNHVGANCGVCILAYYVGTDNARVSVKAFMCRKKLTGSERAAAKPFFHRLRPPDKHHEI

SEQ ID NO: 135949 - protein, 269 aa, Glycine max
  Coding DNA Sequence Number=SeqID_44264
  Gene Ontology: Mol. function=catalytic activity; Biological process =cellular metabolic process
  Homolog annotation: Hit_ID=A6X4F7; Match level="QueryCoverage=98%, HitCoverage=100%, E-value=1e-144, Identity=90%"; Hit description=NAD- dependent epimerase/dehydratase
  Pfam annotation: Domain name=3Beta_HSD; Domain location=9-204; Score=- 105.8; E_value=0.0013; Accession=PF01073.10; Description=3-beta hydroxysteroid dehydrogenaseisomerase family
  Pfam annotation: Domain name=Epimerase; Domain location=8-207; Score =18.9; E_value=1.4e-08; Accession=PF01370.12; Description=NAD dependent epimerasedehydratase family
  Pfam annotation: Domain name=NAD_binding_4; Domain location=10-191; Score=-64.4; E_value=0.00013; Accession=PF07993.3; Description=Male sterility protein
  Pfam annotation: Domain name=adh_short; Domain location=6-126; Score=- 1.9; E_value=1.6e-05; Accession=PF00106.16; Description=short chain dehydrogenase
  Pfam module annotation: Pfam domain module=3Beta_HSD::Epimerase::NAD _binding_4::adh_short; Domain location=9-204::8-207::10-191::6-126
MEIFVKRILITGAAGGLGRVMREKLVGQAELLRLSDVVDMGEARPHEELVQCDLGDLNAVMRLVEGCDGVLHLGGISTEASFSKILNANIVGMYNLYEAARAHGRPRIIFASSNHTIGFYRQDEYIDAKAPTRPDGLYGVSKCFGESIASLYHDKFGQETAIVRIGSCFEEPRNHRMLSTWMSYDDFASLIECVFRAPMLGCPVIWGVSNNDSMWWDNSHARFLGWHPKDNAERFRAGLEKATPRPAPDSALAVYQGGAFVDEPIHQDD

SEQ ID NO: 135950 - protein, 217 aa, Glycine max
  Coding DNA Sequence Number=SeqID_44265
  Gene Ontology: Mol. function=oxidoreductase activity; Cellular component=endoplasmic reticulum; Biological process=metabolic process
  Homolog annotation: Hit_ID=A2R2M6; Match level="QueryCoverage=91%, HitCoverage=66%, E-value=2e-65, Identity=57%"; Hit description =Catalytic activity:
  Pfam annotation: Domain name=adh_short; Domain location=81-208; Score= 35.1; E_value=6.1e-08; Accession=PF00106.16; Description=short chain dehydrogenase
MMLPREGLYIDPIVKILRKTILHPIFTLTCLYFVKSSACAQYDKPAQLIAGTSVLLWLNDWLSAKSRNNWVIDDSWDWKKELVVVTGGSGGIGGGVAQRLATMGARVVVLDIIPLSYEPVVVNNAGLSRGQTVVEGSYSDNIITLKTNLLAPFLLSKEFLPSMIRQNHGHIVNIASMSAYIPPPGIADYAASKAGLIAFHEVYLKYLLSSRLSNRFS

SEQ ID NO: 135951 - protein, 97 aa, Glycine max
  Coding DNA Sequence Number=SeqID_44266
GSFDMEQYLRHVVCQEAANHRAHVRTNETLYQLSLSMQSQGFASFSCPTLDQFRAEVAWPGDWPEAQAGEALPEAPDDGEEAHEDEEMTDLLDFLGG

SEQ ID NO: 135952 - protein, 50 aa, Glycine max
  Coding DNA Sequence Number=SeqID_44267
MTEARQKGGRSLPPSSPRRARLLPPEATSFWRNLLEGPSGPGCYLHPHFY

SEQ ID NO: 135953 - protein, 141 aa, Glycine max
  Coding DNA Sequence Number=SeqID_44268
  Homolog annotation: Hit_ID=Q4YMP6; Match level="QueryCoverage=57%, HitCoverage=59%, E-value=2e-19, Identity=69%"; Hit description =Putative uncharacterized protein
MSNEMLRHFVQQMQSDQAYRYRRPRGGARIYSASSLTDSLRSVVRLRRAEMAYERGGDFLEDARKILNREVRGPRQSRFSIGSAPLTSITKSDAQISGGETRQDYKDTRRFPWRSLVRSPVPAFRFTGVIPLLWPRCLIHA

SEQ ID NO: 135954 - protein, 127 aa, Glycine max; identical to SEQ ID NO: 97488
  Coding DNA Sequence Number=SeqID_44269

SEQ ID NO: 135955 - protein, 67 aa, Glycine max
  Coding DNA Sequence Number=SeqID_44270
MKENMNLGISRSCSSTPSQEVKQIGHLLVLVGLLAIAGSFWGCLSCLGLGPISEPCDLCPELVWSRA

SEQ ID NO: 135956 - protein, 152 aa, Glycine max
  Coding DNA Sequence Number=SeqID_44271
  Gene Ontology: Mol. function=endonuclease activity
  Homolog annotation: Hit_ID=Q9AY32; Match level="QueryCoverage=41%, HitCoverage=95%, E-value=7e-27, Identity=96%"; Hit description=RRNA intron-encoded homing endonuclease
MRSCPYCPGRASGAVTLKKLECSKQAYALILILLCWPSGSPPPLFQGQSGAFVFHSQKKKSWIPPTHKTTAKAFAKDVFIKKERKLGARRRSDTVLVSTINDADQGSADVAFRTPLAPYEKSKSLGSGGSMVARLKLKGIDGRAPPGVEPAA

SEQ ID NO: 135957 - protein, 120 aa, Glycine max
  Coding DNA Sequence Number=SeqID_44272
VKLPAFIVDHRVLPGDMLSGFRRPWGRQASSWQSTDKRNKDHKARRLVVAGQLLENEVRKLREPLELPSEPAVDALDFLEGDEDPLLEVDSPEEVMSASEADSTEDSGPREMAISGGSSS

SEQ ID NO: 135958 - protein, 95 aa, Glycine max
  Coding DNA Sequence Number=SeqID_44273
  Subcellular localization annotation: CTP_CleavageSite=63; ConfidenceScore=5.61e-01
MVKVGTCAYGRSTCSFGPNPAVPATTAVHLRSWVSVTGRAFQSGNHVGANCLMESATRRARPVCAIASGAKAECILAYYVGMQGVPVKAFCGKKG

SEQ ID NO: 135959 - protein, 144 aa, Glycine max
  Coding DNA Sequence Number=SeqID_44274
MRGALAEENLSPFLMRSFDAQSFKIIQRDHKAWESPLRKDKELRGIRNGIIGGYHEWLKVRTRGVRLALQLKVINEGTSKLRKRMKKGVSCLLKVQEKLVSAFMRDRDQHVSHRQQVPRRIKSSHGPRAQSGGRVCPSVRGKGG

SEQ ID NO: 135960 - protein, 162 aa, Glycine max
  Coding DNA Sequence Number=SeqID_44275
MKRWWAAHPQSFADLVFASERINVGPKRGKFDHPTRTTEKTGANKEGEDEGETHAVTAIPVRPSFPPTQQYLYSANNKLSPYPPPSYPQRPSLNLPQSLSTALPMTNTTFSTNQKHQPRTITLSKVHQPPFLREYDSNATCACHGEALGHSIEHCMTPKHKV

SEQ ID NO: 135961 - protein, 231 aa, Glycine max
  Coding DNA Sequence Number=SeqID_44276
MAEKSFEAPEKDEEVQALKNELGKARLAKEKFKLAATDIRKECAGLREENATTARALEQETKRARKEEYGRNKFRGALWGSNSELKLRREEIDQSRAHGMVLKEELVACSRSKRNSSQRLCETQTNMLAIIAKYQEELSLATAHEHRVADEYAQVYAKKEAKGRVIDSLHQEATMWMNRFALTLNGSQELLRLLAKAKAMADTYSAPEEIHGLLDYCQHMIDLMTHIIRNR

SEQ ID NO: 135962 - protein, 156 aa, Glycine max
  Coding DNA Sequence Number=SeqID_44277
MGEVEEVQEQVKADTEALKEKMATMMEAMMSIKEIMEVNAVAITATSTIAECKNKHAFPPYDLLPNYTPHNVAYTPNEDVNNSPPILIESQQSQTDHAHVSQTMGETHEIPHHNLADFEPCLGYAIEGQAVGGIPLQNTLEGPQYHPQPHPLHSTW

SEQ ID NO: 135963 - protein, 96 aa, Glycine max
  Coding DNA Sequence Number=SeqID_44278
MHPTFFMSHVHRDSLGRNNQHENTEKGTLYCITFPNFLNSDQRVPTDPKRIKVIPEWPTPPSVEGRSPEYEEPRDLRSNPFQGGGDDAILHPKGIG

SEQ ID NO: 135964 - protein, 184 aa, Glycine max
  Coding DNA Sequence Number=SeqID_44279
MTTLTQIWMTLLLSNIQPNDPNSDLPLPKCQLVYAILTRMSIHVAQLIADAIYLFVGMEPTRHHLDPDKSNRALGFLALITGLCQSFGIPVTPSKAANHQAHVQTHDCLYQLSLSLQSQGFTSFPYPTQDQFRAEVAWPGDWPEARAGEAPAEAPAEAPDEADEAREDEEMTNLLDFLGGRGAT

SEQ ID NO: 135965 - protein, 236 aa, Glycine max
  Coding DNA Sequence Number=SeqID_44280
  Gene Ontology: Mol. function=chloramphenicol O-acetyltransferase activity; Biological process=response to antibiotic
  Homolog annotation: Hit_ID=P62577; Match level="QueryCoverage=92%, HitCoverage=99%, E-value=1e-126, Identity=97%"; Hit description =Chloramphenicol acetyltransferase
  Pfam annotation: Domain name=CAT; Domain location=6-209; Score=515.3; E_value=6.8e-152; Accession=PF00302.9; Description=Chloramphenicol acetyltransferase
MLNKITGYTTVDISQWHRKEHFEAFQSVAQCTYNQTGQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDHFFAPVFTMGKYYTQGDKVLMPLAIQVHHAVCDGFHVGRMLNGLQQYCDEWQAGRNFFKAVIGALEIFYLIN

SEQ ID NO: 135966 - protein, 309 aa, Glycine max
  Coding DNA Sequence Number=SeqID_44281
MAPRKLASKRSRKDKAVEGTSSAPEYDNHHFRSAEHQQRFKAIKGWSFLRERCVQLRDDEYTDIQEEIVRQRWASLVTPMAKFDPDVVLEFYANAWPREEGVRDMRSWVRGQWIPFDADALSQFLGYPLVLEEGQECEYGQRKNQADGFDEEAIAQLLCIPEQDFSRTAAGRRVRIMRTNMTTLTQIWMTLLLSNIQPSDHNSDLPLPKCMAPTRHPLDPDKSNRALRFPALIIGLCQSFGVLVAPSKRQAQGDAPQAADASPPHQASPAGSFDSEQYLRHVVRQQATNHRAHVQTHDCLYQLSLNLQS

SEQ ID NO: 135967 - protein, 98 aa, Glycine max
  Coding DNA Sequence Number=SeqID_44282
MSNRCPGQFLEEPNYEYWKARMVLPAQCTKLDRHEPVERAVQRLGTSCPKIAGHRRGSLECRFSGRMIDLIQHKLLQPIFTHCYKNMEAARVLYQVRD

SEQ ID NO: 135968 - protein, 90 aa, Glycine max
  Coding DNA Sequence Number=SeqID_44283
MPRWHDLAGGDEHPVGLTEARNQSWKPPGPCWTPPSPLGVLWARSLQIVDGIRNQMLLSNNVIHICVRVFMLVRIIRTRLFAAARVKSYS

SEQ ID NO: 135969 - protein, 71 aa, Glycine max
  Coding DNA Sequence Number=SeqID_44284
MCYVQDSLEEQTSQGSFVPHGCRDLLTAAIGRPEHPGRVCAAGAGVTIKQYFGSAPQTSHTSSSMAPEELE

SEQ ID NO: 135970 - protein, 116 aa, Glycine max
  Coding DNA Sequence Number=SeqID_44285
  Gene Ontology: Mol. function=oxidoreductase activity, acting on single donors with incorporation of molecular oxygen, incorporation of two atoms of oxygen; Biological process=fatty acid biosynthetic process
  Homolog annotation: Hit_ID=Q93YA9; Match level="QueryCoverage=67%, HitCoverage=10%, E-value=9e-17, Identity=52%"; Hit description =Lipoxygenase
  Subcellular localization annotation: CTP_CleavageSite=47; ConfidenceScore=5.26e-01
MGFSSFDSASYKVFKPDKHGTFWIFSNPFPTENTRVVRLRKGAKFPMAAISEDLIKTTLTVHAEKPDFKETILKHLDAINDRIGTRNIVLELMSTEIDPSKPAFHNSPFESFSFSS

SEQ ID NO: 135971 - protein, 107 aa, Glycine max
  Coding DNA Sequence Number=SeqID_44286
MGLGKDSHGNADVVDIRGNPHKYGLGYEPGKPKRRKAPPRLRADRAWPDHVSQCFTSAGIMFEEKVVAIGEEAPQDPPSFVRPFHPNFQLGNWHATSQSEVYTVDSM

SEQ ID NO: 135972 - protein, 130 aa, Glycine max
  Coding DNA Sequence Number=SeqID_44287
  Homolog annotation: Hit_ID=UPI00006A2D9E; Match level="QueryCoverage =60%, HitCoverage=49%, E-value=2e-07, Identity=16%"; Hit description =UPI00006A2D9E related cluster
GLHALAFRGLHVLAFRGLHVLAFTELHVLAFRGLHALAFRGLHVLAFGGVHVLAFTNLHALPFKGLHVLAFRGLHALAFKGRCRNLPFEGRATRDSRDACSTKGIRAESPPTFIRGKRRKNRKRRDLRTF

SEQ ID NO: 135973 - protein, 32 aa, Glycine max
  Coding DNA Sequence Number=SeqID_44288
MSWELERRIGAISLKNLSQEARGQPPLLSYLD

SEQ ID NO: 135974 - protein, 73 aa, Glycine max
  Coding DNA Sequence Number=SeqID_44289
MTDLVSAEDDVNLRVSTGLSAAIDEGCRMTIICLYVPSDTTVSEWKKGPPALNDKRVQNDHNLSLRAIGHDCV

SEQ ID NO: 135975 - protein, 279 aa, Glycine max
  Coding DNA Sequence Number=SeqID_44290
  Gene Ontology: Mol. function=GTP binding; Cellular component =intracellular; Biological process=regulation of transcription, DNA -dependent
  Homolog annotation: Hit_ID=P0ABU3; Match level="QueryCoverage=34%, HitCoverage=26%, E-value=2e-47, Identity=95%"; Hit description=GTP -dependent nucleic acid-binding protein engD
  Pfam annotation: Domain name=DUF933; Domain location=16-99; Score =204.0; E_value=3.7e-58; Accession=PF06071.4; Description=Protein of unknown function (DUF933)
  Pfam annotation: Domain name=Fic; Domain location=185-279; Score =17.9; E_value=6.1e-05; Accession=PF02661.9; Description=Fic protein family
  Pfam module annotation: Pfam domain module=DUF933::Fic; Domain location=16-99::185-279
PGLNRVIRAGYALLNLQTYFTAGVKEVRAWTIPVGATAPQAAGKIHTDFEKGFIRAQTIAFEDFITYKGEQGAKEAGKMRSEGKEYIVKDGDVMNFLLAATNGTPWIYSNLTYPDERKSALMSRYHVAGSEGKFEKDSGEQVMANKLGLTDSTEMNEAELVLLEQLYQSVFEENFPEGKLNVALLKSWHRRWLGNIYEWAGQERTVNISKGGFMFAPSAQLPKLLNEYNKYLAHYTPCNVMEEEELIIAIAVTHVELILIHPFREGNGRLSRLLADVMA

SEQ ID NO: 135976 - protein, 189 aa, Glycine max
  Coding DNA Sequence Number=SeqID_44291
MAPRKLSTKRSRKDAAAEGTSAAPEFDSHRFRSAEHQQRFEAIKGWSFHRERHVQLRDDEYIDFQEEIARRRWMSLVTPMAKFDPDIVLEFYANAWPKEEGVRDLRSWRDASSIGACRPRIFFINGFLCFLEDEWQRNGERERERRCHFKEKMSLEEAHHHRRPWIRAWRKKEMNEGRGREEHEILCSK

SEQ ID NO: 135977 - protein, 278 aa, Glycine max
  Coding DNA Sequence Number=SeqID_44292
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILFLCRIEELLQIKLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135978 - protein, 228 aa, Glycine max
  Coding DNA Sequence Number=SeqID_44293
  Gene Ontology: Biological process=transposition, DNA-mediated
  Homolog annotation: Hit_ID=Q6UUU1; Match level="QueryCoverage=26%, HitCoverage=40%, E-value=3e-18, Identity=78%"; Hit description =Putative uncharacterized protein
LAPGLPGINRDTRIYFILRSDLPSQWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135979 - protein, 262 aa, Glycine max
  Coding DNA Sequence Number=SeqID_44294
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.17e-01
GTSYVPINVSFSPKVGPGLPAVPPVQLLTGWCVTAKAPPDISAGKCSGRVPFAIQAAQLLGRAIGAGLFAITPAGERGMCCKAIKLGNARVFPEFDWELVEKPQHQKVIGVKWVFRKKENLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135980 - protein, 36 aa, Glycine max
  Coding DNA Sequence Number=SeqID_44295
MPRAQNSTAHHSAYFKKRALEAARGATFAEIPRFSG

SEQ ID NO: 135981 - protein, 308 aa, Glycine max
  Coding DNA Sequence Number=SeqID_44296
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDVDIVELDPVVYDYAKSYFNLSTSCLAHIGDGRHFIDHVATPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 135982 - protein, 71 aa, Glycine max
  Coding DNA Sequence Number=SeqID_44297
MKLHYDQSDEQNDGDSDEVYFVEAFGKRRHRECTIWRRRFRLWCLSTLSSLWRQWHWKARTKGDTEVAEGA

SEQ ID NO: 135983 - protein, 225 aa, Glycine max
  Coding DNA Sequence Number=SeqID_44298
  Homolog annotation: Hit_ID=A7R3T5; Match level="QueryCoverage=96%, HitCoverage=48%, E-value=4e-48, Identity=48%"; Hit description =Chromosome undetermined scaffold_567, whole genome shotgun sequence
MAGVAGTKKRARLFKQLQTQIQTEIAIGNPSEGDVRDAIEKVLALDKAYPLPLLGGAMLEKFPAKFEAARWWPESRLSSNDEDKIMEIKNNNNNGWNVELEEEMREVIEVLKRKDMEDYERLGNIALKKNKGFAVSAPLLTGIVALGSVFSGDGLVPALAGALATVVNAFEHGGQVGMVFEMYRTCGGFFQLLEETIETAIEEKDLDKRENGELFEIKMALQLGR

SEQ ID NO: 135984 - protein, 100 aa, Glycine max
  Coding DNA Sequence Number=SeqID_44299
  Homolog annotation: Hit_ID=A5BKT6; Match level="QueryCoverage=79%, HitCoverage=9%, E-value=1e-10, Identity=43%"; Hit description =Putative uncharacterized protein
MGEGNIRNQYKAQIKNVLYVDGLKHNLLIISQLYDKGFKIEFNKHCFLIDEAISGEVVHIGKRIGHIYMLKIEHASFHELSCLGYTDKHASSQSSSQKRL

SEQ ID NO: 135985 - protein, 184 aa, Glycine max
  Coding DNA Sequence Number=SeqID_44300
MSCIILKCVKTTISTKFVITNLNWCFIGAALVRQRVLDDLPFRRYRFVGFADVVAGQFVPGLLVDEVVFRHVSGKGRRPAIAILHFVGQLLLAFLKFLDDHEGHSPITVLLTHGRIKEVQGSYPPSVNNSFKASKLVINQPVMEIQEFNERFAELGIEAWSFFKSHGEGSSQLSGSIQLSSGIL

SEQ ID NO: 135986 - protein, 59 aa, Glycine max
  Coding DNA Sequence Number=SeqID_44301
MKKVSYEMLLSPIALKVVDPLLLDSNSSRDGTNPPFQFPIWQFTNKETKRQAITKDQKT

SEQ ID NO: 135987 - protein, 222 aa, Glycine max
  Coding DNA Sequence Number=SeqID_44302
MTLTYKNRRITRPFRLARFGDDADAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSLHDQPRIVAGSLQEIAVALQPCEAEGGHAGLTRAEHLALAAQAQVLLGDAKAVLARSHHLEPRLGDLSQRTAIEVPSSNS

SEQ ID NO: 135988 - protein, 79 aa, Glycine max
  Coding DNA Sequence Number=SeqID_44303
  Homolog annotation: Hit_ID=A5BPP4; Match level="QueryCoverage=44%, HitCoverage=6%, E-value=8e-07, Identity=62%"; Hit description =Putative uncharacterized protein
MLPFDCRHVTELHRLPNDGCQVPQSGQTRVAFQQTDGPRTKLGYDSNTGVRTDDVGFTLVDLNKLAYQNDPFIMAEQAK

SEQ ID NO: 135989 - protein, 34 aa, Glycine max
  Coding DNA Sequence Number=SeqID_44304
MTEFVPWQKQFNKVMNRMDRRSHDVTTSVSTSGT

SEQ ID NO: 135990 - protein, 127 aa, Glycine max
  Coding DNA Sequence Number=SeqID_44305
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=52%, HitCoverage=65%, E-value=2e-33, Identity=100%"; Hit description=LacZ protein
MESELASVPDSTSSIIGSTWCMKKNMEKGRNGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 135991 - protein, 35 aa, Glycine max
  Coding DNA Sequence Number=SeqID_44306
METYGGSWWLLVVEGAFTETASGSFLKKLSREASL

SEQ ID NO: 135992 - protein, 63 aa, Glycine max
  Coding DNA Sequence Number=SeqID_44307
MGTSKPYTRAMRGITHEPQASIGADQKFSSIHGGPLGTSTLAFCGLHALAFRGLRVLTIRGLH

SEQ ID NO: 135993 - protein, 148 aa, Glycine max
  Coding DNA Sequence Number=SeqID_44308
  Gene Ontology: Mol. function=aspartic-type endopeptidase activity; Cellular component=chromatin; Biological process=chromatin assembly or disassembly
MTSAEMQLRRERGLCFTCDDKFSPSHRCPNKQYFVPQWEEEDEPALQPDPPDEVETAGDPSLQDHHLSYNALKGSSGFGGNGNAFTAEGLIQDLEVKIQGHTLKLPVYLLPVSGADLVLGAACFTWVINLSPCMARDPLYDNRLNLIT

SEQ ID NO: 135994 - protein, 304 aa, Glycine max
  Coding DNA Sequence Number=SeqID_44309
  Gene Ontology: Mol. function=serine-type endopeptidase activity; Cellular component=periplasmic space; Biological process=proteolysis
  Homolog annotation: Hit_ID=Q5PHP0; Match level="QueryCoverage=99%, HitCoverage=44%, E-value=1e-138, Identity=81%"; Hit description=Tail- specific protease
  Pfam annotation: Domain name=Peptidase_S41; Domain location=1-154; Score=184.3; E_value=3.2e-52; Accession=PF03572.9; Description =Peptidase family S41B
LQKLQKQNVDSIVIDLRTNGGGALTEAVSLSGLFIPSGPVVQVRDNNGRVREDSDNDGIVYYKGPLVVLVDRFSASASEIFAAAMQDYGRALIVGEPTFGKGTVQQYRSLNRIYDQMLRPEWPALGSVQYTIQKFYRINGGSTQRKGVTPDLLMPTGVEAAETGEKFEDNALPWDSINAATYTKTGDITPLVPQLTKEHADRIAKDREFQYIMKDIARFNAMKDKRNIVSLNLAQREKENHEEDALRLERINARYQAEGKAPLKSLDDLPKDYKEPDPYLDETVKIANDLAQLEKDQPAPAAAK

SEQ ID NO: 135995 - protein, 136 aa, Glycine max
  Coding DNA Sequence Number=SeqID_44310
  Gene Ontology: Mol. function=hydroxymethyl-, formyl- and related transferase activity; Cellular component=cytoplasm; Biological process='de novo' IMP biosynthetic process
  Homolog annotation: Hit_ID=P0A440; Match level="QueryCoverage=77%, HitCoverage=37%, E-value=4e-51, Identity=91%"; Hit description =Formyltetrahydrofolate deformylase (EC 3.5.1.10) (Formyl-FH(4) hydrolase)
  Pfam annotation: Domain name=Formyl_trans_N; Domain location=1-114; Score=84.1; E_value=4.6e-22; Accession=PF00551.10; Description =Formyl transferase
MADEIDRYQPDYVVLAKYMRVLTPAFVQRYPNQIINIHHSFLPAFIGARPYHQAYERGVKIIGATAHYVNDNLDEGPIIMQDVINVDHSYTAEEMMRAGRDVEKNASGGIPERPKGADCKSAVIDFEGSNPSPATI

SEQ ID NO: 135996 - protein, 69 aa, Glycine max
  Coding DNA Sequence Number=SeqID_44311
  Gene Ontology: Mol. function=nucleic acid binding; Cellular component= cytoplasm; Biological process=regulation of transcription, DNA -dependent
  Homolog annotation: Hit_ID=P0A9Y8; Match level="QueryCoverage=100%, HitCoverage=100%, E-value=2e-32, Identity=98%"; Hit description=Cold shock-like protein cspC
  Pfam annotation: Domain name=CSD; Domain location=3-69; Score=154.0; E_value=4e-43; Accession=PF00313.13; Description='Cold-shock' DNA -binding domain
MAKIKGQVKWFNESKGFGFITPADGSKDVFVHFSAIQGNGFKTLAEGQQVEFEIQDGQKGPAAVNVTAI

SEQ ID NO: 135997 - protein, 1053 aa, Glycine max
  Coding DNA Sequence Number=SeqID_44312
  Gene Ontology: Mol. function=cation transmembrane transporter activity; Cellular component=integral to membrane; Biological process=cell volume homeostasis
  Homolog annotation: Hit_ID=A6TAW2; Match level="QueryCoverage=52%, HitCoverage=95%, E-value=0.0, Identity=75%"; Hit description=Cell volume regulation protein A
  Pfam annotation: Domain name=Bac_transf; Domain location=857-1053; Score=488.6; E_value=7.8e-144; Accession=PF02397.7; Description =Bacterial sugar transferase
  Pfam annotation: Domain name=CorC_HlyC; Domain location=472-552; Score=90.8; E_value=4.2e-24; Accession=PF03471.8; Description =Transporter associated domain
  Pfam annotation: Domain name=DUF1480; Domain location=543-617; Score =45.9; E_value=1.4e-10; Accession=PF07351.4; Description=Protein of unknown function (DUF1480)
  Pfam annotation: Domain name=Na_H_Exchanger; Domain location=1-369; Score=206.4; E_value=6.6e-59; Accession=PF00999.12; Description =Sodiumhydrogen exchanger family
  Pfam annotation: Domain name=TrkA_C; Domain location=396-464; Score =47.0; E_value=6.7e-11; Accession=PF02080.12; Description=TrkA-C domain
  Pfam module annotation: Pfam domain module=Bac_transf::CorC _HlyC::DUF1480::Na_H_Exchanger::TrkA_C; Domain location=857-1053::472- 552::543-617::1-369::396-464
ILLSSFSSRLGIPILVIFLALGMLTGVDGIGGIAFDNYPVAYLVSNLALAIILLDGGMRTKASSFKVALGPALSLATVGVMITAGLTGLAAAWLFKLDLMQGFLIGAIIGSTDAAAVFSLLGDKGLNERVSSTLEIESGSNDPMAVFLTITLIDMIQQGQSGLSWMFVVHLVQQFGLGIVLGLGGGWALQQLINRISLAQGLYPLLALSGGIIVFALTTVMEGSGILAVYLCGFLLGNSPIRNRHGILQTFDGMAWLSQIGMFIVLGLLVTPSDLWHIALPAMILSLWLILVARPLSILVGLLPFKGFTGRERIFISWVGLRGAVPIILAVFPMMAGLENSKLYFNIAFFVVLVSLMLQGTSLGYAAKRAKVVVPPTASPISRVGLDIHPENPWEQFVYQLSADKWCVGAALRDLQMPRETRIAALFRDNALMHPNGNTRLKEGDVLCVIGRERDLPALGKMFSQTPPVALDQRFFGDFILDAEARLRDVAQIYGLELDEETNDQQSLGQLIMGLLGSTPVVGDQVEWNQLTWTVAEKEDNQIVKIGIGRYEIVDAVMDVEKLDTVGIPCHTNPGLSYQLDGWDHETSVPAWIDGEPVDLQIGHYDKQQDRWGIWGELDSFIPPQQIEYRFVAQLGLSVLCTAWFWVRMRHYTYRKPFWFELKEIVKTLFVFSLLDLALIAFSKWDFSRMVWVFSWTYALLLLPLMRAGVKRAINRAGQWQKETIIIGSGKNAMEAYAALQSEEILGYNVQAFISLDDEPHQESVNGVPVITWKDINWQTMDRDNTQFIVATEFEQQVVRDKWLKFLSKMKCRSISVIPTLRGVPLYGTDMSFIFSHEVMILRVSNNLAKRSSRFLKRTFDVVVASLLLLFLAPVFGLLCWMVKRDGGNAIYGHERVGQDGVKFKCLKFRSMVTNSQEVLQNLLATSAEARAEWDRDFKLKNDPRITKIGGFLRKTSLDELPQLWNVIRGEMSLVGPRPVIEAELERYAGDVDYYLMAKPGMTGLWQVSGRNDIDYDTRVYFDSWYVKNWALWTDIAILFKTAGVVLRRDGAY

SEQ ID NO: 135998 - protein, 269 aa, Glycine max
  Coding DNA Sequence Number=SeqID_44313
  Gene Ontology: Mol. function=carbohydrate binding; Cellular component= cytoplasm; Biological process=carbohydrate metabolic process
  Homolog annotation: Hit_ID=A8GFE0; Match level="QueryCoverage=99%, HitCoverage=91%, E-value=1e-106, Identity=65%"; Hit description =Aldose 1-epimerase
  Pfam annotation: Domain name=Aldose_epim; Domain location=5-267; Score=122.6; E_value=1.2e-33; Accession=PF01263.11; Description =Aldose 1-epimerase
MGELPILVISHPKVRAAIALQGAHLLAWQPAGQQPAIWLSDKTPFVSGKAIRGGVPVCWPWFGPAGEPAHGFARNQPWTLTAHDENEDAVMLTFTLESNAQTKKLWPHDFTLLARFRIAEHCEIELEAWGDYEATAALHSYFQVADIAQVEVSGLGNSYIDKVQDNAIGSAADGKQTYPDRVDRIHTAAEDCSVIHDRAGKRQIEVYHHYQSDVVTWNPGPALSCSMADMPNDGYKTMVCVETARINKPMKSAGETPARLGVTLRIRNK

SEQ ID NO: 135999 - protein, 694 aa, Glycine max
  Coding DNA Sequence Number=SeqID_44314
  Gene Ontology: Mol. function=signal peptidase activity; Cellular component=integral to membrane; Biological process=signal peptide processing
  Homolog annotation: Hit_ID=A7MNV1; Match level="QueryCoverage=88%, HitCoverage=99%, E-value=0.0, Identity=68%"; Hit description =Putative uncharacterized protein
  Pfam annotation: Domain name=CLP_protease; Domain location=360-551; Score=-92.9; E_value=0.068; Accession=PF00574.14; Description=Clp protease
  Pfam annotation: Domain name=Peptidase_S49; Domain location=161-317; Score=171.8; E_value=1.8e-48; Accession=PF01343.9; Description =Peptidase family S49
  Pfam annotation: Domain name=Peptidase_S49; Domain location=412-564; Score=235.7; E_value=1.1e-67; Accession=PF01343.9; Description =Peptidase family S49
  Pfam module annotation: Pfam domain module=CLP_protease::Peptidase _S49::Peptidase_S49; Domain location=360-551::161-317::412-564
MNPTSGQTAYRLPWLREYGEFMRTLWRIIAGLFRWSWRVLNFIREFILNLFLIVLILAGVGIWLQLSSASSSEPVQQGALKVDLSGVLVDKPSVSNRLSRISRQLLGASSDRLQENSLFDVVDAIRQAKSDKNITGMVLDLRDFAGGDQPSLQYVGKALREFRDAGKPIFALGDSYSQAQYYLASYATKVYLSPQGTVDLHGFATNGLYYKSLLDKLKVSSHVFRVGTYKSAVEPFLRDDMSPEARDADGRWVGQLWQNYLNTVSANRQITPQQLFPGAAGIISGLQAVQGDTAKYALDNKLVDVLDSRAAADRELVKTFGWDKASNDYRNVSIYDYNVKQPTQQDGNIAVILASGAIMDGEESAGNVGGDTTAAQIRDARLDDKIKAIVLRVNSPGGSVTASEAIREELAAAHDAGKPVVVSMGGMAASGGYWISTPADYIVAAPSTLTGSIGIFGVINTVENSLSSIGVHSDGVATSPLADVSTTKALPAEVQQLMQLTIENGYRNFVGLVAVSRHKTPQQIDAIAQGHVWTGSDAKANGLVDALGDFDDAVAKAAELAKVAKPELSWYQDDPGMIDLLLNQMNASVQAVLPAALKVWLPAPVSEVMGTLQAQPGLMNNLNDPQNRYAFCLTCGNSESIHAKEKYLCSLHGRDHRYATLRAGLHSGLWPSAAAAGDDARVSPSGKMPEWGIL

SEQ ID NO: 136000 - protein, 418 aa, Glycine max
  Coding DNA Sequence Number=SeqID_44315
  Gene Ontology: Mol. function=motor activity; Cellular component=cell projection
  Homolog annotation: Hit_ID=P15305; Match level="QueryCoverage=99%, HitCoverage=99%, E-value=2e-33, Identity=24%"; Hit description =Dynein heavy chain
RGQHALAFRGLRILSFRGLHILTVRGLHVLAFIGLHALTFRGLHVLIFSRVQVLTFSRVHVLVFRGLHALTFRGLHALTFRGQHALAFRWLHVLSFRGLHVIAFRGLHTLAFRGLHVHTFRGLHALALRGLHVLAFSGVNVLAFRGLHVIAFRGLHALTLRGLHALTFRGLHVLAFRGLHVLDFKGIHDLTFRGLHVLAFKWLHVLAFRGLHAFSGLHVLTFRGLHVLTFRGVHVFSFRVLHVLAISGVHVFAFRGPHVLTFRGLHALNFRGYHVLSFRGLHVLGFEGLKILSFRGLHVLAFRGLHILSFRGLHALTFRGLHILVFRRVHVLTFSRVHVLVFRGLHALNFRGLHPLTYRGIHALTFRGQHALAFRGLHVLAFRGLHVIAIRGLHALAFRGLHVHTFRGLHALALSRLH

SEQ ID NO: 136001 - protein, 73 aa, Glycine max
  Coding DNA Sequence Number=SeqID_44316
  Subcellular localization annotation: CTP_CleavageSite=30; ConfidenceScore=5.15e-01
MFVRKKWPRGSLPQRGPGRKRRPKELVPLLSMTVTALGALYTSSASRPSRDGHFSGSDASSSGTTSTLISRRK

SEQ ID NO: 136002 - protein, 48 aa, Glycine max
  Coding DNA Sequence Number=SeqID_44317
MNAKIKSESTDKSFKVNGHRLKPFLTNPSLVDVVVEETSLLHPTSLPS

SEQ ID NO: 136003 - protein, 93 aa, Glycine max
  Coding DNA Sequence Number=SeqID_44318
MEDPLPLNDRLMIMLIDGAFHASKVAAKAVTLSIRQQFGRPWPTWGVIPKDHHDLFFQRFKRKLVWRPEEYNEIKNAFHSKASHRLSKMFRDA

SEQ ID NO: 136004 - protein, 157 aa, Glycine max
  Coding DNA Sequence Number=SeqID_44319
MLAIIAKYEEELGLATAHEHRIADEYAQVYAEKEARGRVIDSLHQEATMWMDRFALTLNGSQELPRLLAKAKAMADTYSAPEEIHGLLGYWKNTITKRAARDPYRTRSKSRTMGDQEETQEQMKADMSALKEQMASMLEAMLGMKQLMEKNAATAAA

SEQ ID NO: 136005 - protein, 144 aa, Glycine max
  Coding DNA Sequence Number=SeqID_44320
  Subcellular localization annotation: CTP_CleavageSite=39; ConfidenceScore=5.08e-01
MVPQWFKLAVVPFLRQLNHSRSPTGTYDRFRLGRAFASVASAFSPEYQQPAHGTAEIGDVPLTGFRTQPSSEPSATKSHGGLWLEPITNLKSTSAGRQMRAPVVAVLNERQVWNQTGAPLHLFPLTTTKPLTAPPRYLPFFTTK

SEQ ID NO: 136006 - protein, 256 aa, Glycine max
  Coding DNA Sequence Number=SeqID_44321
GIDLWPDDLIAQSNTSRLGFLALITALCRARWVVSDSLTFERLIPVINLAYIRKNWARRARARLAKLPSTSAAPTPSSTSAAPFVPVQIDSQRFEAMLQSIHQGQIILLQSLQMMAPPDSIPSVEQFNEIVAWPRTQPSLHREDEGPTAQVPQHMEDESSEATIPEPFVIREEAEETQVRQVVAATPKRSLEATSEPSAQEEDIPSPQHATDPFIPLIEMPEDPTTSVLAMDTSPPPTPVLHLTDEEDVQTQDTQD

SEQ ID NO: 136007 - protein, 173 aa, Glycine max
  Coding DNA Sequence Number=SeqID_44322
MGQLQRQAFRKPMDFQLVPTVKEFEEIRGCPLGGRKPYLFSGFYPSTTRVAKYQGSVWRKGQRPWQIKANGLSFIDILALLIFGVVLYPNMEGLVDLAVIDAFLVFQHDKESPVAAILAMYDTFDRGCEKSGARIEGRIGILSSCEGCPMRGVPSDESITPFIARGYSEHNAK

SEQ ID NO: 136008 - protein, 159 aa, Glycine max
  Coding DNA Sequence Number=SeqID_44323
MSCGFGMTDPLDESISCFLIRVDPWVLVTLTFRGLHVLTFRGLHTLAIRGLHVLTFVGLHALTFRGLHVLANRGLHALTLRGLHVLALRGLHVLTIRGLHALTSRGLHVLTLRGLPALALGTSYPHLQRTTCPHFQRATCPRHQRTACPHLRRATRPHL

SEQ ID NO: 136009 - protein, 229 aa, Glycine max
  Coding DNA Sequence Number=SeqID_44324
MNLIIVIKKKRTRFTAPDRTRARARVMGEAEEVQEKMKADMEAMKEQMATMMEAMMSMKKIMEANAVIVAATSAVAKVNPMLPSGLKQMNHPTSNMHAFPPYGLPPNYTPPNVAYTPNKNVNNSTPIPIESRQPQTVHAHVSQPMGETHEIPHHNLADFEPWLGYATEGQAVGGMPLENTSEGPQYHPQLHLLHSTTSKNPHAMAEMGKLGSSRGKGQGHRMRRRLCLS

SEQ ID NO: 136010 - protein, 40 aa, Glycine max
  Coding DNA Sequence Number=SeqID_44325
MMLDIVLYTGNGARKKLSNHVSFSAAPLRAFSGGTSPSNS

SEQ ID NO: 136011 - protein, 106 aa, Glycine max
  Coding DNA Sequence Number=SeqID_44326
MLATGNRLLPSGNRLPEIKTLCHCFHTCKILYKQRATKDVPSLVNEDKARNKGKEPLEGLGGPMATARTKKAKEALQQVLTMLFEFRLKLQVEKLRIVNCTMFQEE

SEQ ID NO: 136012 - protein, 231 aa, Glycine max
  Coding DNA Sequence Number=SeqID_44327
MDVATPRRFIYEALQKGGVIPHGGHGEDSCLMHPGELHNMETCLGVEDMLQQMIDRGRLEVGDEGSEEQHICMRSADERSFGRPKPLVVYFTRDAAPQTPRYPSVVKPVPFAYRNSHAVPWRYAPPSERNEEATDINSLSAKVTNITGLSGMTRNSRVFAPPDLLTQPANVKGKAKITEGKDDKIIPTSNENIPVKGLSEKKDGCGKKEVSLEETGEFLRIIQQSEFKVIE

SEQ ID NO: 136013 - protein, 143 aa, Glycine max
  Coding DNA Sequence Number=SeqID_44328
MVEPSKKRKAFYSNLEIQESTLISEVYGIKMVIDQSLFYDLTQLSSDNVPFEGALDDDWKFDFSVHDARRLVCTNQADMTGRLLAGSLALESRILHYLIVRILLQRSLNLAQVSEEDLIIMWAFHTGRLMIKISIILPALPTP

SEQ ID NO: 136014 - protein, 133 aa, Glycine max
  Coding DNA Sequence Number=SeqID_44329
MNFVRSGTKQAEKRANTCAHYDELIMNKQYYIHSASQKTLRSHQEVIEFLLDVEIPRKGGSKKAKVVGAVDNQNIQEIMSNTIRIEKFNEKNSFNLWRIKMHALLKEQRVWAPVAYASVKKEVASESKEKAFI

SEQ ID NO: 136015 - protein, 133 aa, Glycine max
  Coding DNA Sequence Number=SeqID_44330
MGSSQKPSLKKRFYQVKIKSLEVTSLRKLGQLMGQLQRQAFRKAYGLPASADCERVGRNPGMPTGRKEAISFLWVLSLHDKSCQGQRPWKIKANWDQLLASKEGASVNWFPRWKEGRTRVLISCGGFPNVPLM

SEQ ID NO: 136016 - protein, 55 aa, Glycine max
  Coding DNA Sequence Number=SeqID_44331
MGLIKVILVASTRTYLPSPEVASTLTYLPSPEVTLKPVSSDPLLVRFTSRSTIEV

SEQ ID NO: 136017 - protein, 67 aa, Glycine max
  Coding DNA Sequence Number=SeqID_44332
MSVDAPQPQVRIAINKILQLISIGLSSIETVGGRQNGVEVTNEEPGAIHISIDTIPDLSKEDLLAIM

SEQ ID NO: 136018 - protein, 139 aa, Glycine max
  Coding DNA Sequence Number=SeqID_44333
MEAMKEQMTTMMEAMMSMRKMMEVNTAIVVAASTTTEVDPIHPSGLYQVQSKHSFSPYGLPPNYTPPNVDNSALIPIKSQQPQSSHERVPQPMEETLEVPRDHTLADFKPHLGYATEGQTFGGIPLPNTLGGPQYCPQP

SEQ ID NO: 136019 - protein, 258 aa, Glycine max
  Coding DNA Sequence Number=SeqID_44334
  Homolog annotation: Hit_ID=Q84VH5; Match level="QueryCoverage=94%, HitCoverage=48%, E-value=6e-92, Identity=89%"; Hit description =Envelope-like protein
VPDIKRTKTSGKKVPDNVPDAPLDNISFHYIGNAERWKFVYQRRLALERELGRAALDCKEIMDLIKAAGLLKTVTKLGDCYESLVREFIVNIPSDITNRKSNEYQRVFVRGKCVRFSPAVINKYLDRPTDGVVDIAVSEHQIAKEITAKQVQHWPKKGKLSAGKLSVKYAILHRIGAANWVPTNHTSTVATGKVAASGAVSKDALIAELKDTCKVLEATIKGTTEKKMELERLIKRLSESGIDDGEAAEQEDEAAEEE

SEQ ID NO: 136020 - protein, 61 aa, Glycine max
  Coding DNA Sequence Number=SeqID_44335
  Subcellular localization annotation: CTP_CleavageSite=35; ConfidenceScore=5.22e-01
MRKEKIPHQAPFAIQAAQLLGRAIGFSQSRRCKTTASAKLACLQVDSRGSPHSRLAMSRPT

SEQ ID NO: 136021 - protein, 107 aa, Glycine max
  Coding DNA Sequence Number=SeqID_44336
VFITWLSIGPSSAWRISWLRWPGQESSLLLWGKVRLLTSQELQPEAKAQSEVTLEATLGTSPVTTPLVEVFEEDDGATNTYYAAYLAVMQSTWDPWPATAQETSQPA

SEQ ID NO: 136022 - protein, 32 aa, Glycine max
  Coding DNA Sequence Number=SeqID_44337
MKQQHCPWGCNLRGCLIGYHLLLVIRVALEGL

SEQ ID NO: 136023 - protein, 104 aa, Glycine max
  Coding DNA Sequence Number=SeqID_44338
MRVHPEVPARTLQQPVDWILPTPTPYRLVEPVQVIEVSSSKEDLEENLEELPPEPAVDALDLPMDDEDPLIDVDSPEDIMSASEADSTEESGPGGTANSDDSSS

SEQ ID NO: 136024 - protein, 230 aa, Glycine max
  Coding DNA Sequence Number=SeqID_44339
  Homolog annotation: Hit_ID=A6FJQ2; Match level="QueryCoverage=16%, HitCoverage=84%, E-value=7e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPECRNHLQKERHLIGENGDGEALQKYLVRMQEQDGNFFYAIEYRARIRNHGHSCFLRETCRASCINESANARGEAVCVLGALPLPRSLTRCARSFGCGERYQLTQRRSFAPSWAVCTNPPFSPTAAPYPVTIVLSPN

SEQ ID NO: 136025 - protein, 171 aa, Glycine max
  Coding DNA Sequence Number=SeqID_44340
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
SEQESARGSFQGETPGIFIVLSGFATSDLSVDFCDARQGGGAYGKTPATRPFYADTARRSRTTERSESVSEEAEERPIRKPPLPALQNSHFTEDSSTVEGPHDGKDVKPGAEEPKDTSGMQAWHWPSFYNVVTGKTLALPNLIALQHIPLSPAGVIAKRPAPIALPNSCAA

SEQ ID NO: 136026 - protein, 117 aa, Glycine max
  Coding DNA Sequence Number=SeqID_44341
  Homolog annotation: Hit_ID=A5C7Z4; Match level="QueryCoverage=96%, HitCoverage=40%, E-value=7e-07, Identity=28%"; Hit description =Putative uncharacterized protein
MVVIVPKEHLVVWFCLLHNRPDNYLKGIIISALKGLDDAPQPKSKAPARWIVAKCNRQKGSTECGYYIMHWMSTIILGSFRNNWEAYFNDPRPLEPERLKALRIQWAHYYLRVRAQS

SEQ ID NO: 136027 - protein, 117 aa, Glycine max
  Coding DNA Sequence Number=SeqID_44342
DAGSRQARQGASAGVGGCRGWLNYAASEQIVLRVHHMRAIGAGLFAITPAGERGMCCKAIKLGNARVFPVTTLSTLEDPRLNCYSPYGGPTTSKGGSWQSSVVSGGGGGGWGCWERV

SEQ ID NO: 136028 - protein, 90 aa, Glycine max
  Coding DNA Sequence Number=SeqID_44343
MRTRSPLKARACSPLMARTYSPLKIDCPFGKGDNSCNPYPIFCKSFRELPQSVRLRFMHGAFHCPSVGLRGTIVVFRHDLVARNLLGENF

SEQ ID NO: 136029 - protein, 50 aa, Glycine max
  Coding DNA Sequence Number=SeqID_44344
MDLMRAAAWKAGKEDALSSKSLEKRDSRPHYREQKKEWIPRCHYCGKYGT

SEQ ID NO: 136030 - protein, 56 aa, Glycine max
  Coding DNA Sequence Number=SeqID_44345
DFTFVVVATYPSAGGRRVTRGMRVPRKEYARSRHQRLFEENVGKTGKDAIYELLSE

SEQ ID NO: 136031 - protein, 130 aa, Glycine max
  Coding DNA Sequence Number=SeqID_44346
MRFHCHQASRRLSMITDSPLLPMFPRTREGDARLTGASSKGGKCSESPPTFILRKTLEKSKHASTNFKYERFRSCFYTRGREKNKSHEDSTSGGFNPFSVSLTFGNSIGAVRGKKSEESQDTSRDAAIAG

SEQ ID NO: 136032 - protein, 99 aa, Glycine max
  Coding DNA Sequence Number=SeqID_44347
  Homolog annotation: Hit_ID=A5ALA4; Match level="QueryCoverage=68%, HitCoverage=9%, E-value=2e-09, Identity=43%"; Hit description =Putative uncharacterized protein
MPYFGVIEEIWELDYSEFRAPLFKSKWVNGNTGVNVDEMGFSLNKQHRCFTSKICKTQDGQWFHKEEQIDLISKNMMQHLVFVRRILSPHNFLPELKNK

SEQ ID NO: 136033 - protein, 60 aa, Glycine max
  Coding DNA Sequence Number=SeqID_44348
MSVRSWRGEALMDSSECKPWGVTVFECSFKPMLIPYDWSILAKHRDPDWSPYDLTLVRVT

SEQ ID NO: 136034 - protein, 83 aa, Glycine max
  Coding DNA Sequence Number=SeqID_44349
MSRNFTDYLTMGVKYLEAVKRRLHATKKWSPDEIRNIIGPVNIPTSGTCHSEGKKRHQKRQQNFSVLKAIKWDIQDISPRHRT

SEQ ID NO: 136035 - protein, 209 aa, Glycine max
  Coding DNA Sequence Number=SeqID_44350
MAFIIGESFGGGHTREGLPATLPQVVRPECQEQGPNVKTNPLASHGGASVNAVKEDGPSQAKRLGERLIDCGQLEVSIGGREEPQICMQSEEKKVPLTPKALVICFTRKGTGSTPIYPRTAPKPTPFAYQSNKAVPWKYTPPASSERVATEVDSLSAKVTNITSLSGVTRSGRVFASPHPAELPSKGKAPMVQEPTDIATPSKEVDPPV

SEQ ID NO: 136036 - protein, 78 aa, Glycine max
  Coding DNA Sequence Number=SeqID_44351
MTKARQKGYRKVEHFCSALLPLFIGKRGRWLPLNSPRQARLLPPEGTAFYWKILEDPSGPDCYLYPLFTKYTPYALFC

SEQ ID NO: 136037 - protein, 248 aa, Glycine max
  Coding DNA Sequence Number=SeqID_44352
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=24%, HitCoverage=40%, E-value=2e-23, Identity=87%"; Hit description=LacZ -alpha
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTHLVRRISLLTHLFEEIKELSNNVVGGSSSSPSPSSSASSKCLLSGSSRVDLQACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 136038 - protein, 52 aa, Glycine max
  Coding DNA Sequence Number=SeqID_44353
MVIIKKGEIVEAKLHGDDKKLKDQSKNNSSESRTSQEFKIRIKKNSRLKKKV

SEQ ID NO: 136039 - protein, 132 aa, Glycine max
  Coding DNA Sequence Number=SeqID_44354
  Subcellular localization annotation: CTP_CleavageSite=41; ConfidenceScore=5.72e-01
MHNKFVHSGNTSFTAFINVWSLSVTITPGRASRFKKRSQKRCKAHTKLLTRSPSTYAKPAENVIPVGVTPTKSSNGSLYRVTPKDITNHVFILYSVPIKYIDHVQEASSNVAFQDRFLLWKNGMHFLHCISV

SEQ ID NO: 136040 - protein, 164 aa, Glycine max; identical to SEQ ID NO: 105175
  Coding DNA Sequence Number=SeqID_44355
  Homolog annotation: Hit_ID=A6FJQ2; Match level="QueryCoverage=23%, HitCoverage=84%, E-value=3e-11, Identity=92%"; Hit description=50S ribosomal protein L5

SEQ ID NO: 136041 - protein, 76 aa, Glycine max
  Coding DNA Sequence Number=SeqID_44356
HGPEIYPKAHENPRAFSCISSSIFLESSIQCPCGVGLHQGALTYCGGSISTAAHFEKLSKEFQRPPTAWEMMEKTK

SEQ ID NO: 136042 - protein, 416 aa, Glycine max
  Coding DNA Sequence Number=SeqID_44357
DFQHFGFGLGEDALLLVRDQHVVDADGDAGAGRVREAGVHQLVGEHDRVLQAQLAVAGVDQAADVLLGQLNIGQRERQAFRQDFIQQGATDRGVHDRGLVLLVAVFVGHHLGDADLDLGVQFHHAVVVSTLDFCDVGEGHALALLVFQRAGHVVQTHYHVLRRHDDRLAVGGRQDVVGGHHQRARFQLGLEGQRNVDGHLVTVEVGVVRGADQRVQLDRLAFDEDRLERLDAQTVQGRRTVQENRMLADDFGENVPDLGQLALDHFLGGLDGGGHTTTFQLAEDERLEQLQGHLLRQTALVQAQGRAHGDHGTTGVVHALAEQVLTEATLLALDHVGQRLQRTLVRAGDGATATAVVEQGVDGFLQHALFVAHDDVRSSQVEQALQTVVTVDHPTIQVVQVGSREATAIQRNQRTQ

SEQ ID NO: 136043 - protein, 100 aa, Glycine max
  Coding DNA Sequence Number=SeqID_44358
  Subcellular localization annotation: CTP_CleavageSite=51; ConfidenceScore=5.26e-01
LLHLDPKSPEAQAGNQIGQKSNGGSISPSPTTSVEGSSQNGRKQGTDETATAKKNSASYIGKRLLERTLTNDSIINFFTDPSAPQTIDSTHSSVALALME

SEQ ID NO: 136044 - protein, 138 aa, Glycine max
  Coding DNA Sequence Number=SeqID_44359
MIGKRVCLYVGPVLLKCQSSGFYQTLGFAFEGHALFGRVARDFPTVCAGCVRVIPPWERRLEDLSGRYHSHLVGDEGWQEVFVRHRDWGEFLSWPWGKVPCRVRIDAKVGIAGQASLGWSRSLRASLWTGAELEESRT

SEQ ID NO: 136045 - protein, 87 aa, Glycine max
  Coding DNA Sequence Number=SeqID_44360
IQRTNRLRILCPNTLEDKSRGYIYLGIVILRTREGTSLVDQFKWKVHPLGFFKENKGWYIPCGSLACKGFTRLKRNLKNCRLLGDWM

SEQ ID NO: 136046 - protein, 93 aa, Glycine max
  Coding DNA Sequence Number=SeqID_44361
  Subcellular localization annotation: CTP_CleavageSite=35; ConfidenceScore=5.55e-01
MRLIRSAINCWIQAQRSLRSRKFMSTASFFFLGGRCGSASSSRFCFFFAFLLLLRGDGGNRYREVAGLFTDHLIHKHLPDQVDLEEAYRSSDP

SEQ ID NO: 136047 - protein, 477 aa, Glycine max
  Coding DNA Sequence Number=SeqID_44362
  Homolog annotation: Hit_ID=Q3EBZ2; Match level="QueryCoverage=67%, HitCoverage=84%, E-value=8e-50, Identity=43%"; Hit description=F-box protein At2g17030
  Pfam annotation: Domain name=DUF295; Domain location=285-333; Score =44.3; E_value=4.2e-10; Accession=PF03478.9; Description=Protein of unknown function (DUF295)
  Pfam annotation: Domain name=F-box; Domain location=2-51; Score=18.0; E_value=0.037; Accession=PF00646.24; Description=F-box domain
  Pfam module annotation: Pfam domain module=DUF295::F-box; Domain location=285-333::2-51
  Subcellular localization annotation: CTP_CleavageSite=89; ConfidenceScore=5.32e-01
MADWSELPKDLLHKISQLLLESPLYLLRFRSVCSSWRSSTPPSPFNPSISLTNTFSLSHRTLLLLNPNSNPNPNPRPRPWLVKLSLDPHASTARLFHPLSRFPMKLPRFALDLFTLPALDLGREFLLTNTRHTRDSLYIEKLVFLPLTHRKDRFALLTIHVSGKLALFRSGEDGWTVIPDMPTPYDDVCVFKGNLYGADSNGRTVRVRPDDGGLTLAAEPVFGGDKKFLVESEGALLLVDMYLSYYSCTQGLFHEDFDEEDVAGMGWERTVKFDVFRLDEEGKKWVELTDLGERVLFLGDDCAFSASAKDLNLGRGNCVAFRDDGLDLALVGVCRVFGVVLPAAGLGRVAVTHHTWASFVASSVVGLQSYMLLSCIFQTKGLISAWLSSVSMVNCAYQCHQWKNMAEGQNSAISTCYYTLWCHHGHQVIGTSSIGLNLLKQGGGFELCRWKKRGWEGSPIKGGQPDFLAKISHQQSW

SEQ ID NO: 136048 - protein, 76 aa, Glycine max
  Coding DNA Sequence Number=SeqID_44363
MAMHCYMAHTLRFPYSSPRIHSCTELQYYEHSCLYLGLEESHHDLEFLLTPMEYDGRGNVCYYNMEQVHPVEVTED

SEQ ID NO: 136049 - protein, 76 aa, Glycine max
  Coding DNA Sequence Number=SeqID_44364
  Homolog annotation: Hit_ID=Q69FA4; Match level="QueryCoverage=38%, HitCoverage=2%, E-value=2e-07, Identity=82%"; Hit description=Gag -pol polyprotein
MRKIKRLRSDRGGEYTLFNDFCEKEGIIHEHDSKEENFKCFGRKLMQKLEEKALKKKVEIETVRLVHKTNPTSLFT

SEQ ID NO: 136050 - protein, 26 aa, Glycine max
  Coding DNA Sequence Number=SeqID_44365
MASVETSAMARSQILPLATPRLLTLT

SEQ ID NO: 136051 - protein, 247 aa, Glycine max
  Coding DNA Sequence Number=SeqID_44366
  Gene Ontology: Mol. function=structural molecule activity; Cellular component=cytoskeleton; Biological process=multicellular organismal development
  Homolog annotation: Hit_ID=A7Q282; Match level="QueryCoverage=96%, HitCoverage=40%, E-value=1e-31, Identity=62%"; Hit description =Chromosome chr13 scaffold_45, whole genome shotgun sequence
MAEYIAPVIEGAVNHIASRRFEFGGIDLTNFLAQELGKSNPLVNISISDVENIKQQYSCCVEDELAYQKTQGSCPVETHTLPDGQVHLLVPLSNNYYPMLAHLLVPDIFDQKHLNLCFELVYEVIGFLLVECYDHRGGGKAMNLSQGWACDGGFEWLNNDSGGFELNQGGRGFKQLNVAVVITIGRERYTVGEALFQPCLLGLEAHGIVEQLVHAISTVSSENHRQLLENTVVCGGTSSMTGKPLFH

SEQ ID NO: 136052 - protein, 124 aa, Glycine max
  Coding DNA Sequence Number=SeqID_44367
MNLRNNLKNLRQKQKNLILVKKKRRRTNDLKGFILQAEWRKKLIEMGAWLDTKFMKDADPYKVIEEFCCRMTGTLKEWYHNLGAVRQNQFHELRSAVAVLELSIKNVLEKERSLKERSNKNCLK

SEQ ID NO: 136053 - protein, 407 aa, Glycine max
  Coding DNA Sequence Number=SeqID_44368
  Gene Ontology: Mol. function=RNA binding; Biological process =chloroplast organization and biogenesis
  Homolog annotation: Hit_ID=A7Q277; Match level="QueryCoverage=88%, HitCoverage=86%, E-value=1e-111, Identity=58%"; Hit description =Chromosome chr13 scaffold_45, whole genome shotgun sequence
  Pfam annotation: Domain name=DUF1092; Domain location=93-404; Score =402.0; E_value=8.8e-118; Accession=PF06485.2; Description=Protein of unknown function (DUF1092)
  Subcellular localization annotation: CTP_CleavageSite=65; ConfidenceScore=5.52e-01
MATLSFNPVRIKTSTLKHSKLTTTPSKPITIPCTTPSNSHPKLLHFRTRSVSESTHQKEAPEAVLGEHEEEEDDDDDPTSELSYVDPETDPESITEWELDFCSRPILDVRGKKIWELVVCDKTLSLQYTKYFPNNVINSITLKDAIVAVSDQLGVPLPRNIRFFRSQMQTIITNACNELRIRPVPSKRVCMEKLLYGLEPHILVRGAPAYTLCGSSDPFQCVSIILWLEERYETVYRKHPGFQEGSKPLLALDNPFPTELPDILYGERWAFVQLPYSEEISTFERGVCGSGLDLELLGLDIDDKTLIPGLSVASSNATALAALINGLEVSAVEADAPRARLILSAGISTRYIYSTYKKTPETTSEAEAWEAAKKACGGLHFIAVQPDLDSEDCVGFFLLLDLPFPPV

SEQ ID NO: 136054 - protein, 1288 aa, Glycine max
  Coding DNA Sequence Number=SeqID_44369
  Gene Ontology: Mol. function=DNA topoisomerase (ATP-hydrolyzing) activity; Cellular component=chromosome; Biological process=DNA topological change
  Homolog annotation: Hit_ID=O24308; Match level="QueryCoverage=96%, HitCoverage=84%, E-value=0.0, Identity=69%"; Hit description=DNA topoisomerase 2
  Pfam annotation: Domain name=DNA_gyraseB; Domain location=75-233; Score=169.8; E_value=7.2e-48; Accession=PF00204.16; Description=DNA gyrase B
  Pfam annotation: Domain name=DNA_topoisoIV; Domain location=504-974; Score=315.4; E_value=1e-91; Accession=PF00521.11; Description=DNA gyrasetopoisomerase IV, subunit A
  Pfam module annotation: Pfam domain module=DNA_gyraseB::DNA _topoisoIV; Domain location=75-233::504-974
MGKKSEPVITKCKVGENWTKVTFKPDLEKFKMDYLEEDVVALMKKRVVDMAGCLGKTVKVELNGQVIRMKSFRDYADLYLKSVEKSRPVPLPRIHAKVGERWEICVSLSDGQFQQVSFVNSIATIKGGTHVDYVTNQITNFVMNKVNKKKKDANVKAHNVKNHLWVFVNSLIDNPAFDSQTKETLTTRLASFGSKCDIPESMLKEVANSGIVDTLLSWADFKQSKDLKKSDGTKTQRLRGIVKLEDANDAGGRNSEKCTLILTEGDSAKALAMAGLSVVGRDHYGVFPLRGKLLNVREASSKQIMDNEEIQNIKKILGLQQNKEYTSVKSLRYGHLMIMADQDHDGSHIKGLLINFIHSFWPSLLKVPSFMVEFTTPIIRAFHSNGTKLSFYSMPEYESWRESLGNNANGWKIKYYKGLGTSTPQEGREYFQDLDKHKKDFVWDDEQDGGAIEMAFSKKKAEDRKIWIRNFEPGTCRDHMAKYINYRDFVNKELILYSRADLQRSIPSMVDGLKPGQRKILFCSFKKKLFKEIKVGQFIGYVSEHSAYHHGEQSLASTIINMAQDFVGSNNINLLKPNGQFGTRNLGGKDHASARYIYTELSTITRCIFHEDDDKLLEYLNEDGRCIEPTWYIPVIPLVLVNGSEGIGTGWSSYIPNYNPRDIIANVRRLLSGETMVPMDPWYKGFKGTIERSPKEGGYIVNGSVEEINEHNFRITELPIRKWTQDYKQFLESITDGSPNVKDPLIDDFRQNGDDATVNIEVRMKLEKIVGIMQEGLLKKFKLTSSISTNNMHLFDAEGKIKKYDNPEQILEEFFPLRLEYYERRKNHILNNLERLLLILDNKARFILGVVNGEIIVSNRKKADLLIELQHKGFTPMPRKGKSAEPQVAGANEDQEDDNTREQETESVEVAKGGDYEYLLSMSIGTLTLEAVQKLLAEKAEKEKEFKILKETPSKSLWLKDLDELEKKLDDIDSIEAEEERKRSSQANRKTKEAFTKAAKKPPQPRKYTKKAKNVEPENDNSSMEVENVAEVVKPKGRAGSNNTQKNTLPVAEDDEILSLQERLAAYNFGASSDISAGMETEEPPAPAEKKEAPKRRGAAKKMSSAIVLDDSDSDNEIHDVEDDDDNFEIMQPVALEAGKKKGGRKPAAQNAKKAPAAASTKKRNVGGKQSQLLGQKLITDMLESTGISPEKKVRKMRASPFNKKSSSVLGRVAAADKDDSVSEDLSGDSAGSSPRITEEVVEIAPPPARARPQRANRRQTTYVLSESESDNDSDVDEDYSDFEEDED

SEQ ID NO: 136055 - protein, 531 aa, Glycine max
  Coding DNA Sequence Number=SeqID_44370
  Gene Ontology: Cellular component=cellulose and pectin-containing cell wall
  Homolog annotation: Hit_ID=A7Q261; Match level="QueryCoverage=61%, HitCoverage=89%, E-value=1e-154, Identity=79%"; Hit description =Chromosome chr13 scaffold_45, whole genome shotgun sequence
  Pfam annotation: Domain name=DUF642; Domain location=46-362; Score =651.1; E_value=9.3e-193; Accession=PF04862.3; Description=Protein of unknown function, DUF642
MAVTLTSTLFLALLFAASAFAALQPRVPEAYLQNGNFEEQPNPKYLKKTKLFGKYALPKWEINGLVEYVSGGPQPGGMFFPVTHGIHAVRLGNDASISQSIKVKPGQLYALILGASRTCAQDEVLRISVPPQTGDVPLQTLYSLNGDVIAWGFKATSSVVKVTFHNPGVQEDPSCGPLLDAIAIREFYPPMPTRVNLVKNPGFEEGPFPIFNSTNGVLLPPQQQDGFSPLPGWIIESLKAVKFIDSKHFNVPFGLGAVELVAGRESAIAQIIRTVTNKVYNITFSVGDAKNGCHGSMMVEAFAAKDTFKAPFKSEGKGTFKTVSFKFKAIAPRTRLTFYSSFYHTRIDDYGSLCGPKGYHWCVDAEEALDKDEEVHDDTDEELNLSEGGSKVGVCFDLGFMGLPYHCGLNGVHTNHALSSQQRHQHDLDLDLERKVQDNDGVGGGSGGCNDIGGGCGDKGDGSDSDNNDDVGNDNGGGSGASVMVVIVSFGGDNDVDGGSVVVAMTKMILVVKYSDGDGGSDNGSGGNGGS

SEQ ID NO: 136056 - protein, 167 aa, Glycine max
  Coding DNA Sequence Number=SeqID_44371
MTYNLLTDPYKDEYLLWTMLEWFSPLAWWRMKLKQIIDIERQRGISEDHIGELVSIVIIHHPYFMEQEQLWFRNEAQIWRTFEAYPLEESYRNQLARHLGEVNNYSYRPLDPNLPSSSQRPRDSNPTDRIILQNTNDGRIDTEIYVPEPEFQKVEDLGDDYSALEQD

SEQ ID NO: 136057 - protein, 237 aa, Glycine max
  Coding DNA Sequence Number=SeqID_44372
MKVNKECDALDCYGNCLTKMVTIKGVLLNAIIIINDEKENLRGAFVAAVELLIAIEAKAVLVPFEGVGSNEGGEDTGLTLPRNAWTSKRISGVSLEMKQLKRNDGGRPIMWLAKFSNLERACRKTDQDIQSRGSLSSNRGTSSFMRWEFTEVAEEGVVVEEDGEEVVESLVAKVWIYSSSFSVMVWMVSLRDKWFEVSFTMASSSLSEDTFERVDSTMGEGQGEHQNVRLITHNSGL

SEQ ID NO: 136058 - protein, 126 aa, Glycine max
  Coding DNA Sequence Number=SeqID_44373
MVQEYAEVQNQSQNRTEEQNRTGVAGVGVSRSAEHWSRATTTALGTDSGRKAEQQRRRNGRWMERRAATTVLGGTKNRSATLRCNSGCSSHDPKPSRYTRVRRGWVPLRSAAIVAAIHNIARDKEN

SEQ ID NO: 136059 - protein, 500 aa, Glycine max
  Coding DNA Sequence Number=SeqID_44374
  Gene Ontology: Mol. function=phosphoinositide phospholipase C activity; Biological process=intracellular signaling cascade
  Homolog annotation: Hit_ID=A2Q4S5; Match level="QueryCoverage=62%, HitCoverage=61%, E-value=7e-34, Identity=29%"; Hit description=IMP dehydrogenase/GMP reductase, putative
  Pfam annotation: Domain name=DUF1723; Domain location=216-264; Score =34.9; E_value=3e-07; Accession=PF08330.1; Description=Protein of unknown function (DUF1723)
MQEHQIQMQKWCRSHPRPLLESDCYVCEICNQDSRETRTFRCTGGGTRASPGAAVKLCLGDLLVMGSNPETASLHMQGFLLCAVVAHIARERKRNRRRHLSSLRRKSQFPLCRSVASLVIMVRTGGSGWTLDRVIRKALVAPVVEHVDHATKEVHEQPQEAPGDDVVSVVEGFPGGPYDTLVLMDYAYHVTVTVWNKEEHPELKLSSHVRKVEKFGRHAPEIEGLERWHKETSSFHIPIGEVTITLDDVTSLLHLPITGAFHSFETLHVDDVIFLLVELLKVSFEEDKSWDGIMPQGICCTLFANKSATHVHVVFLDAFRDLTQSGSYASGAAALVHMYDILNDASKSSARQLAGYITLLQHFPSIVFAITARDYDERKPHACRWKSGKALSMLTYCKHLDVLVSYAICWIPYSDHRAFREFELISLFFRHMCWGPSIIIHRPERVMRQFEYVQTIPPHPATPCLSVEEIDDRWIQFFEYLALVGQACVAPRQCATDYME

SEQ ID NO: 136060 - protein, 82 aa, Glycine max
  Coding DNA Sequence Number=SeqID_44375
MSDIKQVQEQMTTMMEAMMSIRKIMEVQSKHSFPPYDLPPNYTPHTVVYAHGENISSSAPVLIENQQPQPDHTHAFVSQTMG

SEQ ID NO: 136061 - protein, 152 aa, Glycine max
  Coding DNA Sequence Number=SeqID_44376
MKECTWRWKRLANTNFIKAELPHFIPHKASVSLSTQMFWLRVFLNSTTELMFPSLHFFSVKVLREHLPHVLLITHYRNLPYDGRVGKKPKERLPKRKTRGSRRQRLFEENVRKTKKTKGKWALGAMAARPSELMLTPEVTASPSQAGSFILK

SEQ ID NO: 136062 - protein, 327 aa, Glycine max
  Coding DNA Sequence Number=SeqID_44377
  Homolog annotation: Hit_ID=UPI00006A2D9E; Match level="QueryCoverage =46%, HitCoverage=86%, E-value=1e-11, Identity=17%"; Hit description =UPI00006A2D9E related cluster
MVAIIPARVPQPPFFRGYDSNATCAYRGGVPGHSIEHCMTLKHKVQAIGLFAQATCAPKFFDFQDRSIRDYSSCTLVGVMTKDKVDTSKPYTGAIRGTVHEPQANLGADQKYSPVDGGPLGTSTLTFRGLHVLTFRGPHALTFKGLHALAFRGLHVLAFRGLHVLAIKGQHGYMHALRGLRILIFRGLHALAFRGLHALTFRGLHVLTFRGLHVLAIRGLHVLAFRGLHALTFRGLHVLTFRGLHVLTFRGLHTLSFSGLHALAFRGLDALAFKGLSCRDRAHKTPSGPGEVQQGLGVSSSDYGPLARHHNSLGMADSGQQAHCHHL

SEQ ID NO: 136063 - protein, 258 aa, Glycine max
  Coding DNA Sequence Number=SeqID_44378
MALVKEFYTNLFDPEDNSPRQVRVRGKLIKFDAKTLNTFLETPMVFGPGELYSTYSRFCHSHPDPQELVARLCITGRGFVLNAEGAPWKLLRKDLTTLAQTWSVLSYSNLAPTSHTSDLNMDRAWLVMKMDMDLGSIISGQISQMAQSNSSQLEFPALITALHIARGVVPDSLTFKSLSPAINLVYIRKNYWNPEDPTITFPRSRKPRARGPLDTSTSTPTPTPAPTPALAPVPVPLPAPTTPSDTSMQTLNVIVPML

SEQ ID NO: 136064 - protein, 100 aa, Glycine max
  Coding DNA Sequence Number=SeqID_44379
MSLSSPKRGRLLSLDSPLSSRRPNPTLDFDDYKERAMHTASFYKTTVFSRHIVDLVMNPSLKSKKVFHAQDFNNEIYQVKMSKGSLKRSAIKLVDDALCT

SEQ ID NO: 136065 - protein, 112 aa, Glycine max
  Coding DNA Sequence Number=SeqID_44380
MPHIFQGCQVEYVKYNTTQSHTLKKQQTNEHTSAKQSIWDHDSLPKRAGYFTMKLFRGLGELGVRKSLKMSLLPSPLGIFVFFSKMLKNLSYCAVTGIKQLNLACKDENFSK

SEQ ID NO: 136066 - protein, 29 aa, Glycine max
  Coding DNA Sequence Number=SeqID_44381
MAIGTATPPNCVIGVYTAEVGLGWVGSWA

SEQ ID NO: 136067 - protein, 142 aa, Glycine max
  Coding DNA Sequence Number=SeqID_44382
  Gene Ontology: Mol. function=protein dimerization activity; Biological process=DNA integration
  Homolog annotation: Hit_ID=A3B418; Match level="QueryCoverage=60%, HitCoverage=12%, E-value=6e-13, Identity=43%"; Hit description =Putative uncharacterized protein
MWSYHICCSSFRKGEEIIDEADDNGWECDARNKATVTEVFAMQLKTEVPVLEDHSRVAPHRDEEISREKMKCFRRLFPNNDDFDKVYDEYAQFSLMTGPFENPTSLTKRYSLDPRNWWANFRAKTPFLQSLAFKLLGQPILL

SEQ ID NO: 136068 - protein, 187 aa, Glycine max
  Coding DNA Sequence Number=SeqID_44383
MSDGFCGTHLQIMVRTRGLGRALGQVTGRGVGRGDRDDSDDAPQRRRPTASTRRQRVAVTADHVDESVIPAPDVQDDSMEAPAAVEDIPANIPADTGAKAAEDQPQGFSGGPSDPSVLTAFADHVACKVWTGEERPELKLSSHRRKVHNLGRPVPAIEGLIAGTGLSPLIACSVDTGDRGLLSAFVD

SEQ ID NO: 136069 - protein, 62 aa, Glycine max
  Coding DNA Sequence Number=SeqID_44384
MDSRQYISPPSSKPAYGRKRLSNVEDCLMSTVLALTSRRVDVACQAPEPGLARSDMSGEGSL

SEQ ID NO: 136070 - protein, 458 aa, Glycine max
  Coding DNA Sequence Number=SeqID_44385
RADNFIQKQACSPRRVGYFMMKLSSSIRLARIKTLANEGPWTKLGYDTGYVWVRGNVLKNKSSFTSVVSVAALQCQVKLWRWVVHPSSVCIGACLRSWDLTALPCALLEHLNVALPQLHPNSWAMVLATDVLVDSLSLMFNKDGEPHFRFYWQSDPARFKSFDKDLLTLVERVDKAILEQLPTLLDTRDILSLPSVSDPLAALDNKATHEAGQTYGWDCAIVTSSAPSFVLAKRKQDDGVGPQAIGLMLGAGSFSSVQDMPPTPPTVKAPVGNVIVTVTPAPPPPLVALENGQQNQETFHKVASLEAEVAKWRATTRTVWRVERLKVANATIPFAEAESESRLEEFELWATREKEANKEFKEELLVYKKEAVEQHEKGFNKVFRKAEFFSDGYEDFREQVDQGDALGFVCRESIGLTNNRPLVLRAIWRIDYGIVQPGFWASFSSIHVTRHGRHILET

SEQ ID NO: 136071 - protein, 462 aa, Glycine max
  Coding DNA Sequence Number=SeqID_44386
MAPSQLYLNNRAMMMAFEILCPFFNIRPNLNNFCYFKDRFFKVLVTDVVANGFFDDKAILEQLSTSLDARAILFVPLESDPLVALDDKFCTLSCQFKPLMKQVEPTDGTVPPSTVPPVIGERGQPVDEIGSIVGIVKVAPNARFYVLTKRKLDDDTGVQATGLTLGLGHPPSLQDVSPAPRVVEAPASTVIVVATPAPPPPHDTPATGVGAMATSVGSIATSSSNVATPLLSAGVETTNAPLMPPLPSLAPPVPPFIVLAAAVPSSSSHPHVSLDHLYDSLWGANYKPKKKTPTGFVSSCDRNLIQSVGVQNTMNSAKVFLLRSLAILKENGQRHQETLRKVLSFETEVGSVLPKLLFTRLDGDELSAHCKGLWEEKNDLAGKVEGIAAERDELAKVVVDLKAWLKESKSRLEEFELWAIRQARFFTKDLDLGLFDLFKDVKDGVLLDEEDIAAEEEAGEEA

SEQ ID NO: 136072 - protein, 101 aa, Glycine max
  Coding DNA Sequence Number=SeqID_44387
MVAGGGLESSKRVSHRRLDCVLTMGAKERDNERPQDMFYHSLSVGAKCTYQNLKMTHVRVDMTKVGFQTSHVRLRVTFVRRTREGTYKIKDSDAQIIAGSL

SEQ ID NO: 136073 - protein, 270 aa, Glycine max
  Coding DNA Sequence Number=SeqID_44388
  Homolog annotation: Hit_ID=Q84VH5; Match level="QueryCoverage=84%, HitCoverage=39%, E-value=7e-94, Identity=71%"; Hit description =Envelope-like protein
MDLIEAAGLLKTVTKLGDCYESLVREFIVNIPSDITNRKSDEYQKVFVRGKCVRFSPAVINKYLGRPTEGVVDIAVSEHRIAKEITAKQVQHWPKKGEAFCREAKREVCNPAQDWRCKLESFAVKLPIAFPTVLCGIMLSQHPNILNYTDSVMKRESPLSLHYKLFEGTHVPDIVSTSGKAAASGAVSKDALIAELKDTCKVLEATIKANTEKKMELERLIKRLSDSGIDDGEAAEEDGEAAEEEEEAAEEEEDAAEDTTSDDDDSEATP

SEQ ID NO: 136074 - protein, 66 aa, Glycine max
  Coding DNA Sequence Number=SeqID_44389
MQHLMKLLERDKYIHWHRLKEEDVYLQTNKYRLPLLDFVGVTPTGMTFSVGFAYLEGERVNMWYGL

SEQ ID NO: 136075 - protein, 71 aa, Glycine max
  Coding DNA Sequence Number=SeqID_44390
MYKYQQYSSNVTIKKIARKVNVTDLQPCYMHKLSVKHPGCRTGCHDITLQNMQIIFDSMNRLNKSITQENC

SEQ ID NO: 136076 - protein, 84 aa, Glycine max
  Coding DNA Sequence Number=SeqID_44391
MSILTPIAINASLTSKQDHVCIPKVIAAYLVVASPRVVLGFVEPWIRDVFVLDFVKPTELCRGLPRIDLGFCRPVKISKHKAWV

SEQ ID NO: 136077 - protein, 593 aa, Glycine max
  Coding DNA Sequence Number=SeqID_44392
MVLRCPTFLVLASLESRFALQPILGEAALKLSLRVCSKVILSRPSRMIPAPLPFTMEARQCKGSTCLGGCVFNEPSYHPFYEFRLSQNLLDRVVRLDYHLMTLEVEPKSSCQASSATERYRSRDAPSLGRLKTGDVAMVFLKARKACSQVSSLEKGSAAHLQYGSAFVEVGFNPPVCDHEAEELVAAYPESTFLRVEAEWHDLVAKVGIFNDECHFLLVWRMHSDLAYPIQINVVDAYSPFIVGLFDHDNIGEPSMKPDLFDEVGMEELIANLWQIMPGWIPGVISWIYVKFSAWAGLVEGQGSDLRPFVHYHDLSAFSHCWVRHAPRELALTEGGHQVNVASGLNSFACKDEEWTNVKVDSVRGGFKSLEGFPVQDSSRTSLVDKDPGHLKVLYDDGDNHEVVLVDRVDALEVPVRKGDRRETPLLVVLSSIEKAASDGVDYTSDSSALLLSASWFLFYSSGCPLGLAPAWLLSDLLTNWAKYPTYISFVWGSWMGTSRLNAFSRIMDSSSACHGLAKAAEIITKDDDKGDDKKLKGQSKNEFKMFKIESRTLQDSRGKLNSRIKNQDSRDQGSRLKIQESRKGYSRIKKKA

SEQ ID NO: 136078 - protein, 60 aa, Glycine max
  Coding DNA Sequence Number=SeqID_44393
MEANTFLPPATKSQAKYSDDKSKTGRQIPSGSLYLARKHLLERVREIKNGKIKGILRAQN

SEQ ID NO: 136079 - protein, 597 aa, Glycine max
  Coding DNA Sequence Number=SeqID_44394
  Gene Ontology: Mol. function=oxidoreductase activity; Biological process=electron transport
  Homolog annotation: Hit_ID=Q9FRK4; Match level="QueryCoverage=19%, HitCoverage=31%, E-value=1e-18, Identity=34%"; Hit description =Cytochrome P450, putative; 64213-66051
MKMIIESGTIHKDIIQENHREFTQKWLQQSIHRGLKGRRCIAQAKRHYAIFVMALMGAKGGLRSSFENHEAWPRSSNNSSMVGMGKRSLIVTEFRARTLTQANQTGLEESNNLPFDFGLLAIGITIRTDVNRWGRRLKVDTMDNLAGRRVGEGSGSKAKWNRAEVERVWISRLTCGADMGVSPKDTSAFNVTGPNPFNQAIPNTTSAPLMRNLVAVEDGTVADQDAQWRGLGDRQVQELGDAWLDEIVETKEGVETDMRGGCDLYNDVMSSISHHSCNKGPSRDEKPSPLAYGGGSCGDGQSTCPPGVSPRRRPGPDDAVSKTLEVRKAISRGNKAIAVHPLVPAQGWTIHVKRGHAGNIKFDWRSVLRKHRRRWRRKQGMGVVLVGEGIVVDQEARNCIFQSISGSLFGRVLRHGMAGVEPNVRDERDGDPWIRGILIQVRRAFGASFGPLPMGLDFTGLAASLWHRHSFIVNSNMNLLLAAVTLLVFYMVNFFYSNLWIPWRTEHYFKEQGIWGPDYRLILGNSLEIRRLYDEAKSEPTPSFDHHHVIMGRVEYVKVPFNPQSKMLFGQGLVGLEGDQWAFYRSIINLAFNFGTC

SEQ ID NO: 136080 - protein, 119 aa, Glycine max
  Coding DNA Sequence Number=SeqID_44395
MVERGHGMYYTPPIFSQYPFEGHQNDTSASEHSLGGVAETYPNFSWPTMISSQQYDAPIPTPNVLGAIPDMDEIVNPNNKYIRDIPGLAPPVSSRRLLPRKKIVPLCDLDVHVPLKRRD

SEQ ID NO: 136081 - protein, 173 aa, Glycine max
  Coding DNA Sequence Number=SeqID_44396
  Gene Ontology: Cellular component=integral to membrane; Biological process=intracellular protein transport
  Homolog annotation: Hit_ID=Q9LRP1; Match level="QueryCoverage=71%, HitCoverage=43%, E-value=1e-44, Identity=76%"; Hit description=Novel plant SNARE 13
MWDLDFSQYTPSHPTLFKAWCVDNMALRINGFERLDKIKDSNRQSKQLEELTDKMRECKRLIKEFDREIKDEDGRNLPEVNKQLNDEKQSMGLMIFYWKIKELNSYVALRKTYMNTLGNKKLELFDTGAGASEPIAEENVQLASDVPLEWRHKGHMHQACCKDNLSKDLLKIL

SEQ ID NO: 136082 - protein, 211 aa, Glycine max
  Coding DNA Sequence Number=SeqID_44397
MEAIQVWPDPETWAEFAKSRKTPNCQGIRKKAQEIQKFNDCPHVLSRGGYELLDKKLMEEKSKRGHEEHLCTESPTLNIDPPSPVVRHLKWKIACKKRHGQMTSEVAQEIADKIDILNTALGRPEHPGHVRVAGTGVTISQYFGQASRASSTSSPSINQQQLAYIIGGIKDDIRKQLQDEIRKEEQDEIRKEVQQEHKQQQKAWMRAVEEK

SEQ ID NO: 136083 - protein, 138 aa, Glycine max
  Coding DNA Sequence Number=SeqID_44398
  Subcellular localization annotation: CTP_CleavageSite=57; ConfidenceScore=5.38e-01
MSSVIYISNTSMSSVSYAFKDYNIFIYISKTSMSSAIYTFQKTTMSLFTFQRLQCLRSFTLSKDYKSSFTFQRLQCLHSFTLSKTTISSFTFQRLQCLQPFTDAILPRKGPVTRTMSKRLQEDWARVAEEGPRVHHEP

SEQ ID NO: 136084 - protein, 239 aa, Glycine max
  Coding DNA Sequence Number=SeqID_44399
MGTMWLRRGNQHIGNDDVRVFCCKLDIMKRHEFVWEPYTTTVISLLSPICVVRSDARRKTKMFVDPANAKTATLGEVAEALQYMVSPQGRNTCTFDDLVPYVEKITILSEEQERVTEPVSHGPASERQFPAQQFHMLQSSIETQGIDRRRDIVEAEEYSQQMAERGHGMYYTPQTFAEYPTQMYQYPFQGHHTDTSASQQSFGGVAETQAHFSWPTMTPSQQYHGPIPTPNAPLGTQWN

SEQ ID NO: 136085 - protein, 52 aa, Glycine max
  Coding DNA Sequence Number=SeqID_44400
MASANFLFPEGNSINRPPIFNGEGPYVPTIVERTTIDGSTTSGIRAGFLYKV

SEQ ID NO: 136086 - protein, 53 aa, Glycine max
  Coding DNA Sequence Number=SeqID_44401
MASYGGELMLDSSISLRSKAYKLHMELHHGVLEHLRLGDVLLLPLSFCSINSL

SEQ ID NO: 136087 - protein, 42 aa, Glycine max
  Coding DNA Sequence Number=SeqID_44402
IMSNYDAILPRKGPITRTMSKRLQEDWARAAEEGLRVLMNLR

SEQ ID NO: 136088 - protein, 209 aa, Glycine max
  Coding DNA Sequence Number=SeqID_44403
  Homolog annotation: Hit_ID=Q6WAY6; Match level="QueryCoverage=62%, HitCoverage=25%, E-value=1e-11, Identity=32%"; Hit description =Putative uncharacterized protein
MSSRGKKAISFLRVSPLFEQNCNCGHGFSKRFGPHKTDSERHSGPTTEVPRRQGEGYGQSRRLGPQSTLSLPTTDSKESPVVAVLADLFDTFDRRCEKSSAQIICCLPALCVRIDWDQLLAGIGGRTISWFPRLKEGKEGVLFSCGRYPIIPLVGTRGCINYNPALAIRQLGYPMRGAPTEESMSPFLVRDFGAHNSKTMLRIHKAWET

SEQ ID NO: 136089 - protein, 82 aa, Glycine max
  Coding DNA Sequence Number=SeqID_44404
MGEIEEVQERMEVLKEQMATMMEVMMSMKRIMQVNAVAVAAISTIIEVDPAPPSGLNQISHSTSGVRGKELASTGGPHCVQI

SEQ ID NO: 136090 - protein, 298 aa, Glycine max
  Coding DNA Sequence Number=SeqID_44405
  Gene Ontology: Mol. function=succinyldiaminopimelate transaminase activity; Cellular component=cytoplasm; Biological process=amino acid biosynthetic process
  Homolog annotation: Hit_ID=A4W9J5; Match level="QueryCoverage=66%, HitCoverage=48%, E-value=1e-101, Identity=94%"; Hit description =Succinylornithine aminotransferase
  Pfam annotation: Domain name=Aminotran_3; Domain location=1-154; Score=-33.7; E_value=1.9e-12; Accession=PF00202.12; Description =Aminotransferase class-III
  Pfam annotation: Domain name=AstA; Domain location=205-298; Score= -142.3; E_value=6e-06; Accession=PF04958.3; Description=Arginine N -succinyltransferase beta subunit
  Pfam module annotation: Pfam domain module=Aminotran_3::AstA; Domain location=1-154::205-298
MQGEGGVLPAQKAFLQGLRELCDRHNAVLIFDEVQTGVGRTGELYAYMHYGVTPDVLSTAKALGGGFPIGAMLTTDKFASVMTVGTHGTTYGGNPLATAVAGQVLDIINTPEVLKGVKQRHDWFVERLNAINSKTGLFKEIRGLGLLIGCELTAEFAGKAKLISQEAAKMGVMVLIAGANVVRFAPALIVSEEEVQTGEVRGVIMMVIRPVERGDLAGLMQLAGKTGGGLTSLPADEKTLSARIERALQTWQGTLPKSEQGYVFVLEDTTTGTVAGICAIEVAVGLNDPWYNYRVGTM

SEQ ID NO: 136091 - protein, 34 aa, Glycine max
  Coding DNA Sequence Number=SeqID_44406
MADQQVAKSKAKAQDVKEALLGGNLVPFKSLLVI

SEQ ID NO: 136092 - protein, 74 aa, Glycine max
  Coding DNA Sequence Number=SeqID_44407
MALTSYPRKDQAHGILGAAPSKPKEDKDIPSSQEETTSCPSSSGSEDEVRGEESSEEVYPHEEGDLLMVRRLLG

SEQ ID NO: 136093 - protein, 59 aa, Glycine max
  Coding DNA Sequence Number=SeqID_44408
  Homolog annotation: Hit_ID=A0PAV3; Match level="QueryCoverage=64%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCFYQLSLLFSY

SEQ ID NO: 136094 - protein, 238 aa, Glycine max
  Coding DNA Sequence Number=SeqID_44409
  Gene Ontology: Mol. function=motor activity; Cellular component=cell projection
  Homolog annotation: Hit_ID=UPI00016621D1; Match level="QueryCoverage =89%, HitCoverage=42%, E-value=1e-19, Identity=33%"; Hit description =UPI00016621D1 related cluster
MTGPLDESISCFLIRVDPWVLVPIAFRGLHVLTFRGLHALANRGLHALTFRGLHVLAFRGLHVLTFRGLQVLTFRGLHALAFKGLHVLTFRGPQVLTFRGLHALAFRGQHVLTFRGLHALALRGQHILTFRGLHVLAIRGLHALTFRGLHVIAFKGLHVLTFRGLHALTFRGLHVLAIKGLHTLAFRGLHVLAFIGLHALTFRGLHVLAIGELHALTLRGLHILAIQRANSPHLKRTY

SEQ ID NO: 136095 - protein, 423 aa, Glycine max
  Coding DNA Sequence Number=SeqID_44410
  Gene Ontology: Mol. function=nucleoside-triphosphatase activity; Cellular component=excinuclease repair complex; Biological process =response to DNA damage stimulus
  Homolog annotation: Hit_ID=A5CRU2; Match level="QueryCoverage=49%, HitCoverage=21%, E-value=2e-89, Identity=74%"; Hit description =Putative exinuclease ABC subunit A
RVRHDPRRGAASLRRIAERVRAPVPRPGGPARRRLHRGAEPRGVDRPEVHEPQPALDRRNDHRDLRLHAPALGAHRCAALSRVRREDPAADRPADRRSAHGAARAHALPGGGADRVPEEGRVRRSLPRARCEGLLARDRRRRAHPARRAAHAEEELQARHRRGRRPPGGLERHPRAHHRLGRDRPGPRRRRRADQLRRRRGRRRVADVLREARLPERPPLTLTEIEPRTFSFNAPFGACPACSGLGTRMSVDVDLMLGDEELSIREGAIIPWTTQGKGLFQYYERLLEGLAADLNFSLDTPWQDLRVDVQDAILRGDNYKVSVKWKNRYGREMRYTSGFEGVVPYIERQYAQAESDTQRARWGEYLREVPCPVCDGNRLKPEVLAVQVHGHSIAEVSHLSLADAREFMETLTLTDREAKIAAQ

SEQ ID NO: 136096 - protein, 67 aa, Glycine max
  Coding DNA Sequence Number=SeqID_44411
MKSDDMRGYLIVTHTVRQPWANELIDAQRLTSSSAPFVVLTREVRGKHARWRPKICIVFCTFCRLDP

SEQ ID NO: 136097 - protein, 174 aa, Glycine max
  Coding DNA Sequence Number=SeqID_44412
VDSRGSPSNRALGFPALITGLCQSFGVPVAPTKVIRPPITRAFIEKYCTQRQAQGDAPQAAGAPPPPHQAGPAGSFDMGQYLRHLVRQQAANHRAHVQTHDCLYQLSLNMQIQGFASFSCPTPDQFRAEVAWPGDWPEAQAGEAPPEAPDDGEEAHEDEEMADLLDFLGGSGAT

SEQ ID NO: 136098 - protein, 77 aa, Glycine max
  Coding DNA Sequence Number=SeqID_44413
MLENNPFNGTAHEDPMQHLRKFIKLTNTRKQESLLEALERLQEMIRSCLHHGFSPTKASSYFSITNHITHESRTGSR

SEQ ID NO: 136099 - protein, 82 aa, Glycine max
  Coding DNA Sequence Number=SeqID_44414
  Gene Ontology: Mol. function=protein dimerization activity
  Homolog annotation: Hit_ID=A2ZIT3; Match level="QueryCoverage=95%, HitCoverage=32%, E-value=9e-17, Identity=56%"; Hit description =Putative uncharacterized protein
MDDEIPVRGRSRAEGRTITNLHHYRAEIFYVAIDKICVEMDHRFSEGSSIILDCFSCLDPKNSFSKFDVDKLARLADICRLF

SEQ ID NO: 136100 - protein, 93 aa, Glycine max
  Coding DNA Sequence Number=SeqID_44415
MARSVFALCPYLRDLYGRELKGLLVIIPKAVISLLMVSRVPSGVANCRNLPFGGRATRDSWVRVPRKEYAWSRHQRLFEENVGKTGKDVIYEF

SEQ ID NO: 136101 - protein, 57 aa, Glycine max
  Coding DNA Sequence Number=SeqID_44416
MSFNAEHGLSDWSSGVMDGRNDRAIADALQALALAIGNPNRGEVSGAVEYQGLDCFQ

SEQ ID NO: 136102 - protein, 265 aa, Glycine max
  Coding DNA Sequence Number=SeqID_44417
  Gene Ontology: Mol. function=transporter activity; Cellular component= periplasmic space; Biological process=transport
  Homolog annotation: Hit_ID=A4W7V6; Match level="QueryCoverage=100%, HitCoverage=50%, E-value=1e-144, Identity=95%"; Hit description =Extracellular solute-binding protein, family 5 precursor
  Pfam annotation: Domain name=SBP_bac_5; Domain location=2-237; Score =22.1; E_value=4.2e-05; Accession=PF00496.13; Description=Bacterial extracellular solute-binding proteins, family 5
MRVYQPHQAIVLEANDSAPGGAPKLKSIIIKNVPDPASRRLLIQQGDADVARDLGADQISALDGKPGVKVLSIPSAEQNYLVFNTGNSTNPLLNNPAFWEAARWLVDYDGITKNLLKGQYFVHQSFLPVGLPGALEDNPFKFDPAKAKAILARAGIKDAHFTLDVENKPPFITIAQSMQASFAQGGVKVDLLPAAGSQVYARVRAKQHQAAIRLWIPDYFDAHSNASAFAWNDGKSSTVAGLNGWKIPELNKATLAAVAEPDPAK

SEQ ID NO: 136103 - protein, 137 aa, Glycine max
  Coding DNA Sequence Number=SeqID_44418
  Homolog annotation: Hit_ID=A5AWV0; Match level="QueryCoverage=70%, HitCoverage=6%, E-value=1e-08, Identity=34%"; Hit description =Putative uncharacterized protein
MQSSKRDVYLGAYLNGRHWQMVVILPKEHLVVWFCSLHNRPDNYHKGIINSALKDLDDAPQPKSKAPARWIVVKCNRQKGSTECDYYVMHWMPTIILGTFRNNWEAYFNNPRSLESERLKALWIKWTQFYLRVRDQT

SEQ ID NO: 136104 - protein, 195 aa, Glycine max
  Coding DNA Sequence Number=SeqID_44419
  Gene Ontology: Mol. function=nucleoside-triphosphatase activity; Cellular component=plastid chromosome; Biological process=cobalamin biosynthetic process
  Homolog annotation: Hit_ID=A9CFH0; Match level="QueryCoverage=98%, HitCoverage=51%, E-value=5e-87, Identity=87%"; Hit description =Putative uncharacterized protein
  Pfam annotation: Domain name=cobW; Domain location=7-189; Score =197.2; E_value=4e-56; Accession=PF02492.10; Description=Cobalamin synthesis proteinP47K
MSRDRIPVSIITGFLGAGKSTLLNRLLKDPDMSDAAIIINEFGDVSIDHMLVESAGEGIIELAEGCLCCTVRGELVDTLAELMDGIQTGKLKPVKRVVIETTGLADPAPVMQSVMGNPVIAQNFVLVGMVTVVDAVNGLSTLDNHQEAVKQVAVADRLVVTKRALADDATIAALTARLEALNPRAIIEDGHKGIL

SEQ ID NO: 136105 - protein, 150 aa, Glycine max
  Coding DNA Sequence Number=SeqID_44420
MIREDTLRLSAPFCHPEAAGPMTSRDQVWSFCTLVSSRGGGPDDTRRYLTVICTLLSSRGEAAGPMIRGDTLRLSAPFCHPEAAGPMTSRDQVWSFCTLVSSRGGGPDDTRRYLTVIRTLLSSRGGGPDDKQRPSLVILHPCIIQRRRAR

SEQ ID NO: 136106 - protein, 31 aa, Glycine max
  Coding DNA Sequence Number=SeqID_44421
MGQVGFVADLGMTFVDDWAFLAGRVVGNEND

SEQ ID NO: 136107 - protein, 104 aa, Glycine max
  Coding DNA Sequence Number=SeqID_44422
MGLKRGKFNHLAWTNEKTGANEEGENEGETHAATVVPTWKLPHQLNKHHYSANIIPSHYPPPSHPQRPSLNQPQSLSTTLPITNTTFSTNQNTNQGRNFATKNL

SEQ ID NO: 136108 - protein, 274 aa, Glycine max
  Coding DNA Sequence Number=SeqID_44423
  Homolog annotation: Hit_ID=Q652R5; Match level="QueryCoverage=32%, HitCoverage=36%, E-value=1e-16, Identity=53%"; Hit description =Putative uncharacterized protein P0603C10.50
  Subcellular localization annotation: CTP_CleavageSite=68; ConfidenceScore=5.26e-01
TRPRAPAILEGNFWREPATRRVSSGFAPLRHSSPSFGSRQVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFP

SEQ ID NO: 136109 - protein, 173 aa, Glycine max
  Coding DNA Sequence Number=SeqID_44424
MKDKRDEEEKLEKQKKKKDSKALSSKSKGKEKEEKDSSKKIVKKENHFARKGDIKIALLLKQSFYLILSRETSLSTAIPLKLEVIPQVKELLDEGLVRKSLNPYALFVPKIGIIRHQIPMIGGMMNVLSGATLFCKITHVPNIFMIYVHRDSLGRNNQHENKEKGMFYSITFP

SEQ ID NO: 136110 - protein, 96 aa, Glycine max
  Coding DNA Sequence Number=SeqID_44425
MAVEELHEEQQKAPVEDPPTDVEGFLGGPHDTSVLSDYENHNAFKIWNGEERPELKLSSLGRKMTKFGRLALVIEGLVGASELSSLISCSLDTGDR

SEQ ID NO: 136111 - protein, 129 aa, Glycine max
  Coding DNA Sequence Number=SeqID_44426
IAPANHTVHPEKSNRILGFPALITGLCRFYRVPATPNKVIRPPINRAFIKKYCAPQAEFAKRNLQLLSARKNPEEDELSSSLSAPFQVIKRTASAHLLSKTSVLSQNPLMRAKQSRSALSARARTRPPI

SEQ ID NO: 136112 - protein, 62 aa, Glycine max
  Coding DNA Sequence Number=SeqID_44427
  Subcellular localization annotation: CTP_CleavageSite=54; ConfidenceScore=5.38e-01
MGPKSTLRLMRTLGPSLASLAQSTWSLLSNALAGLFGMNWKTKDSPSSFTGRNVSSMKTSIN

SEQ ID NO: 136113 - protein, 139 aa, Glycine max
  Coding DNA Sequence Number=SeqID_44428
MDEKTKKRLEEAAQSGSTEGVIDHASPIRCHVKWKMARTKKTGQMTFEAAKEITEKIDSLDEQASQGSRLEHPCRVRAAGAGVTIKQYFRSAPQTSRSSSSMNPEDLQQLTQQLRDQLEESITKKVTRQLMTSFSQIQS

SEQ ID NO: 136114 - protein, 27 aa, Glycine max
  Coding DNA Sequence Number=SeqID_44429
DSVEILHRSSSFFTVLHPFFVRSSFFN

SEQ ID NO: 136115 - protein, 107 aa, Glycine max
  Coding DNA Sequence Number=SeqID_44430
LASGSPGPPNYFKVKEPARLGEPVTLGVSISSPGRAAIAPSAHFPINRCAREDEEKFQGSVLEGIERIKKEEEEEERRGNEAEALPNHDCDQSLDRSSFGILCATVG

SEQ ID NO: 136116 - protein, 57 aa, Glycine max
  Coding DNA Sequence Number=SeqID_44431
MASIVVAIFSLMASMSAFIFSCISSALPITLALAQKWVYDPNMVGSWYLTNATKNAS

SEQ ID NO: 136117 - protein, 269 aa, Glycine max
  Coding DNA Sequence Number=SeqID_44432
  Gene Ontology: Mol. function=sequence-specific DNA binding; Cellular component=intracellular; Biological process=regulation of transcription, DNA-dependent
  Homolog annotation: Hit_ID=B0J486; Match level="QueryCoverage=84%, HitCoverage=75%, E-value=1e-68, Identity=56%"; Hit description=AraC -type transcriptional regulator domain protein
  Pfam annotation: Domain name=AraC_N; Domain location=2-118; Score =70.5; E_value=5.5e-18; Accession=PF06719.4; Description=AraC-type transcriptional regulator N-te
  Pfam annotation: Domain name=HTH_AraC; Domain location=133-179; Score= 56.2; E_value=1.2e-13; Accession=PF00165.14; Description=Bacterial regulatory helix-turn-helix proteins, araC family
  Pfam annotation: Domain name=HTH_AraC; Domain location=185-229; Score= 16.1; E_value=0.035; Accession=PF00165.14; Description=Bacterial regulatory helix-turn-helix proteins, araC family
  Pfam module annotation: Pfam domain module=AraC_N::HTH_AraC::HTH _AraC; Domain location=2-118::133-179::185-229
MGDDVMHYGPGDLLLVTMDMPVQSCVVLATPEKPCLGVGITINEARLLRYLEHFPPQQIGSAAPERSITVHKVAPPLVDAVMRLVALLDQPQDIAALAPLIEQEIFYRLLTGPEGPRILNMALTERPGNKVARAARWLRENFHQPLKVDQLASSVGMSISSLHHHFKAVTAMTPMQYQKQLRLSEARRLMMIEKLDAGTAGYRVGYQSASQFSREYSRFYGQSPARDVRKMGGGAGRTLPTAVRLTACVRLPSPARTNAGAPADRKSGR

SEQ ID NO: 136118 - protein, 90 aa, Glycine max
  Coding DNA Sequence Number=SeqID_44433
  Homolog annotation: Hit_ID=A5C693; Match level="QueryCoverage=80%, HitCoverage=32%, E-value=2e-11, Identity=41%"; Hit description =Putative uncharacterized protein
MASLYSLSFKSIFRNKLFQDHDEDQVNLCLMTKSDENNNEDSVRKKWYIDSGCSKHMTADVSKFTTISPKKSGHVTYGDNNISKISKEDN

SEQ ID NO: 136119 - protein, 55 aa, Glycine max
  Coding DNA Sequence Number=SeqID_44434
MDEDQWMYDSIMSKEVDMDDQNEQECGVNEQHVDCSNAFNTSQVFGIRDDVLQWA

SEQ ID NO: 136120 - protein, 133 aa, Glycine max
  Coding DNA Sequence Number=SeqID_44435
MISEVVIIKKGEIVEAKLHDESRLIQRCFDDNKDDDKGDDKKLKDVQDRIKNTSRFKRKVDFKNQESRFKDQAFKNQAQDSRLKIQESREGLIKISMKRFFQKVSSTGMFLKTCLPKSFYSLVIDYQIVVIDY

SEQ ID NO: 136121 - protein, 110 aa, Glycine max
  Coding DNA Sequence Number=SeqID_44436
  Homolog annotation: Hit_ID=A5BU71; Match level="QueryCoverage=86%, HitCoverage=4%, E-value=3e-11, Identity=37%"; Hit description =Putative uncharacterized protein
  Pfam annotation: Domain name=G-patch; Domain location=56-100; Score =11.0; E_value=0.0087; Accession=PF01585.14; Description=G-patch domain
MGISSTYSFLLGRPWIHSVGVVPSMLHQKLKFVVEGQLGYSIRRGRHTMQPRLSGATLMVARVMSRDRYEPGMGLGRNEDGMASLVEFTENHGRFGLVTSLHMLTRKGSP

SEQ ID NO: 136122 - protein, 78 aa, Glycine max
  Coding DNA Sequence Number=SeqID_44437
DTLDEILKDAKYHSYFRDCIGAIDDTHIQVGKILHMILRYLWRLNVSLHCIFHILLKGRKGKLGIISHNLELSLESRR

SEQ ID NO: 136123 - protein, 86 aa, Glycine max
  Coding DNA Sequence Number=SeqID_44438
MKKEITSGQLANAKLAGVGGRLKNNGMCIGLVPYLHCSSVVPEFASLFLLILFMFMCELKLPAEDQKGLKRKIITTIKTKRVVKPK

SEQ ID NO: 136124 - protein, 146 aa, Glycine max
  Coding DNA Sequence Number=SeqID_44439
MTSPLDEPISCFLIRVDLWVLVPSLLEDYTSLPSEGYTPSTLEDYMSSPSKGCTPSPSEGYTASPSGGLHVLTFRGLHALSFKGRHILNFRGLHALAFRGLHTLAFKGRHILNFRGLHALAFRGLHVLTFSGLHIHILREFKVLCP

SEQ ID NO: 136125 - protein, 124 aa, Glycine max
  Coding DNA Sequence Number=SeqID_44440
MELRHLNQNEEIDKKKRSIALKASSSMQEENEEEESDDEEDFSLFVKKFQKFVKKRRIERHQNFNNGRRSQEDSQKSDKKRYDERRTKKAYIAWDDNDSSNGSEKEINLLTKDYESDENISQED

SEQ ID NO: 136126 - protein, 147 aa, Glycine max
  Coding DNA Sequence Number=SeqID_44441
  Gene Ontology: Mol. function=helicase activity; Biological process =viral genome replication
  Homolog annotation: Hit_ID=Q2A9E0; Match level="QueryCoverage=100%, HitCoverage=10%, E-value=2e-27, Identity=43%"; Hit description =Putative uncharacterized protein
MADDITFNHRKQGIHLTEKETIHLCLTEIENMLQANRRSLRDFPSMPYPIGYAPNQHHNKLIHNEMAYDKEMLAAEFNTAYHLLTDEQKTIVDIIMRVVNTQSAAVYFLYGYGGTGKTFVWTTLSSAICSNGGIVCTVASSGIASLL

SEQ ID NO: 136127 - protein, 73 aa, Glycine max
  Coding DNA Sequence Number=SeqID_44442
MAIQPEESRADQKVEGFKQQLVDEPTLEPVDDLVELEEIVEEAEEKVVEIEKKKGKSEANIEKKTEATPIVIP

SEQ ID NO: 136128 - protein, 100 aa, Glycine max
  Coding DNA Sequence Number=SeqID_44443
MHRSPKGNLVPLDLEIEATLRRNRAERTRKLLQDKTVASILEEETHFFYSSSPDSPSSRESATYFPEVVSMANKHQQRVTLKDDSSSSVLQFFTSIARPE

SEQ ID NO: 136129 - protein, 115 aa, Glycine max
  Coding DNA Sequence Number=SeqID_44444
  Gene Ontology: Mol. function=hydrolase activity
  Homolog annotation: Hit_ID=Q2HAQ6; Match level="QueryCoverage=91%, HitCoverage=12%, E-value=2e-10, Identity=31%"; Hit description =Putative uncharacterized protein
RDALPGVIVTDRDLALMNAVKIVFPECTNLLCRFHIDKNVKAKCKSLIGQKNAWEYVMDAWGSLVDCPSEHQFNDCLKKYALNQIAAEYDRVHYADKNPSHYGCVMRTTHGFPCA

SEQ ID NO: 136130 - protein, 37 aa, Glycine max
  Coding DNA Sequence Number=SeqID_44445
MERNSPLPLGDQPESQGSSKPSDMPPSTSIPPHEKLQ

SEQ ID NO: 136131 - protein, 92 aa, Glycine max
  Coding DNA Sequence Number=SeqID_44446
LGRIDGDPVLRETRIWATWEYVSSVGGEQQGMSVPGDMSRGSGDLGDVRRAPGSQQIKGKQDHKARRLVVAGQLLENEVRKLRKPLVIDYQG

SEQ ID NO: 136132 - protein, 163 aa, Glycine max
  Coding DNA Sequence Number=SeqID_44447
MGDQEETQEQMKADMSALKEQMTSMMEAMLGMRQLLEKNVATAAAVSSAAEADPTLLATARHPPSNIVGRGRNTLGHDGNPHLGYNRAAYPYGLLPNYSPPVLQDDAGHIASPVLEREPPQRSNYEVHEDPQDYARRDVEFYPPIPEGPEPSTLPQPNITTHQ

SEQ ID NO: 136133 - protein, 230 aa, Glycine max
  Coding DNA Sequence Number=SeqID_44448
  Gene Ontology: Mol. function=protein binding; Cellular component =integral to membrane; Biological process=protein amino acid phosphorylation
  Homolog annotation: Hit_ID=Q1SWI6; Match level="QueryCoverage=80%, HitCoverage=73%, E-value=4e-30, Identity=41%"; Hit description =Leucine-rich repeat, plant specific
  Pfam annotation: Domain name=LRRNT_2; Domain location=27-67; Score =41.5; E_value=3e-09; Accession=PF08263.3; Description=Leucine rich repeat N-terminal domain
  Pfam annotation: Domain name=LRR_1; Domain location=112-137; Score =5.8; E_value=26; Accession=PF00560.24; Description=Leucine Rich Repeat
  Pfam annotation: Domain name=LRR_1; Domain location=139-161; Score =9.2; E_value=6; Accession=PF00560.24; Description=Leucine Rich Repeat
  Pfam annotation: Domain name=LRR_1; Domain location=163-188; Score =10.1; E_value=4.1; Accession=PF00560.24; Description=Leucine Rich Repeat
  Pfam annotation: Domain name=LRR_1; Domain location=190-212; Score =14.1; E_value=0.53; Accession=PF00560.24; Description=Leucine Rich Repeat
  Pfam module annotation: Pfam domain module=LRRNT_2::LRR_1::LRR_1::LRR_ 1::LRR_1; Domain location=27-67::112-137::139-161::163-188::190-212
MNSSSIYILVFVQLWLLSLPCRESVCIPSECETLMKIKNNLNDPSNRLWSWNHNHTNCCHWYGVLCHNLTSHVLQLHLSSSHSPFDDDYNWEAYRRWIFGGEISPCLADLKHLNYLDLSANVFLGEGMSIPSFLWTMTSLTHLNLALTSFMGKIPPQIGNLSKLRYLDLSFNYFLGEGMAIPSFLCAMSSLTHLDLSGTVFHGKIPPQIGNLSNLYPLRSGISLSFDILT

SEQ ID NO: 136134 - protein, 132 aa, Glycine max
  Coding DNA Sequence Number=SeqID_44449
MVGYTPSSFTDLVFASERIKVGPKRGKFDHPTRTTEKTGANEEGEKEGETHAVTVIPIRPSFPPTQQCHYSANNKPPPYPPPTVTPTKVHQPSFLREYDSNATCACHGEASGCPIEHCRALKCRVRGLIDAG

SEQ ID NO: 136135 - protein, 80 aa, Glycine max
  Coding DNA Sequence Number=SeqID_44450
MKGRRHKYGFNNNKREKAEKKRVVDDETGDKHQLDEIMGSPPPSTPPPPPPPPPPPSDASASPSAVKAEMQSLTSTIIVH

SEQ ID NO: 136136 - protein, 74 aa, Glycine max
  Coding DNA Sequence Number=SeqID_44451
DDVNLRVSTGLLVVIDKGDSSVSMTEFVCAEDDVNLRVSTGLLAAIDKGDSSVSMTEIVGAADKSEALAPTYPQ

SEQ ID NO: 136137 - protein, 82 aa, Glycine max
  Coding DNA Sequence Number=SeqID_44452
MCRNLPICGRARRGSWVDKSGALAPTYPPSKRKSDLRNSFKRGESSDSFLLGRWSFKALDLKLIHFYLVRKANALDLKTFFQ

SEQ ID NO: 136138 - protein, 85 aa, Glycine max
  Coding DNA Sequence Number=SeqID_44453
MLCVIDYNDLGTSFVVQVKGTSTWVVMTENKRGYISCGSVLVEGTSTRLFKENKGGYIPYGSLLVKVFTRLKRNLKDRRSLGDWM

SEQ ID NO: 136139 - protein, 69 aa, Glycine max
  Coding DNA Sequence Number=SeqID_44454
MSRNLTDYAIVPSLASGMLQNFTYYALTLPFDSRHVAKLHGLPNNGCLVPQSGQAKVASQQIDGPRMKL

SEQ ID NO: 136140 - protein, 129 aa, Glycine max
  Coding DNA Sequence Number=SeqID_44455
MVKEECKEVSVSAKRLAKKESHFAIKTNIKETSPLRQPPHLLLCKKTLVSIATPLGLEIIPHVKELLDKGLVRKSDQGVPIDVKRIKVISEWPTPTPPRGVCVAKLKHLISRSYALTSQGSFSRKLLKE

SEQ ID NO: 136141 - protein, 120 aa, Glycine max
  Coding DNA Sequence Number=SeqID_44456
MEQRGHGMYYTPPTFAQYPSQMYQYPFEGHDTDMSASEHSFGGVAKTQPHFSWPTMTLSQQHDAPMATPNAPLGQQWDVPGAIPAMDDLLGVDLHHEFSAEAEEQGRRLRARRNPDRQAR

SEQ ID NO: 136142 - protein, 100 aa, Glycine max
  Coding DNA Sequence Number=SeqID_44457
  Homolog annotation: Hit_ID=Q6CQE5; Match level="QueryCoverage=47%, HitCoverage=43%, E-value=3e-08, Identity=63%"; Hit description =Protein TAR1
  Subcellular localization annotation: CTP_CleavageSite=58; ConfidenceScore=5.57e-01
MTSKSGSESSRSSSFSSFPRGTCSLSVSRQYLALDGIYRPIGAAFPNNPTRRQRLVVRQGPGTTGLSPSLAPPSRGLGPGPPLRTLLQTTIRTPRATDFL

SEQ ID NO: 136143 - protein, 71 aa, Glycine max
  Coding DNA Sequence Number=SeqID_44458
MTPVNRKAGTGERTREPPGGNAWGAEPMEKRLCRGPLTSLLSIFLASSRKFRPVSKPFPLAAVERPSVASQ

SEQ ID NO: 136144 - protein, 104 aa, Glycine max
  Coding DNA Sequence Number=SeqID_44459
MSEIEEVQKKMKAMEEKMATMMEAMMGMKKMMEVNAAIVVAASTAIEVDLTHPSGLNQVHPPVLDIVGQGGEALGSTGGPHFVQVQNKHSFPPYSLPPNYTPPN

SEQ ID NO: 136145 - protein, 110 aa, Glycine max
  Coding DNA Sequence Number=SeqID_44460
MNPDFNQPRGGCSREVSIHPAQQHCRRALRPNGFGRNLRSKTRWFFHGILQFTPSIAFRATFFIDAEPRYPLPRVIVCKCWVVTTPAGHPLPGPRESHLTDFEFLGAQSA

SEQ ID NO: 136146 - protein, 133 aa, Glycine max
  Coding DNA Sequence Number=SeqID_44461
MPISPCGRIAPTRHLVDPEKFDRALGFPALVTGLCQSYRVPVPPARSRHREIGVAPARHPVDPKKSNRVLGFLALIAGLCQFYGVPVAPSKVIRPPINRAFIKKYCAPGRRRVRHQSSLGMAGSGQQTHRHHL

SEQ ID NO: 136147 - protein, 107 aa, Glycine max
  Coding DNA Sequence Number=SeqID_44462
  Subcellular localization annotation: CTP_CleavageSite=60; ConfidenceScore=5.15e-01
MVHDIFVKVKLEVTWISTILNVSGSRRSNDVTRSIFCPNFCKMVTSMLQLDLMTCFPKSMSSEVQPYIQDGKCTLAISAWSGNMKTKGKNAMSNATNEKDGMYANDA

SEQ ID NO: 136148 - protein, 149 aa, Glycine max
  Coding DNA Sequence Number=SeqID_44463
  Pfam annotation: Domain name=PT; Domain location=104-139; Score=6.1; E_value=0.16; Accession=PF04886.3; Description=PT repeat
  Pfam annotation: Domain name=PT; Domain location=64-99; Score=3.4; E _value=0.34; Accession=PF04886.3; Description=PT repeat
  Pfam module annotation: Pfam domain module=PT::PT; Domain location =104-139::64-99
MRGPLDESISCFLIKVDPWVLVPIAFRGLHVLDFRGLHVLDFRGLHVLASEGFTSSPSKGCTPSPLEDCTSSPSEGYTSSPSEGFTSLPSEDCTSSPLEGFTSSPSEDCTSSPLEGYTPSPQEGCTSSPSEGCTSSPSEDCTSSPSEGF

SEQ ID NO: 136149 - protein, 100 aa, Glycine max
  Coding DNA Sequence Number=SeqID_44464
  Homolog annotation: Hit_ID=A5APK5; Match level="QueryCoverage=67%, HitCoverage=5%, E-value=4e-27, Identity=91%"; Hit description =Putative uncharacterized protein
MSPPCGDMDGGEKTLALPEKEVIQPHLPVRLPCYDFTPVTSPAFGIPLLAVKVTTSGMASSHSVTGGVYKARERIHRRMADRRLLAIPASCRRVAAYNPN

SEQ ID NO: 136150 - protein, 41 aa, Glycine max
  Coding DNA Sequence Number=SeqID_44465
MARSVFAPCPYLRDLQGRELTRHLAITPQEVSSPSKNILQQ

SEQ ID NO: 136151 - protein, 128 aa, Glycine max
  Coding DNA Sequence Number=SeqID_44466
  Homolog annotation: Hit_ID=Q5QJQ3; Match level="QueryCoverage=62%, HitCoverage=89%, E-value=2e-29, Identity=62%"; Hit description =Putative uncharacterized protein
MAYERGGDFLEDARKILNREVRGPRQSRFSIGSAPLTSITKSDAQISGGETRQDYKDTRRFPLAAPSGALLQFAPSWTVCTNPPFSPTAAPYPVTIVLSPTRKDMQKHHWQQPLVIDLEELVLKSCAG

SEQ ID NO: 136152 - protein, 85 aa, Glycine max
  Coding DNA Sequence Number=SeqID_44467
MIRRGQDIYSSQDEATTSPSSSESEEEKGDQGVPTDPKRIKVIPDWPTPPSVEGRSPEYEEPRDLRSNPFQGRRDDAILPPKGIG

SEQ ID NO: 136153 - protein, 134 aa, Glycine max
  Coding DNA Sequence Number=SeqID_44468
  Gene Ontology: Cellular component=chloroplast
  Homolog annotation: Hit_ID=Q49KT9; Match level="QueryCoverage=67%, HitCoverage=96%, E-value=2e-28, Identity=64%"; Hit description =Putative uncharacterized protein ORF113
VDSRGSPAWTVRALSHMDSLMCSSAPDPEMWIIQGTLAWRTSPVRSNVDPTFSSLVGSGRSGGDHHGSSLLENSYIPYQYMDSYLSSTGLGLASMEKNGAPNNVSSQTKNYEIAPFILGDQEIGSSHKKNRMLG

SEQ ID NO: 136154 - protein, 157 aa, Glycine max
  Coding DNA Sequence Number=SeqID_44469
  Gene Ontology: Mol. function=aspartic-type endopeptidase activity; Biological process=DNA integration
  Homolog annotation: Hit_ID=A5BKB9; Match level="QueryCoverage=87%, HitCoverage=12%, E-value=3e-23, Identity=40%"; Hit description =Putative uncharacterized protein
  Pfam annotation: Domain name=zf-CCHC; Domain location=60-77; Score =27.2; E_value=6.2e-05; Accession=PF00098.14; Description=Zinc knuckle
MLVQEETRLKNQGSHSIHYVSHRGNQGAGKRFVKKHDKGKGPLRIKDGPVQIQKKASKNNNCHFCGKSGHFQKDCPKRKSWFEKKGELNALGFLTIQTISPNEKFVFMGNRVKAPVEAIGTYRLKLDTGHHLDLLETLYGKTSKTYKEKSYKKHSAS

SEQ ID NO: 136155 - protein, 82 aa, Glycine max
  Coding DNA Sequence Number=SeqID_44470
  Homolog annotation: Hit_ID=A0PAV3; Match level="QueryCoverage=46%, HitCoverage=17%, E-value=5e-07, Identity=76%"; Hit description =Restriction endonuclease
MVKVGTSFVPINVSFSPKVGPGLPGINRDTRIYLFCEVIFRHSCPSCSATDGVVRNGKNTAGHQRWQSVAVTLRVTTTPAAA

SEQ ID NO: 136156 - protein, 188 aa, Glycine max
  Coding DNA Sequence Number=SeqID_44471
  Gene Ontology: Mol. function=sequence-specific DNA binding; Cellular component=intracellular; Biological process=regulation of transcription, DNA-dependent
  Homolog annotation: Hit_ID=A2WG31; Match level="QueryCoverage=94%, HitCoverage=62%, E-value=5e-33, Identity=43%"; Hit description=AraC -type DNA-binding domain-containing protein
  Pfam annotation: Domain name=HTH_AraC; Domain location=131-174; Score= 15.4; E_value=0.044; Accession=PF00165.14; Description=Bacterial regulatory helix-turn-helix proteins, araC family
  Pfam annotation: Domain name=HTH_AraC; Domain location=79-125; Score =31.8; E_value=2.4e-06; Accession=PF00165.14; Description=Bacterial regulatory helix-turn-helix proteins, araC family
  Pfam module annotation: Pfam domain module=HTH_AraC::HTH_AraC; Domain location=131-174::79-125
MMQRRGLGDVANIQGAFRSTLTDDAQLASAIQQAWFAVHQREGRLARDQSLDHLLTLLSRHLENKPGVQLSDAQRQMHLLRDYLHDFMAQDIGLDDLSRLSGIDRFRLTRQFKQAFGQSPHAYLVRLRLRSARALLAQGVEPVQVAAQVGFADQSHLGRWFQRAYRLTPAAYQRQCTNVLYRSLPAIR

SEQ ID NO: 136157 - protein, 137 aa, Glycine max
  Coding DNA Sequence Number=SeqID_44472
  Subcellular localization annotation: CTP_CleavageSite=23; ConfidenceScore=5.05e-01
ARLALWSLGRMLLNSNVIHIHVRVVMLVCMIRTRLFAATRVKSCPDMHSRCVTASLSGCARTVGRPLISGVAQEPLKGNYWPLNRSASLGEASKGKGPYILLSPLMARTYSPLKVIGTSTQGSTFMRKQEIDSSRGT

SEQ ID NO: 136158 - protein, 143 aa, Glycine max
  Coding DNA Sequence Number=SeqID_44473
MVVSCLRRPRRELSVGAPVDPLSGSCALYTPPKVEIRSGGALGHRVRRGRHLGGQHFLRGLLLWQPCLSDAAVMMARVMLGNGYKPTQADMKRSIAGRKSSGQSSRWRQESEGSPPYHISRSFISVGLGDKGQVVAIYEDDVP

SEQ ID NO: 136159 - protein, 143 aa, Glycine max
  Coding DNA Sequence Number=SeqID_44474
  Pfam annotation: Domain name=Ins_element1; Domain location=40-117; Score=-10.3; E_value=0.0012; Accession=PF03811.4; Description =Insertion element protein
MVKVGTSYVPINVSFSPKVGPGLPGFNRDTRIYLFCEVIVRHSCPSCSATDGVVRNGKSSAGHQRWQVAVTLRVTTTPAALNAPLQGASHSPFRLRNCWEGRSVRASSLLRQLAKGGCAARRLSWVTPGFSQSRRCKTPASEL

SEQ ID NO: 136160 - protein, 100 aa, Glycine max
  Coding DNA Sequence Number=SeqID_44475
MHRSPTGNLFPLDLEIEATLRKNRAERRRKLLQDKIVASILEEGTHFSYSLSPDSPSSRESATQFPETTSMEDEQHQKITLEDYSSTSVPQLFTSIAHPK

SEQ ID NO: 136161 - protein, 146 aa, Glycine max
  Coding DNA Sequence Number=SeqID_44476
GNPSDLQPFDPEIDRTFHRLVRHHFVPFEHPEHSVIGESEHFVVGNFEHPDFEHYSFEHSDFEHSENMAQPPPHERTLREMAALDFTYESLCIQYPDEDVPYVLKTGLIHLLPKFHSLLGEDPEWQRTSYITLLQGPSQAGMTSRE

SEQ ID NO: 136162 - protein, 46 aa, Glycine max
  Coding DNA Sequence Number=SeqID_44477
MAPKKLSAKRSRRDAAAKGTSATPEFDSHRFGSTEHQQRLKAIKDG

SEQ ID NO: 136163 - protein, 59 aa, Glycine max
  Coding DNA Sequence Number=SeqID_44478
MGDFGELVLIARIFVCFYSKHLVCGTRAHCKDLVYGSRAHCKGLILSEVIQIAGCPLNA

SEQ ID NO: 136164 - protein, 67 aa, Glycine max
  Coding DNA Sequence Number=SeqID_44479
MENWRTSLLNNFAGLQTRWWRTHEQHKAMNSWVSEKSGEWRIGEQRYAITSRCSRLEGGGCMNSAKQ

SEQ ID NO: 136165 - protein, 193 aa, Glycine max
  Coding DNA Sequence Number=SeqID_44480
MMLDLEILAHFLHHFVIQIGAIISNDFPGESVSINQFPLYESDHHTPRDIGIGSHFDLFGEIIYRHENEAMTVRSLGFDGPYDIYPPHGKRPRGGHDIQRMWRNIDIVCERLTFMAFRYMGAAIAFHSEPVITCSKDLPGHSMPIGMCPKLTLMDFLNHVVRLFGIYASQEGHVMVSFVQDGTTHKETSSQSP

SEQ ID NO: 136166 - protein, 124 aa, Glycine max
  Coding DNA Sequence Number=SeqID_44481
MMGYTSSSFTDLVFASKKIEVGLKRGKFNHPAWTNEKTGANEEGEDEGETHAVTTIPVRPSFPPTQQCHYSANNKPPPYPPPSYPQRPSLNQPQSPPTTQPMLNTTFGTNQKTNQEMNFAAKSL

SEQ ID NO: 136167 - protein, 23 aa, Glycine max
  Coding DNA Sequence Number=SeqID_44482
MARPIGNPSPKPKVARYLGYACI

SEQ ID NO: 136168 - protein, 149 aa, Glycine max
  Coding DNA Sequence Number=SeqID_44483
  Homolog annotation: Hit_ID=A7UQU7; Match level="QueryCoverage=88%, HitCoverage=22%, E-value=3e-18, Identity=39%"; Hit description=IMP dehydrogenase/GMP reductase, putative
MYDQLNDASISHNRQLGNYITLLQCWIYEHFPSVKDSTADQEYDEASPRVCRWIATKKTVKSIRTPAYRERLDRLWIPDVYWIPYGEHRSVWDFQVISCYSGLLRWGPVAVYYRPEKVVRQFGYTQTIPAPPVHSWVSYDDIHDRWTHY

SEQ ID NO: 136169 - protein, 223 aa, Glycine max
  Coding DNA Sequence Number=SeqID_44484
MLGAAIENVFRRLRPFFCHQIAHFRFMEVAAEMTAKPFEVLRACNHVLRACAIETPVMMDERARHPRIGVAQGIGEGFIIGIGDFAAGKRCAMRPVAAHFRENVLEAMHAAFRQFAEGGDLAAEDVEQRRIVGFIEVEDVVAGDGGRIALAVVKQRAHAGEGMQHVFTPELFLEIAVHGGQQIFDFLLIRRNIFGAPFIGDVGGADQRLVALIRVDEDHALVV

SEQ ID NO: 136170 - protein, 99 aa, Glycine max
  Coding DNA Sequence Number=SeqID_44485
VLMITKDDDKKLKDQSKNNSSDQDRIKNNSRVQDGIKKNSRLKRKVKSQESRFKVQNFKNQDQDSRLKIQESREGLIKISGSLDTGYEYLDDATSSEGR

SEQ ID NO: 136171 - protein, 185 aa, Glycine max
  Coding DNA Sequence Number=SeqID_44486
IDAFLAFHHGKESPVIAILADMYDTFDRRCLCVRYKVTARAPRKERRIGTNSWLAWRGRPLIGSLTGRKEEPGFCPRVKDFQCSLDGNKGDPNTRVLQGVCKAWDAVQRKDKELRGSSNGIIGDYRKWLRVYTRGLDWLPKLRATREEEAEAPEESEEVQALKVELERAWAVKEKFKSTAIKVRR

SEQ ID NO: 136172 - protein, 28 aa, Glycine max
  Coding DNA Sequence Number=SeqID_44487
GAGAADEDGASDLLALDFSVPGKVAVSA

SEQ ID NO: 136173 - protein, 180 aa, Glycine max
  Coding DNA Sequence Number=SeqID_44488
  Gene Ontology: Biological process=transposition, DNA-mediated
  Homolog annotation: Hit_ID=Q1J7G7; Match level="QueryCoverage=21%, HitCoverage=55%, E-value=3e-15, Identity=97%"; Hit description =Transposase
RNIQLNGLVIGTLSNLTEMPQNVLYDAHWGYINGVGTSYVPINVSFSPKVGPGLPGINRDTRIYLFCEVIFRHRYLFGAKCVGGCCQLTDLVYDGVFEVLQWLLFLSAVPPVQLLTGWCVTAKAPPDISAGKCSGHAARRVPFAIQAAQLLGRAIGAGLFAITPAGERGICCKAIKLGNA

SEQ ID NO: 136174 - protein, 111 aa, Glycine max
  Coding DNA Sequence Number=SeqID_44489
  Subcellular localization annotation: CTP_CleavageSite=26; ConfidenceScore=5.32e-01
MATPHVFLSWNTHPASHASPSRKRVGCDNKYKGTTCPKNHLRRCNYRTFAKRGADLSKNTPKRWRDLAAQVLPPMMERETMIVMVDTLSILYYEKMVGYAPSKLCGFGLRQ

SEQ ID NO: 136175 - protein, 83 aa, Glycine max
  Coding DNA Sequence Number=SeqID_44490
MNEKTRANEEGENEGETYAVTVIPTWPNFPPAQQCHYSTNINPSPYPPPSYPQNPPTTQPMLNTTFSTNQNTNQGRNFAAKSL

SEQ ID NO: 136176 - protein, 113 aa, Glycine max
  Coding DNA Sequence Number=SeqID_44491
  Subcellular localization annotation: CTP_CleavageSite=30; ConfidenceScore=5.24e-01
MYPLLFSVTTTQVDVPSTCTTKDVPSNVLRQSSQAVSPLKLCEGETKDISGEQGLETRKLRKLLAKEEEEEVQKDVQKLCEKVIQNASQGLAFIDSSCLVKKTIGRVITLRKT

SEQ ID NO: 136177 - protein, 88 aa, Glycine max
  Coding DNA Sequence Number=SeqID_44492
  Gene Ontology: Biological process=transposition, DNA-mediated
  Homolog annotation: Hit_ID=Q1J7G7; Match level="QueryCoverage=34%, HitCoverage=42%, E-value=2e-10, Identity=100%"; Hit description =Transposase
MVKVGTSYVPINVSFSPKVGPGLPGINRDTRIYLFCEVIFRHQWLLFLSAVPPVQLLTGWCVTAKAPPDISAGKCSGHAARNHHTRRA

SEQ ID NO: 136178 - protein, 40 aa, Glycine max
  Coding DNA Sequence Number=SeqID_44493
MDIVLGLLMQSYPARALGRRLQVDWARDPREGPRVLMSLR

SEQ ID NO: 136179 - protein, 88 aa, Glycine max
  Coding DNA Sequence Number=SeqID_44494
MKPCFYIDDAPQPKSKASARWIVVKCNRQKGSTECGYYVMHWMSTIILGTFRNNWKAYFNDPKPLEPKRLKALRIQWAQFYLRVKNQA

SEQ ID NO: 136180 - protein, 201 aa, Glycine max
  Coding DNA Sequence Number=SeqID_44495
DAIGQLLGYPLVLEEGQECEYGQRRNRSDGFDEEAIAQLLCIPGQDFARTAAGRRVRIMRTNMTTLTQIWMTLLLSNILPTDHNSDLPLPKFMAPTRHPLDPDKSNRALGFPALITGLCQSFGVPVTPSKVIRPPITRAFIEKYSTQRQVQGDAPQAAGVPPPHQAGPAGLFDTEQYLRHLVRQQATNHGHMYRLMVVCIR

SEQ ID NO: 136181 - protein, 97 aa, Glycine max
  Coding DNA Sequence Number=SeqID_44496
MEERMKNVEGTVETLRNSSRKTLRSSKIGEGSCPSPRRAQLAQATTVAFLKKQQPSGGIFWRAQVGLVDYLTPIFTEDTPPLLFFVIFFRKVTETYD

SEQ ID NO: 136182 - protein, 66 aa, Glycine max
  Coding DNA Sequence Number=SeqID_44497
MTLSSWQNKLNRKTIGVNVEDDDSYTDTYVSPLSTQMTSNVIGEEEADDVHANRNDHDEGELINIV

SEQ ID NO: 136183 - protein, 327 aa, Glycine max
  Coding DNA Sequence Number=SeqID_44498
  Homolog annotation: Hit_ID=Q6WAY6; Match level="QueryCoverage=70%, HitCoverage=41%, E-value=8e-16, Identity=26%"; Hit description =Putative uncharacterized protein
MLAARSHCSCTDKGGANWDQLLANKEGASINWFPRRKEGRIRVLISCGGFPNVPLMGTRGCISYNLVLAIRQLGYPMRGPPLEEEIAPVISRGFNKTNVETLQKVRKAWEVVRKKDKELRGSNNGLIGGYQEDEEVQALRTELGQAQIVKERFKSAALKIQKENAELRDINTATTKALEQETKRACREEHGRNKFQGTLWGSNNELKLRREERDQSQVDSLILKDELKQVPRRTKSATAHEHRVADEYAQVYAVKKARGRVINSLHQEATIWMDRFALTLNGSQELPRLLAKAKAMADTYSAPEEIHGLLGYCQHMIDLMAHIIRNR

SEQ ID NO: 136184 - protein, 158 aa, Glycine max
  Coding DNA Sequence Number=SeqID_44499
  Gene Ontology: Biological process=transposition, DNA-mediated
  Homolog annotation: Hit_ID=Q1J7G7; Match level="QueryCoverage=20%, HitCoverage=47%, E-value=2e-11, Identity=96%"; Hit description =Transposase
LPGINRDTRNLFILRSDLPSQVLQWLLFLSAVPPVQLLTGWCVTAKAPPDISAGKCSGHAARRVPFAIQAAQLLGRAIGAGLFAITPAGERGMCCKAIKLGNARVFPVTTLNSMITKDDDKGDDKKLKDQSKNNSSESRTIQEFKIRIKKNSRLKKKV

SEQ ID NO: 136185 - protein, 101 aa, Glycine max
  Coding DNA Sequence Number=SeqID_44500
SAKVDVSLSELNALSECHPLSKASTCLADRRNLEGNLSCRHAFNASSAHSASYLSPSRLSASLALSKNSLTRAKRENGAKRDVKELPCYGRLNPQLGILAE

SEQ ID NO: 136186 - protein, 99 aa, Glycine max
  Coding DNA Sequence Number=SeqID_44501
  Subcellular localization annotation: CTP_CleavageSite=65; ConfidenceScore=5.20e-01
MVKVGTSYGADQRSSPKVGPLGSAYQPEHRGKCKAGVQTLTLPLTRRVNAPLQGASHSPSVRNCSGRADRCGTFAIRRQRWRRGWLRLRNWVTPFSGRV

SEQ ID NO: 136187 - protein, 54 aa, Glycine max
  Coding DNA Sequence Number=SeqID_44502
MQENELCFLENVMNSLSELDTLSEFIKLVYRAKRVHLLRMNTHPLAELPVAKRG

SEQ ID NO: 136188 - protein, 139 aa, Glycine max
  Coding DNA Sequence Number=SeqID_44503
MTLLLSNILPSDRIANLPLQKYQLVCVVPTWVRIAPTKTLVDPKKSNRALGFPALVTGLYQSYRVPVPPRQGHVIIGIAPARHPVDPKKSNRVLELSSSNYGSLASGPLLIELSSRSTAPPGRRRAKHHSSIGMAGSGQ

SEQ ID NO: 136189 - protein, 254 aa, Glycine max
  Coding DNA Sequence Number=SeqID_44504
  Gene Ontology: Mol. function=oxidoreductase activity, acting on the aldehyde or oxo group of donors, disulfide as acceptor; Cellular component=mitochondrial membrane; Biological process=metabolic process
  Homolog annotation: Hit_ID=P0AFG5; Match level="QueryCoverage=100%, HitCoverage=27%, E-value=1e-139, Identity=93%"; Hit description=2 -oxoglutarate dehydrogenase E1 component
MVQAPIFHVNADDPEAVAFVTRLALDFRNTFKRDVFIDLFCYRRHGHNEADEPSATQPLMYQKIKKHPTPRKIYADKLESEKVATLEDATEMVNLYRDALDAGECVVKELRPMNMHSFTWSPYLNHEWDESYPNKVEMKRLQELAKRISTVPDAIEMQSRVAKIYADRQAMAAGEKLFDWGGAETLAYATLVDEGIPVRLSGEDAGRGTFFHRHAVVHNQSNGSTYTPLQHVHNGQGQFKVWDSVLSEEAVLVF

SEQ ID NO: 136190 - protein, 141 aa, Glycine max
  Coding DNA Sequence Number=SeqID_44505
MEPLQMQAFRKNNGKILELTIAEVSIDAIASLTQCYDQAMRCFSYGEKPDFSSRCLPSLSRIATVVKDSARGLDRIKQTRNGIAGLPQKYLEDKARGMANQGDWVPFMDVLALLIFGVVLFPNVDGLIDLAAIDAFLCLPP

SEQ ID NO: 136191 - protein, 50 aa, Glycine max
  Coding DNA Sequence Number=SeqID_44506
MKKQQWRRSFNNDAILPPNLDRRLQENWAKDAAEDPRVLMSLRVDFGPMG

SEQ ID NO: 136192 - protein, 186 aa, Glycine max
  Coding DNA Sequence Number=SeqID_44507
  Homolog annotation: Hit_ID=Q6WAY6; Match level="QueryCoverage=86%, HitCoverage=31%, E-value=3e-11, Identity=30%"; Hit description =Putative uncharacterized protein
MGANQTGKRFYQVKIKGLDITSIKELRRLMGPLQMQAFRKAYGKILDLTIAEISTKAIASLTQYYDQPLRCFTKLYLFSGLLPSLSKIAIVVRDSTRGLDRVKQTRNDIVGLPRKYLEGKARDMANQEEWVPFMDVLALLIFRVVLFPNVDGLVDLATIDAFLAYHHSKESPVVAFLADLLDTFDR

SEQ ID NO: 136193 - protein, 84 aa, Glycine max
  Coding DNA Sequence Number=SeqID_44508
NETFSQTQPKDVDIFREGADDNSRPENADISGKGAVLRIANETFSQSRPEDADIFGKGRLRVPTDSQVTIAKGGAVDKSEAFAP

SEQ ID NO: 136194 - protein, 138 aa, Glycine max
  Coding DNA Sequence Number=SeqID_44509
MISRYVLNEIVAEYKRVAYAGKNPSRCGCVMRSTHGLPCVYQGLCETQVTIIEEMETISKCFEQLDVCGKVHLKSKLREIVYPDMNSMCPPPEKDSIENIIDIKTDGNCGYRAIATLLGMGEKSWSLMCNHIHEELTS

SEQ ID NO: 136195 - protein, 61 aa, Glycine max
  Coding DNA Sequence Number=SeqID_44510
MLESFKQQQEMSVLELYIEKDVTESLDEDDSVDDISDTDNEVPEMIPPVRIVHPAEGIISS

SEQ ID NO: 136196 - protein, 286 aa, Glycine max
  Coding DNA Sequence Number=SeqID_44511
  Gene Ontology: Cellular component=membrane; Biological process =cytochrome complex assembly
  Homolog annotation: Hit_ID=A6TDQ9; Match level="QueryCoverage=100%, HitCoverage=42%, E-value=1e-147, Identity=90%"; Hit description =Suppression of copper sensitivity protein
SVRLRAQSESNGDTRLLLDVALEKGWKTYWRSPGEGGIAPAIAWHTPLEVNWRWPTPQRFDVAGISTQGYHGDVSFPMTLRGKIPPTLSGVLTLSTCSNVCILTDYPFSLDMTAPAGERFNYDFTRAMGTLPLRDGLTSALSASYVSGKLTVTARRDAGWQQPALFIDSMEDVDFGKPSFTSRGDTLTATVPVTDSWGEAAPDLSGKTLSLVLADSGQAQESHIAIAAGSAAPGLALGWVLLMALAGGLILNVMPCVLPVLAMKLGSLVQTERRERGAVRRQFLAS

SEQ ID NO: 136197 - protein, 125 aa, Glycine max
  Coding DNA Sequence Number=SeqID_44512
MPDTRKCTTPFGRGHGGATEMQANGRGHGEVTVDRNLRETGKRELEREWWLKNNVIDIQNFNDGVFKSTVLTYLLRNLQRQAPRSTLLNVSRAMHMAHKMVTYLQNCHYYSYYDGYGGNDVDSVS

SEQ ID NO: 136198 - protein, 241 aa, Glycine max
  Coding DNA Sequence Number=SeqID_44513
ETREPCPRSPAKGHVAKVKIDADSLNTFLETPVVLEEGETLPTYSRYYRLPTDHRKIEVAFCIAGMEFILNAKGHPGRILKKDLTTLAQVWSVLSYSNLAPTSHTSDLTVDRARLIFGLVSHMDMNIGALISGQMTSITQSNCCRFWFPALITALCRARRVVSDSLTFERLSPAINLAYIRKYCWNIDYLTVAFQGTRRARARLADIPSSSAAPASTSAAPSVPAHVDSQHFEAMLQSINQ

SEQ ID NO: 136199 - protein, 110 aa, Glycine max
  Coding DNA Sequence Number=SeqID_44514
FQALLEHKISCSSLPLPSFISFFLQALIHGLLWCGISFLSSFSIPLPFIFQEAKESIDEEDPRPTSSNGGYIKTPRIELAFQIERSSPTTAPKTWSSPTSAPDSTSSIKH

SEQ ID NO: 136200 - protein, 265 aa, Glycine max
  Coding DNA Sequence Number=SeqID_44515
  Pfam annotation: Domain name=Transposase_23; Domain location=80-150; Score=-1.0; E_value=0.0015; Accession=PF03017.5; Description =TNP1ENSPM transposase
MAPDELEQLTQQIKDQLEESITKKVTRQLMLSFSQMQSQFQSQMQSQGLALPLEPKVGPLAARVSTKESCVDPSVTDPNTGDLDKCGLYISKNPPRLVALGRVYEGSTTVHNIPLLHDQVKVGVEEVKDADAPILVPTDKVNLVGQTLNTFLAWPTLLVKRLSEQVMWDAIVFGVFNQDFPLYIKHEDLSEIAHGGQCLSISIIQLWILHLTETSMRARNSDVCGFPKPQSIQRSGQSQFESESYMKNWMQNSKRDVYLGAYLNG

SEQ ID NO: 136201 - protein, 73 aa, Glycine max
  Coding DNA Sequence Number=SeqID_44516
MIYVVKNVRIPKYLDLEWFSQQVFNFPNLLEAQGLSKMALDLLHQWSHLLLEDQWQGNGAGGKVIGDVTLRRR

SEQ ID NO: 136202 - protein, 104 aa, Glycine max
  Coding DNA Sequence Number=SeqID_44517
MWMDRFALTLNGSQELPRLLAKAKAMVDTYSAPEEQMASMMDAMLGMKQLMESNAATAATVSSAAKADPTLPTAAHPPFSNVVEREKSTQGHVSNPHPGYNRGG

SEQ ID NO: 136203 - protein, 88 aa, Glycine max
  Coding DNA Sequence Number=SeqID_44518
  Subcellular localization annotation: CTP_CleavageSite=46; ConfidenceScore=5.44e-01
MASNPSRAQKKAKTSKTKQAQALSNLVWMKGTFCPKLVKVFYTYASADLEGNLFSTVNGVEMVIYVVGWKEVADLDMGGVRKFDETDD

SEQ ID NO: 136204 - protein, 241 aa, Glycine max
  Coding DNA Sequence Number=SeqID_44519
  Homolog annotation: Hit_ID=Q6UUU1; Match level="QueryCoverage=24%, HitCoverage=40%, E-value=3e-18, Identity=78%"; Hit description =Putative uncharacterized protein
  Subcellular localization annotation: CTP_CleavageSite=52; ConfidenceScore=5.00e-01
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGAIDDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136205 - protein, 280 aa, Glycine max
  Coding DNA Sequence Number=SeqID_44520
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISASTKLTCMDVVVADEVWMQSIGDMEPFPKNEVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136206 - protein, 188 aa, Glycine max
  Coding DNA Sequence Number=SeqID_44521
  Gene Ontology: Mol. function=helicase activity; Biological process =viral genome replication
  Homolog annotation: Hit_ID=Q2A9E0; Match level="QueryCoverage=88%, HitCoverage=11%, E-value=3e-37, Identity=46%"; Hit description =Putative uncharacterized protein
MTVDLLEDMNSESPQASDSNSFSDDENCESNTNEAAIDTEGYSDLGDQAMQCTHCNAKMWYDERISKDRNTTSPKFSLCCGDEKVELPLLQSPPKYLERLLFDGKESDSKNYQCNIRTYNMMFAFTSAGIKLDKSINESRGPPTIRIQGQPCHRIGSLLPMPGKQPKFSQLYIFDTQNEVENRINTMR

SEQ ID NO: 136207 - protein, 58 aa, Glycine max
  Coding DNA Sequence Number=SeqID_44522
MDHGYTYGVETHERYCEERCVLTSFSTRFLKAIHLVILLPEHKVQDHHRIQTQTTHGE

SEQ ID NO: 136208 - protein, 59 aa, Glycine max
  Coding DNA Sequence Number=SeqID_44523
MSQRGSRHATSVGASSDDESHEGSNAGDPAVNFEQEASRTEDEEDEDVGLHPKMERIIA

SEQ ID NO: 136209 - protein, 202 aa, Glycine max
  Coding DNA Sequence Number=SeqID_44524
QGAPFEGTIVDDWKFDYSSHDARRMVCNDQAEMTASKEDLILMWAFLTGRQIDWAHLVWYRMHKALRANAPLPYPQLITLFLRHFQIPLDDEPFVQVKHSFAIGAGAVTSFGYHKNRNGQWLKKDALPPQDERTPSPFPQRDDSALMNEVLSELRGLRSYVGECFDSLDTRFVGMDIRLIQLEEDVCYICQSFDLPPPPPPS

SEQ ID NO: 136210 - protein, 195 aa, Glycine max
  Coding DNA Sequence Number=SeqID_44525
MVEREMIDTLPVFYYEKLVGYMPSSFADLVFAEERIEVGLKRGKFDYVSSTSTNARRIRATGEKRKEGDTHAVTSTPAWVKPPQTSHGTHQYAQHHPSFSARAGNSSNSAPVQPRAPTPIQREAPQAPAPTTTRPVGNAHFGAGSNAMRNFPPRPIPEFTPILMAYEDLFSSLIANQMVVITPGKIYQHPFPKWY

SEQ ID NO: 136211 - protein, 72 aa, Glycine max
  Coding DNA Sequence Number=SeqID_44526
MEACLWGFYGGWIFELHGRQRRRGERRRHPLGNKPWKKELHHQDEPWMRSLERMLQWRKRNRERKRTGGARN

SEQ ID NO: 136212 - protein, 53 aa, Glycine max
  Coding DNA Sequence Number=SeqID_44527
MGVQIATRPTWALQKIPPEAEALPKRFRKEFREGFDRSSTFFIRSSSFFDLQR

SEQ ID NO: 136213 - protein, 170 aa, Glycine max
  Coding DNA Sequence Number=SeqID_44528
  Subcellular localization annotation: CTP_CleavageSite=49; ConfidenceScore=5.09e-01
LIEARNQSWKPQGPVGLFQVHWVSCGGRLALRSLGRMLLSSNVIYICVRVVMLVRMVCTCLFAAVRVKSCPGMHNSHLTASLSGRARTVGPLPISGALSRRGRVVLFKVRACSPLLARTCSPLKVRACSPLLARTCSPLKVRACSPMKLRTCSPLKMRTYSPRSRGRVAL

SEQ ID NO: 136214 - protein, 173 aa, Glycine max
  Coding DNA Sequence Number=SeqID_44529
  Homolog annotation: Hit_ID=Q84VH5; Match level="QueryCoverage=76%, HitCoverage=28%, E-value=2e-52, Identity=62%"; Hit description =Envelope-like protein
IDIDVSEHQIAKEITAKRVQHWPKKGKLSAGKLSVKYAILHRIGAENWVPTNHTSTVATESFAVKLPIAFPTGTHVPDSVSTSGKAASGAVSKDTLIAELKDTCKVLEATIKANTEKKMELERLITRLSESGIDDEEAAEEEEEAAEEEEEAAEEEEDAAEETESDDDSEATP

SEQ ID NO: 136215 - protein, 253 aa, Glycine max
  Coding DNA Sequence Number=SeqID_44530
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLSVVDWGHGTRREGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136216 - protein, 50 aa, Glycine max
  Coding DNA Sequence Number=SeqID_44531
MDKSLKVGEDEWREKKRRSMKFCASIELWLSPLIQDQVQDSPLSVLSCHE

SEQ ID NO: 136217 - protein, 57 aa, Glycine max
  Coding DNA Sequence Number=SeqID_44532
PVFFLSLRVKGGVLNEFTLAQPLCTANPSSKFFYALSRRMVHLADDSPSAWPGLASS

SEQ ID NO: 136218 - protein, 280 aa, Glycine max
  Coding DNA Sequence Number=SeqID_44533
  Gene Ontology: Mol. function=catalytic activity; Biological process =cellular metabolic process
  Homolog annotation: Hit_ID=A7MJI6; Match level="QueryCoverage=98%, HitCoverage=98%, E-value=1e-126, Identity=78%"; Hit description =Putative uncharacterized protein
  Pfam annotation: Domain name=DapB_N; Domain location=1-102; Score= -38.9; E_value=0.09; Accession=PF01113.11; Description=Dihydrodipicoli nate reductase, N-terminus
  Pfam annotation: Domain name=Epimerase; Domain location=3-202; Score=- 3.3; E_value=6.5e-07; Accession=PF01370.12; Description=NAD dependent epimerasedehydratase family
  Pfam annotation: Domain name=NAD_binding_4; Domain location=5-179; Score=-88.1; E_value=0.0046; Accession=PF07993.3; Description=Male sterility protein
  Pfam annotation: Domain name=NmrA; Domain location=3-229; Score= -89.2; E_value=0.0039; Accession=PF05368.4; Description=NmrA-like family
  Pfam annotation: Domain name=RmlD_sub_bind; Domain location=1-273; Score=-188.4; E_value=0.089; Accession=PF04321.8; Description=RmlD substrate binding domain
  Pfam annotation: Domain name=TrkA_N; Domain location=3-129; Score= -5.4; E_value=0.021; Accession=PF02254.9; Description=TrkA-N domain
  Pfam annotation: Domain name=adh_short; Domain location=1-118; Score=- 56.6; E_value=0.066; Accession=PF00106.16; Description=short chain dehydrogenase
  Pfam module annotation: Pfam domain module=DapB_N::Epimerase::NAD _binding_4::NmrA::RmlD_sub_bind::TrkA_N::adh_short; Domain location=1- 102::3-202::5-179::3-229::1-273::3-129::1-118
MRIFITGATGFIGSRVVSALLARGHQVTGLVRSEEAAQQLNDKGATAQRGTLEDPHAWIAGIDQCDAVIHTAFDHDFSRFVENCEKDRRVIRAIGSVLQGSQRPLLITSGTGMGDDGSGQPALEQNFNPAHPNPRVASDWKVHNTERQGLISYYIALAREKGAAAYIGGGENAWCAAHVDDVAGLYVKVLEQGERGKRYHAVAEESIASRLIAETVAAGLGIPAVSLKPDQAAEHFGWFAAFARLDLRASGAWTRQQLNWQPKGPGLIADLSRANYSTQS

SEQ ID NO: 136219 - protein, 189 aa, Glycine max
  Coding DNA Sequence Number=SeqID_44534
MNHHSSNVNGKGTSHKDPLSRILDELSSLKLWKEKLERKEKGKERSLSEELRDYYEGRHRSHIRPHSHRREKERKPQEANINLPYFHGKDNVEAYLDWEISVEQQLKRKSPSKSYGSHSYPKKDQGQGILGVTPYKPKDDKGKTIENLDEATTSPSFSESEEAKGKNLVKKSTPRKKDNLYWLRRSVRR

SEQ ID NO: 136220 - protein, 62 aa, Glycine max
  Coding DNA Sequence Number=SeqID_44535
MSISPCGNISWSVSFRHRDRAHKTPSEPGGAQQGPEVSSSSYGPLSVLQGARPPQQGHSIMT

SEQ ID NO: 136221 - protein, 108 aa, Glycine max
  Coding DNA Sequence Number=SeqID_44536
MLAIVSRYQEELNLATTHDHGVADEYAQVYAEKKARGRVIDSLHQEATMWMDRFALTLNGSQELPRLLAKAKAMADTYSAPEEIHGLLRKNTITKRAPRHPYRTRSKS

SEQ ID NO: 136222 - protein, 95 aa, Glycine max
  Coding DNA Sequence Number=SeqID_44537
  Homolog annotation: Hit_ID=A0PAV3; Match level="QueryCoverage=40%, HitCoverage=17%, E-value=5e-07, Identity=76%"; Hit description =Restriction endonuclease
MVKVGTSHVPINVSFSPKVGPGLPGINRDTRIYLFCEVIFRHSCPSCSGTDGVAAQLLGRAIGAGLFAITPAGERGMCCKAIKLGNARVFPVTTL

SEQ ID NO: 136223 - protein, 93 aa, Glycine max
  Coding DNA Sequence Number=SeqID_44538
MKWMDRFALALNGSQELPRLLARAKAMADVYLAPDEVHGLFDYCEHMVDKSGALAPTYPPSKRKSDLLSSFLRGESSDSFYLEGGHLRRWTLK

SEQ ID NO: 136224 - protein, 76 aa, Glycine max
  Coding DNA Sequence Number=SeqID_44539
MPQNVLYDAIGIYQRWSPGLIFANIRHSGLPLSSSGTCQAAQLLNERPTRGRSGGPFAIPRALRAECAYWRYYVGR

SEQ ID NO: 136225 - protein, 90 aa, Glycine max
  Coding DNA Sequence Number=SeqID_44540
MGKQAHRCTETNIIFCTFCRPDPLKSGDMRGYLIVTRTFGQPVANKPVDARRLTSSAAPFVILTREVRGKRARLRPETKIVFCTFCRPDP

SEQ ID NO: 136226 - protein, 136 aa, Glycine max
  Coding DNA Sequence Number=SeqID_44541
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=63%, HitCoverage=72%, E-value=3e-24, Identity=67%"; Hit description=LacZ protein
MASIPARAFVHHLKSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPP

SEQ ID NO: 136227 - protein, 390 aa, Glycine max
  Coding DNA Sequence Number=SeqID_44542
  Gene Ontology: Mol. function=ATP binding; Cellular component=integral to membrane; Biological process=transport
  Homolog annotation: Hit_ID=A7MJZ4; Match level="QueryCoverage=100%, HitCoverage=48%, E-value=1e-126, Identity=60%"; Hit description =Putative uncharacterized protein
  Pfam annotation: Domain name=FtsX; Domain location=171-364; Score =53.9; E_value=5.6e-13; Accession=PF02687.12; Description=Predicted permease
MIWRWFWREWRSPSLLIVWLALTLAVACVLALGSISDRMEKGLSQQSRDFMAGDRTLRSSKPAPDAWLDKAREEGLAVSRQLSFMTMTFAQETPQLADVKAVDDAYPMFGTLQTDPPGLRPVAGTVLAAPRLLALLNLKVGDRIDVGDTTLRIAGEVIQEPDGGFNPFQTAPRLLMNLADVEKTGAIQPGSRLSWRYKFSGEAAPLARYDRWIQPQLQAGERWISVENSEDALGRSMQRAQQFLLLSALLTLLLAIAAVAVAMSHYCRSRYDLVAVLKTLGATRKSLQRLIIGQWLAVLLLAAIAGSALGQGIEVALLIMLKPVLPAALPAASVWPWLWAIGALVVISLLVGLRPYRLLMATQPLRVLRRDAVATLWPLRIYLPVMALVV

SEQ ID NO: 136228 - protein, 89 aa, Glycine max
  Coding DNA Sequence Number=SeqID_44543
GPSNVFGMGIPPTACPSVAYPRQGSKSTRLWLSALNEYGSGVIDILFGNVCHIGWCTVGRQAIWQEGVLVLNLHIMGAVPTSQIFAYHI

SEQ ID NO: 136229 - protein, 73 aa, Glycine max
  Coding DNA Sequence Number=SeqID_44544
MVAITPARVPQPPFFRGYDSNTTCAYHGGDPGHSIEHCMTLKRKVPCYKFMMKDKVDTSKPYTWAMRGTEHEP

SEQ ID NO: 136230 - protein, 82 aa, Glycine max
  Coding DNA Sequence Number=SeqID_44545
MNLVPELIPFRIQSDTPSRERKEKRAWKNLKTRNSSWQWLEVKMFSLTKPPAANLGTGTRLPTLQGPRIPVYRILLIYPHNL

SEQ ID NO: 136231 - protein, 253 aa, Glycine max
  Coding DNA Sequence Number=SeqID_44546
  Homolog annotation: Hit_ID=Q84VH5; Match level="QueryCoverage=81%, HitCoverage=39%, E-value=9e-55, Identity=84%"; Hit description =Envelope-like protein
MDLITAAGLLKTVTKLGDCYESLVREFIVNIPSDITNRKSDEYQRVFVRGKCVRFSPAVINKYLGRPTDGVVDITVSEHQIAKEITAKQVQHWPKKGKLSAGKLSVKYANPAQDWSCKLGTHQSYFHCCHRENLPLSLHYKLFEGTHVPDIVSTSGKAAASGAVSKDALIAELKDTCKVLEATIKATTEKKMELERLITRLSESGIDDEEAAEEEEEAAEEDKEAAEEEEEAAEEEEDAAEETESDDDSEATP

SEQ ID NO: 136232 - protein, 128 aa, Glycine max
  Coding DNA Sequence Number=SeqID_44547
GETPGIFIVLSGFATTDLSVRFRDACQGGGAYGKTALPRPSHFPVKYLPGIFQEISAPSRITYSAEPSLFSPATEARSLEHPGTVPTCNAYTLRPFASVIAKPASIALGLINAVGTTGFPDMEMGAAL

SEQ ID NO: 136233 - protein, 218 aa, Glycine max
  Coding DNA Sequence Number=SeqID_44548
  Homolog annotation: Hit_ID=Q84VH5; Match level="QueryCoverage=79%, HitCoverage=29%, E-value=8e-75, Identity=74%"; Hit description =Envelope-like protein
GVVDIAVSEHQIAKEITAKQVQHWPKKGKLSAGKLSVKYAILHRIGAANWVPTNHTSTVATESFAVKLPIAFPTVLCGIMLSQHPNILNNIDSVMKRESPLSLHYKLFEGTHVPDIVSTSGKAAASSAVSKDDLIAELKDTCKVLEATIKANTEKKMELERLIRRLSESGIDDGEAAEEEEEAAEEEEEAAEEEEEAAEEEEDAAEDPESDDDSEATP

SEQ ID NO: 136234 - protein, 100 aa, Glycine max
  Coding DNA Sequence Number=SeqID_44549
RKISIVTKFVKFRKVTEKELPKKKSGPLGPSRFFHQKAAASGGSNLARLGELGGKLLPYFAINRGRSEEGRGSAFLALLILSKLLRKIVSMKKIQAEALP

SEQ ID NO: 136235 - protein, 62 aa, Glycine max
  Coding DNA Sequence Number=SeqID_44550
MSSSSPPLDDKRAQNDHNLSLRAIGLNCLRMVKRVSMIEIVGRPTKARLLLLRILNEELRPT

SEQ ID NO: 136236 - protein, 112 aa, Glycine max
  Coding DNA Sequence Number=SeqID_44551
MPSYKSCQWNNKLSTTDSRHLRGARWRLAHQRCQEAAMKLQRVCFSDASETSLVMLDLIEALDETQAGQPRTQIFPSNKSPGRNLSGSKHGQTMPDFATATENPDPGLLGHS

SEQ ID NO: 136237 - protein, 51 aa, Glycine max
  Coding DNA Sequence Number=SeqID_44552
MALGLPLILLWIAIIWKAMAPKKLLSKRARKEAIGEGSNAAPQADMEFDGH

SEQ ID NO: 136238 - protein, 238 aa, Glycine max
  Coding DNA Sequence Number=SeqID_44553
  Homolog annotation: Hit_ID=A5B5V0; Match level="QueryCoverage=75%, HitCoverage=39%, E-value=2e-07, Identity=23%"; Hit description =Putative uncharacterized protein
  Subcellular localization annotation: CTP_CleavageSite=46; ConfidenceScore=5.43e-01
MFRGTSLVCVLKRKGSSSTTAATGHRRHGPSEAPTTPIHPSLSSPRSSTLFSSDDQRLRYNSQFSSRIILDPKYLDTNFFDDETFDYYQVFQNSGLVDFMSLKLPYYLELVKVFCNNLKIQDGNISSVVHGISMIIDQSLLFSLTKLPSQGAPFEGTIVDDWKFDYSSHDARRMVCNDQAEMTGRFLAGSLTFDCHIMHYIIVRILLPRSSNLAQASEEDLILMWAFLIGCQIDWAHL

SEQ ID NO: 136239 - protein, 131 aa, Glycine max
  Coding DNA Sequence Number=SeqID_44554
MIDATSGGALGDMTLVKARNLIEKMASNSQQFSARNDAIVLRGVHDVATDSSSFVENKKLEGKLDALVNLQSGVNDKRYSPGWRNHPNLRWANPPQQQQQQQQQPVPPFQNAVGPSRPYVPPPMQQQQQQQ

SEQ ID NO: 136240 - protein, 109 aa, Glycine max
  Coding DNA Sequence Number=SeqID_44555
MYTGSATTRVYIQSPNDLRSLRFLVNLIKILLQAKIHKGLDVPSTRTDPQEMYPLLFSVATTQVDVPSTCTTKDVPSNVLRQSSQAVSPLKSFVYGKGKNQKNSQTVSF

SEQ ID NO: 136241 - protein, 175 aa, Glycine max
  Coding DNA Sequence Number=SeqID_44556
MPLWGRIASDRPDHEVMWDATVFGVFNEDLPLYIKHENLSEIAHGGQCLSIFVIQLWIFNRHLTETSMRAMNSNVYGFLEPQSIQRSGQSQFESESYKKNWMQNSKQDVYLGAYLNGAHWQMAIILPKENLVVWFCSLHNRPDNYLKGIINSALKGLDDTLQLKSKAGARWIVVK

SEQ ID NO: 136242 - protein, 149 aa, Glycine max
  Coding DNA Sequence Number=SeqID_44557
  Gene Ontology: Mol. function=ribonuclease inhibitor activity; Biological process=regulation of RNA metabolic process
  Homolog annotation: Hit_ID=A7ZUE4; Match level="QueryCoverage=100%, HitCoverage=92%, E-value=2e-49, Identity=67%"; Hit description =Regulator of ribonuclease activity A
  Pfam annotation: Domain name=Methyltransf_6; Domain location=1-149; Score=241.4; E_value=1.9e-69; Accession=PF03737.6; Description =Demethylmenaquinone methyltransferase
MKYDTSELCDIYQEDVNVVEPLFSNFGGRSSFGGQIITVKCFEDNGLLYDLLEQNGRGHILLIDGGGSVRRALIDADLARLAVQNEWEGLVVYGAVRQVDDLEDLDIGIQALAAIPVAAAGEGIGESDVRVNFGGVTFFSGDHLYADNT

SEQ ID NO: 136243 - protein, 83 aa, Glycine max
  Coding DNA Sequence Number=SeqID_44558
  Subcellular localization annotation: CTP_CleavageSite=66; ConfidenceScore=5.89e-01
MKDCRNTSSGDVSSTSRTSQSLTNSSQALRTASSSSFGLYRSSHNKFSQTLRNLDLSLSKTLQLCRSFNKRPNSPQKSDFRLK

SEQ ID NO: 136244 - protein, 139 aa, Glycine max
  Coding DNA Sequence Number=SeqID_44559
  Subcellular localization annotation: CTP_CleavageSite=76; ConfidenceScore=5.64e-01
MAKPSSPANLASAIICFFASKKFPHRLKASPGRLQGKTLHHTLPSWSIFPVFRVVKRRPVNCNTTHYRANWSSTAVAAALELVDPPGCRNSIPITMKFQRLPGPVGQGYRLVEYISVARVRPRTSKGITDLLLPQTSVA

SEQ ID NO: 136245 - protein, 232 aa, Glycine max
  Coding DNA Sequence Number=SeqID_44560
  Gene Ontology: Mol. function=chloramphenicol O-acetyltransferase activity; Biological process=response to antibiotic
  Homolog annotation: Hit_ID=P62577; Match level="QueryCoverage=82%, HitCoverage=87%, E-value=1e-111, Identity=99%"; Hit description =Chloramphenicol acetyltransferase
  Pfam annotation: Domain name=CAT; Domain location=6-198; Score=424.7; E_value=1.3e-124; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAISVVLLHVFPGWTQDDSYRIRRSGRTERGVRAYSPAWSELPTRN

SEQ ID NO: 136246 - protein, 100 aa, Glycine max
  Coding DNA Sequence Number=SeqID_44561
IFEGMLRSFNSSKVIVLDGAHVHMLYVVYVHGGYIDLVGRPSCGKLKWLKNLSIFEGMLRSFNSSMVIVLDGNSLRPQVDHLRGRGSYGARLGGLDKYCM

SEQ ID NO: 136247 - protein, 62 aa, Glycine max
  Coding DNA Sequence Number=SeqID_44562
  Subcellular localization annotation: CTP_CleavageSite=33; ConfidenceScore=5.00e-01
MLTSLERAQMTTLASARQSHLGSLNDKVRITVRCLRGLPALGSWAFAPTYPQMRNSDLRSSG

SEQ ID NO: 136248 - protein, 181 aa, Glycine max
  Coding DNA Sequence Number=SeqID_44563
MVSRKRKATASVSQAGYDRSRFISQEAWDRYSDNVLARNILPERNVKLYITEFDDFRRELIGRNWHKQLTNLIEGSIDVAIVKEFYANLYDPKDKSPKQVRVRGHLIKFDVDSLNAILETPMVLEKEESIPAYSKFVRLRPDPQELAARLCIPGKGFVLNAECLPWKLLMKDLTTLAQTWS

SEQ ID NO: 136249 - protein, 63 aa, Glycine max
  Coding DNA Sequence Number=SeqID_44564
  Subcellular localization annotation: CTP_CleavageSite=43; ConfidenceScore=5.22e-01
MEAWGLLLSWFPGCSPRRANLPFFFGGNITMPPLFTATFSACPAPGRDDDRSVVTLSSICVHS

SEQ ID NO: 136250 - protein, 191 aa, Glycine max
  Coding DNA Sequence Number=SeqID_44565
  Gene Ontology: Mol. function=oxidoreductase activity; Cellular component=mitochondrial matrix; Biological process=metabolic process
  Homolog annotation: Hit_ID=Q7CSM1; Match level="QueryCoverage=97%, HitCoverage=42%, E-value=5e-76, Identity=76%"; Hit description =Aldehyde dehydrogenase
  Pfam annotation: Domain name=Aldedh; Domain location=5-191; Score= -248.2; E_value=0.00041; Accession=PF00171.13; Description=Aldehyde dehydrogenase family
MARRVSGKTIAVSDPATDEIIGAIAHAEKEDLDLGARRRRAGFQGRPTYARAQGQDRLHHDPRTGASRLAQSATEIMGAADTIDWFAEEARRTYGQVIPARATGVSQLAIKLPVGPVAAFTPWNFPINQIVRKLSAALATGCSIIVKAPEETPASPAELIRAFVDAGVPAGVVGLVYGVPSEISEYLIPHP

SEQ ID NO: 136251 - protein, 123 aa, Glycine max
  Coding DNA Sequence Number=SeqID_44566
MAFVSMIEPKNIKEAIIDDNWIIANARRTNNLKEQVLEIVEKLKISVCKMVFRNKLDEHGITYSEIKQDTQNEERNLKRKRDDEDKDDQDDTTQENDNLPKEWKTSRNHPLDNIIGDISKGNN

SEQ ID NO: 136252 - protein, 107 aa, Glycine max
  Coding DNA Sequence Number=SeqID_44567
MMVARVMLGHDYEPEMGLGKDNGGRADLERKNKGQGPRSEQQAKEVPPCHISRSFVSAGLKHEGQVAAICDEDSLRRSNLIQLCPLGFQLGNWRVEECPEVYTRSIM

SEQ ID NO: 136253 - protein, 119 aa, Glycine max
  Coding DNA Sequence Number=SeqID_44568
MNFAARKPVEFTPIPVSYADLLPCLLDNSMVAITPTKVHQPPFLREYDSNATCACHGEASGHSIEHCRALKRKVQGFSTFTGSGCKPLVCLLKRPVLLSLDFQDRSIRDYSSCALVGLP

SEQ ID NO: 136254 - protein, 38 aa, Glycine max
  Coding DNA Sequence Number=SeqID_44569
MWTTTGEELATQLAQASKVASSRSNSLLEQESGRPKCA

SEQ ID NO: 136255 - protein, 71 aa, Glycine max
  Coding DNA Sequence Number=SeqID_44570
MRTHSPLKARVCSPLMARTYSPLKIDCPFEKGNNPCNPILSFANLSGNSLRVYVLFDLVTCPFWSDDNGAV

SEQ ID NO: 136256 - protein, 191 aa, Glycine max
  Coding DNA Sequence Number=SeqID_44571
MRGASSEETIMPFITRGFNKANMKILQKIRKAWNKVGKKDKELRRRSNSVIGDYHKWLKSRTQGIAWHKKLKGLNGEEAGVPEESEEVQDLKAELGKTKVEKEKLKVVVTRVRKECDKLKDVNMSTTEALEQKMKKARKEEWSRNKFRGALLGSSNELKVSKAEKDKSRMENMMLKDKLRNFQRSKGSLKE

SEQ ID NO: 136257 - protein, 114 aa, Glycine max
  Coding DNA Sequence Number=SeqID_44572
  Subcellular localization annotation: CTP_CleavageSite=89; ConfidenceScore=5.04e-01
MLLSSNVIYICVRVVMLVRMVRTCLFAVVRVKSCPGMHSSCVIASLSGCACTVGRPPMIRGWPRNRQKETTSPLTGRRGRVPSEVQDVSPFKARECSPMMARACNPLKVRACPL

SEQ ID NO: 136258 - protein, 280 aa, Glycine max
  Coding DNA Sequence Number=SeqID_44573
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMPQPPKSRTPDRKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136259 - protein, 151 aa, Glycine max
  Coding DNA Sequence Number=SeqID_44574
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MRVLISNSFKVILRQAILVIDGVIQTPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 136260 - protein, 194 aa, Glycine max
  Coding DNA Sequence Number=SeqID_44575
  Gene Ontology: Mol. function=nucleoside-triphosphatase activity; Cellular component=flagellum; Biological process=chemotaxis
  Homolog annotation: Hit_ID=A1K4Y7; Match level="QueryCoverage=93%, HitCoverage=32%, E-value=3e-83, Identity=85%"; Hit description =Probable ABC transporter, ATP-binding protein
  Pfam annotation: Domain name=ABC_tran; Domain location=32-193; Score =19.2; E_value=2e-08; Accession=PF00005.18; Description=ABC transporter
MAQYVMSMLRVSKIVPPKRQIIKNISLSFFPGAKIGLLGLNGSGKSTVLRIMAGADKEYEGEVQWQPNLSIGYLPQEPQLDPDKTVRQEVEAGLGAIMEAKQKLEEIYAAYAEPDADFDKLAEEQAKYENILAASGSDVEQQLEIAADALRLPPWDAMIGPLSGGEKRRVALCKLLLSKPDYAVAGRTDQPPGC

SEQ ID NO: 136261 - protein, 224 aa, Glycine max
  Coding DNA Sequence Number=SeqID_44576
  Homolog annotation: Hit_ID=UPI00006A2D9E; Match level="QueryCoverage =58%, HitCoverage=98%, E-value=7e-13, Identity=16%"; Hit description =UPI00006A2D9E related cluster
SLTFRGLHVLAVRGLHVLAVRGLHVLTFRGLHALAFRGLHALAFREQHALAFRGLHALAFRGLHALAFRGLHSLTFRGLHVLPFRGLHALTFKGLHVLAFRGLHALAFRALHVLNFRGLHVLKFRGLHALAFRGLQRATRPRLQRTTRPRLSEDYTSSPSEGYTSSPSEDYTSSPLEGYTPSPFRGLHALALQRTTRPCLQRDYTSSPSEGYMSLPSEDYTSSP

SEQ ID NO: 136262 - protein, 39 aa, Glycine max
  Coding DNA Sequence Number=SeqID_44577
  Homolog annotation: Hit_ID=A5BKW4; Match level="QueryCoverage=100%, HitCoverage=3%, E-value=2e-09, Identity=74%"; Hit description =Putative uncharacterized protein
MPRTPQQNGVSERVPSKTVPKTTFELWTNMTPSIRHLHV

SEQ ID NO: 136263 - protein, 73 aa, Glycine max
  Coding DNA Sequence Number=SeqID_44578
  Gene Ontology: Mol. function=nucleoside-triphosphatase activity; Biological process=riboflavin biosynthetic process
  Homolog annotation: Hit_ID=P43329; Match level="QueryCoverage=100%, HitCoverage=5%, E-value=6e-35, Identity=98%"; Hit description=ATP -dependent RNA helicase hrpA
MATEKVTVYGLPVVAARKVNYSQIDPALCRELFIRHALVEGDWQTRHAFFRENLKLRAEVEELEHKSRRRDIL

SEQ ID NO: 136264 - protein, 99 aa, Glycine max
  Coding DNA Sequence Number=SeqID_44579
NNKRTQKHQEYQHSCQYEPQLSQQSIQSEKSKPSSMLQDGESRGAAASSVESSGMIIRGGAGGDNVSSSGEAGGSTTGGYGSADVSSVLAGTGPGGTTL

SEQ ID NO: 136265 - protein, 44 aa, Glycine max
  Coding DNA Sequence Number=SeqID_44580
MDSGRFQVSVPSSSYPRINEALGLNLELGLGLNPALGLDLKRVD

SEQ ID NO: 136266 - protein, 113 aa, Glycine max
  Coding DNA Sequence Number=SeqID_44581
AEEGLPKKVRMVEVDQSQEEKAPKKNKTHKNKKRDDDESPNAEIDEFDDEFATQIVLLIHGLWTQMKNLLTLSEEVILTSRPPGHYTTFGNGAWKVMEACLWSFYGGWIFVLQ

SEQ ID NO: 136267 - protein, 82 aa, Glycine max
  Coding DNA Sequence Number=SeqID_44582
AALRLRCQLSGRPDRCGPLAIKRQRWRKGDVLQVAIKLGIDIRFTQQVTGLATARSFDCGERKWLTNGAEISWKMPGRYLTG

SEQ ID NO: 136268 - protein, 223 aa, Glycine max
  Coding DNA Sequence Number=SeqID_44583
  Subcellular localization annotation: CTP_CleavageSite=85; ConfidenceScore=5.73e-01
MTKYAQKISISSGMPRTTLTSVLLATRSQPNGLTRASAIASASGSDSARPHNARISVSASPPSGPLGYWPTSSVGQYCDRRSSTVASLVQAVARIDARADQHDQEGSQQVHDGRGAKRGEGSIGFVLDLARLVGQLHHADGHGHAGVLEQQQGAPHQRRNGNPHRLRHDHEAHALQVAGAQRPRRLELRAGNGAQPAADVLGDIGGRPQRQRDRRQRHLGVVL

SEQ ID NO: 136269 - protein, 251 aa, Glycine max
  Coding DNA Sequence Number=SeqID_44584
  Homolog annotation: Hit_ID=Q6UUU1; Match level="QueryCoverage=23%, HitCoverage=40%, E-value=3e-18, Identity=78%"; Hit description =Putative uncharacterized protein
LPGINRDTRIYFILRSDLPSQWLLFLSAVPPVSATDGVVRNGKSTAGHQRWQAAQLLGRAIGAGLFAITPAGERGMCCKAIKMGIRSGCTAAFSVIFVTIFLESCSFGGRDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136270 - protein, 263 aa, Glycine max
  Coding DNA Sequence Number=SeqID_44585
MTPAEDRNLIEKMASNSQQFIARNDAIFIRGMHEVATNPSASSETKKLEGKPDALVNLVTQHALNQKFVSVARVCAEAYAANIYNRAPQPQKQNQPQQNNYDLSSNRYNPGWRNHPNLRWSSPQQQQQQPAPSFQNAAGPSRPYIPPPIQQQQQPQKQPTIEAPSQPSLEELVRQMTMQNMQFQQETRASIQSLTNQMGQLATQLNQQQSQNSDKLPSQAVQNPKNVSAISLRSGKQCQGPQPVAPSSSANEPAELHSTPEKG

SEQ ID NO: 136271 - protein, 156 aa, Glycine max
  Coding DNA Sequence Number=SeqID_44586
MVKEKCKEVNVSSKRLAKKKSHFATKTKVKETSPLRQPPHLLLCKMTLVSTATPLRLEVIPQVKKFLDEGLVRKNLNPYALLVPKIGIIRHQIPKISDMMNVLSVATPFCKITHAPNIFMIHVHKDSLGSDQGVPTDPKRIKVIPDWPTPPSIREI

SEQ ID NO: 136272 - protein, 107 aa, Glycine max
  Coding DNA Sequence Number=SeqID_44587
MVSMSKGEKRIGEEKQQLVTEPAIDPVVEPLSETEEEVEVEDDQQKEIPLIVAGCVICGRAHDSGCCIPTEDTTHEVNYMGNQPRPYFNAGGYSGFQHGQQYNQQQG

SEQ ID NO: 136273 - protein, 260 aa, Glycine max
  Coding DNA Sequence Number=SeqID_44588
  Gene Ontology: Mol. function=sequence-specific DNA binding; Cellular component=intracellular; Biological process=regulation of transcription, DNA-dependent
  Homolog annotation: Hit_ID=Q2K0L1; Match level="QueryCoverage=18%, HitCoverage=30%, E-value=1e-12, Identity=70%"; Hit description =Probable transcriptional regulator protein, AsnC family
  Pfam annotation: Domain name=HTH_11; Domain location=200-256; Score =10.8; E_value=0.016; Accession=PF08279.3; Description=HTH domain
MLVGAHDDVHLAAPCQRGRHAQQVHQAVDAHGGARAGEDHGMLVARAAAAADHGARLAPQARDETAAERGLGVRIGVVRQHVLEHEALDLHERAAGSHVIGIDQRLEAERAFDDGVLADQAVGQTGDDVGGIAGIAGTGATALWRPGSLGWTWCGFDETAGRKVSEISYDGRKFETSPKFSLKSSKFDRLNEYMEKIDKFDLNIISCLQREGSLSQRELADRVGLSQNACWRRLQRLNACGIIRGTRAGGEPGGLGAGPD

SEQ ID NO: 136274 - protein, 121 aa, Glycine max
  Coding DNA Sequence Number=SeqID_44589
MGGVVYNLQQFFTQKFAKKESHFVIKTNITETSLLRQPPHLLLCKRTLVSTAIPLELDVIPQVKELLDEDLVCKSLNPCALLVSKIGIEGRSPEFQEPLDLRSNPFQGGGDDVIIPPKGIG

SEQ ID NO: 136275 - protein, 71 aa, Glycine max
  Coding DNA Sequence Number=SeqID_44590
MPSHMRCMWVSSLVVGSRKIHIVFLTAHKGHCAPKCAVHRVKLKYGSNHLAKIGAKDGSCYIIASSTVKHV

SEQ ID NO: 136276 - protein, 193 aa, Glycine max
  Coding DNA Sequence Number=SeqID_44591
MGTNQTGKRFYQVKVKGLDTTSIKELGRLMEPLQMQAFRKTYGKILDLTIVEVSIEAIASLTQYYDQPLRCFTIATVVKDSARGLDRVKQTQNGIVGLPRKYLEDKARDMANQEDWVPFMDVLALLIFGVVLFPNVDGLVDLATIDAFLAYRHSKESLVVAVLADLFDTFDRSKTRGIHVRSKAIARVLKREE

SEQ ID NO: 136277 - protein, 44 aa, Glycine max
  Coding DNA Sequence Number=SeqID_44592
MWMKNNMVERKTPLEQQMTSKAEGGDGCAWWFGWVGLNLNQNNA

SEQ ID NO: 136278 - protein, 71 aa, Glycine max
  Coding DNA Sequence Number=SeqID_44593
MRRILREGERERDWECNRRKSSYLRLMNELKAPKVMREGSWLVVPAPFGRVKVEFRKDTRREQQQQQKAQQ

SEQ ID NO: 136279 - protein, 189 aa, Glycine max
  Coding DNA Sequence Number=SeqID_44594
DVVRVSVEQVINSDVEVPFPTSEIKCVRQTLHTFIAWTTPLVKKIFIEHEGSSPTKDTKAVEAVNDVVVDDPLRELIKSLVDIYEKPVELVWDVTKFGIPNATASLFITCADVNEIISGVQCLNIAILQLWTMYMDQLSQSNGLGSVYGFLEPQAILNANDKRGQCQEYIEKWLKESNRDVYLGAYLNQ

SEQ ID NO: 136280 - protein, 112 aa, Glycine max
  Coding DNA Sequence Number=SeqID_44595
  Homolog annotation: Hit_ID=A5B0N4; Match level="QueryCoverage=43%, HitCoverage=11%, E-value=3e-07, Identity=53%"; Hit description =Putative uncharacterized protein
MAYGMSGKSEISEGGANDSVASVGDVIFVKLRDSSWWPAQVVDENSVNKSVKPSKLTKQLPRDILVRHYGSYTCQEHLTNKVEDIIVIERDEWKWVDYQLVMMFGRKLNILL

SEQ ID NO: 136281 - protein, 54 aa, Glycine max
  Coding DNA Sequence Number=SeqID_44596
MKETVQGHTGLNGMLQNSPMISTCHIQVVSSGKWRLRNLCWAYGYHCIIEQIRE

SEQ ID NO: 136282 - protein, 294 aa, Glycine max
  Coding DNA Sequence Number=SeqID_44597
  Pfam annotation: Domain name=Transposase_23; Domain location=208-278; Score=-7.2; E_value=0.0072; Accession=PF03017.5; Description =TNP1ENSPM transposase
MTLARRNGPSFVGAVETPRGRMCGKRHMPSRSKILPPMCCLVGTKKKLEEATQFRSIKVVIDPPSSIRRHVKWKMARAKKTGQMTSEAAKEIAEKIEQASQGSFVPHGRHNVLTAAIGRPEHPGHVHVARAGVTIKQYFGSAPWTSLTSSSMAIEELEHLTQQIRDRLKESITKKGLALPPEPEVGPSTAHVSTKKSYVGPSRNDPDTGDSDKCGLYIKENPPRLGSLGRVYEGSTTVHSIPLLHDQVKVGVEEVKDADAPVPVPTNEVNLVGQTLNTFLVWPTRNSVYWRCAY

SEQ ID NO: 136283 - protein, 70 aa, Glycine max
  Coding DNA Sequence Number=SeqID_44598
  Homolog annotation: Hit_ID=Q9LNG5; Match level="QueryCoverage=100%, HitCoverage=5%, E-value=3e-07, Identity=37%"; Hit description =Serine/threonine protein phosphatase 7 long form homolog
MTITLEDVALQHGIRVDGRPITSATYYDWEEMCEQYLGVVLPKGEAIVSSTIKLKWLQDDMPLLPVEPTQ

SEQ ID NO: 136284 - protein, 214 aa, Glycine max
  Coding DNA Sequence Number=SeqID_44599
MGGCASLLQSWAWYRMTIIATRVNWTPSYSLVTRWNGGGLSFTCTPHGDVIGYRMRLDHMTIEQNDICLRQDIPDPPRNMEKLHKIDMRGRTDTNWVEKHAKWIRLCSTHIHTHPPMKDYIFPSLSNMDYTPLIVQLDDFVSNVFGTDCGMPASSHEYMHSLQNKVELSFNLMFSQDVEENNPSLHDIPDKCLCQNPGRNGRHPPCGTRHHYGD

SEQ ID NO: 136285 - protein, 80 aa, Glycine max
  Coding DNA Sequence Number=SeqID_44600
MNPRNVGPLGSVFNQEDLLLKTVTKSRSLEKLFGLDLNQEGEALTDSRPWGKDTRFECSFKPMLIPYGWSILSKQSDPDW

SEQ ID NO: 136286 - protein, 80 aa, Glycine max
  Coding DNA Sequence Number=SeqID_44601
MTSKIILMMPKNQELSKFQRFKIQEQSSFKNQDSRTIKFQESRFKNKIKIQDSRFKIQEKKSRSNSQDFTREVFFQKIQT

SEQ ID NO: 136287 - protein, 106 aa, Glycine max
  Coding DNA Sequence Number=SeqID_44602
MAPRKLSSKRSMKDTTGEGSSAAPQADTDFDRHRFRSVEHQQCFEAIKGWSFLRERRVQLRDYEFPDFQEEIASRRWAPLVTPMAKFDPEIVMEFYTNAWPTEEGV

SEQ ID NO: 136288 - protein, 45 aa, Glycine max
  Coding DNA Sequence Number=SeqID_44603
MITNYRKRDGGDRGGVGGDDNPGGWNNVSEGGGMVMVTVIVMTMF

SEQ ID NO: 136289 - protein, 280 aa, Glycine max
  Coding DNA Sequence Number=SeqID_44604
  Gene Ontology: Mol. function=AMP deaminase activity; Cellular component=integral to membrane; Biological process=purine ribonucleoside monophosphate biosynthetic process
  Homolog annotation: Hit_ID=A7Q2Q2; Match level="QueryCoverage=71%, HitCoverage=44%, E-value=8e-77, Identity=64%"; Hit description =Chromosome chr1 scaffold_46, whole genome shotgun sequence
  Pfam annotation: Domain name=A_deaminase; Domain location=1-244; Score=134.0; E_value=4.3e-37; Accession=PF00962.13; Description =AdenosineAMP deaminase
METLAGTTRRRRRRVVLLACWAVSRVSTWWAVSNRVCPIVQPCPVTAEATDTASHRSRIRMRVWCESDAGHANDVVGFDLVDDESKPERRPTKHMPTPSEWTNEFNPAYSYYLYYYYANLYTLNKLRESKGMTTIKLRPHCGEAGDSDHLAAAFLLCHNISHGINLHKTPVLQYLYYLAQLGLNVSLSTDDPLQIHLTKEPLLEEYNVAAKVWKLSACDLCEIARNSVYQSGFSHQAKSHWLGDKYLLRGSEGIDIHKTNVPNLRISFRYEVKKLKTNHI

SEQ ID NO: 136290 - protein, 159 aa, Glycine max
  Coding DNA Sequence Number=SeqID_44605
MVDRFHVDPRGVRVQRQDADLWRWRERQKLWRIKVPPKINIFIWRLLRNRLPTTDNKRKRNLLTVWSHYYAWLDLNSVLLQHFRQHFLLDYNQERQYCIQGSLVPGFFVSYMDLDEKHWEFFWLFICAAVLEHQSLCSGVELGVGIDQAGLQRPTTWPI

SEQ ID NO: 136291 - protein, 365 aa, Glycine max
  Coding DNA Sequence Number=SeqID_44606
  Homolog annotation: Hit_ID=A5B731; Match level="QueryCoverage=16%, HitCoverage=6%, E-value=5e-07, Identity=46%"; Hit description =Putative uncharacterized protein
MVEALVCTQDWIKKTPSPLPSNENDEFLEFERIEEATFFVNIKLHCFLLFLKEFVKLESSWGDITCHWCLDPIWDAVREEAKLENHMIIKLSFIVAASIAALKILQTKTSSSTKRNGSDGSHLEQEFEERENSTVNANHNEEKEIKFEMPQNLPTREFKDLELLIDGEKMHNVTKKEGSPWSVTNDKSRFCRASTSSFLDVIFQIRGPPALSFGPVGSMIGIAIILQNLVQNYKQREVNLERKLLKLNSLREEQSTIAQMQKQLEEKTETVEILNKTIGSLRSERIDKYETGDGFGHFGLLSPAFGMELLRTQDDPETKIETKQKDRGCFDLQERPYPPPSAMTLLHLPPKRSLGSHLKLAFNRL

SEQ ID NO: 136292 - protein, 332 aa, Glycine max
  Coding DNA Sequence Number=SeqID_44607
  Gene Ontology: Mol. function=nucleic acid binding; Cellular component= cytoplasm; Biological process=multicellular organismal development
  Homolog annotation: Hit_ID=A1E5M3; Match level="QueryCoverage=28%, HitCoverage=12%, E-value=3e-38, Identity=66%"; Hit description =Argonaute 1
  Pfam annotation: Domain name=Piwi; Domain location=68-299; Score= -113.6; E_value=0.043; Accession=PF02171.8; Description=Piwi domain
MGVANLITNINQTQINGFGMILGKISNITNINQVVTLVEQSQEFPQKQGGRENYDQYGRTIWKLHCCASSAGDLKRICETDLGLASQCCLTKHVFKMSKQYLANVALKINVKVGGRNTVLVDALSRRIPLVVASQDYPEITKQELIQDLFKQWQDPVRGRVTGGMIKYSPSLFLIWMVLVRVNFNRFYYLSLMLFERHVHPWNPTITIRVLLTGVATYCLVLLLTPKSAIPPNLTFISAAMLEYRVQAVLLTSIVIQHLASVLTSPLMLNAHFLPRFLNNTDLECLISTSVVRIVPMWKTLSFYNDGLGTDAEIFNFQHRLTTDVECGFPLM

SEQ ID NO: 136293 - protein, 155 aa, Glycine max
  Coding DNA Sequence Number=SeqID_44608
MVFGYMQQPTDNNTNIEKERECVKSLKAFEQSGTTLNTDKSEARDPRHINPSKAVRQRGTMQQWRRLWEQQGEDVEELFFLACWAASRVSTWWAASNRACPTIQPCPVMAEATGTASHRSHICMRVWCESDAGHAGDVPCPCFLGLAHNFLRGFM

SEQ ID NO: 136294 - protein, 144 aa, Glycine max
  Coding DNA Sequence Number=SeqID_44609
MEQIKNMAASDHVILCDQAYTPTKKSLLELTSQDAMLAQNKLLANTLETLTTTLSNLPQQLHAVQPPPSLVMHIGRCNIYGGTHESSSCMVQDNTSNEVNYMGSQNHQGGPPGFYQRVYAKDRITSEEYRCSNQESGGTDGPTS

SEQ ID NO: 136295 - protein, 158 aa, Glycine max
  Coding DNA Sequence Number=SeqID_44610
  Subcellular localization annotation: CTP_CleavageSite=28; ConfidenceScore=5.25e-01
MYKDKWAHTYPMGPKSTLRLMRTLGSSLASLVMGSPPSSPPYSDGHSQVASKRMVIIDPATGRGSVPHKEKFHKYPGVVAREKIPIVHSNWIDVPESLKELGQDKEDPSVKYGIDPQTWEEFAATRKTPNWQDLLEEQMTQGSFVPQGRDNILNTAIG

SEQ ID NO: 136296 - protein, 95 aa, Glycine max
  Coding DNA Sequence Number=SeqID_44611
MEGRRWREKYDGEEMKGWWQREEGRREKDKLGSQEVGVDGARVWLFNGWGKQQIRSWLRAQGTSKMEKRVVGVREITRKVRGNKNEVEGANGGEL

SEQ ID NO: 136297 - protein, 231 aa, Glycine max
  Coding DNA Sequence Number=SeqID_44612
  Gene Ontology: Mol. function=transmembrane receptor activity; Cellular component=intrinsic to membrane; Biological process=innate immune response
  Homolog annotation: Hit_ID=A7QGF1; Match level="QueryCoverage=75%, HitCoverage=18%, E-value=1e-46, Identity=50%"; Hit description =Chromosome undetermined scaffold_92, whole genome shotgun sequence
  Pfam annotation: Domain name=TIR; Domain location=17-149; Score =159.9; E_value=6.6e-45; Accession=PF01582.11; Description=TIR domain
MASASSFSFIPQETDDVFISFRGEDTRHTFTAHLLAAFYRLKIRTYVDYKLGRGDEISPTLIRAIEESKVSVIVLSKNYATSKWCLEELVKIMECRRTKGQIAIPVFYHVDPSDVRNQTGSYADAFANHEQRFKDNVQKVELWRASLREVTNLSGWDCLVNRTGNMRDMEDLITTLHQLGELKLEKAMPTDDSSVWNDLMATYERVLQLKQDKLMRAFNTKDIVDSLLDDS

SEQ ID NO: 136298 - protein, 149 aa, Glycine max
  Coding DNA Sequence Number=SeqID_44613
  Pfam annotation: Domain name=zf-CCHC; Domain location=121-138; Score =9.7; E_value=0.053; Accession=PF00098.14; Description=Zinc knuckle
MARSLFKGTQQQIVCKKQVLSYDESSKIIPLRHELSPTGFCEQATKPHLRENYLDGNPNTKIYGPRLIKEQGTLKLEEEVFDHYLARTFWRLQCGHVTIFAKGQKKKKGKGGKKRKFDPKDICNYSKELGHWKQDCPKKAKKYFVVTLV

SEQ ID NO: 136299 - protein, 148 aa, Glycine max
  Coding DNA Sequence Number=SeqID_44614
  Homolog annotation: Hit_ID=A7UQU7; Match level="QueryCoverage=56%, HitCoverage=14%, E-value=6e-11, Identity=41%"; Hit description=IMP dehydrogenase/GMP reductase, putative
  Pfam annotation: Domain name=DUF1723; Domain location=47-96; Score =60.1; E_value=7.8e-15; Accession=PF08330.1; Description=Protein of unknown function (DUF1723)
MERYECLELKLSSHGRKMTKFGRPAPEIEGFVAAIGLSPLIICSLDTSDRGLMSAFVEHWHKETNSFHLPVGEVTITLDDVASLLHLLVVGAFHNFELLHVDDAVNMLVELLEVSAAEERAETIQCHGSYVRLSWLRDVYQMKIEACD

SEQ ID NO: 136300 - protein, 106 aa, Glycine max
  Coding DNA Sequence Number=SeqID_44615
MTPTHDALLYYNRRWNMPRQHDFVSYSFTGKNPKKFDIPSGCIIDELKDLIKQVAPQGIPLYGIHESQMLCTEWALPENDNVYSTTTLLAVKDIGLVQTCYITTTN

SEQ ID NO: 136301 - protein, 148 aa, Glycine max
  Coding DNA Sequence Number=SeqID_44616
  Homolog annotation: Hit_ID=A5BEV8; Match level="QueryCoverage=65%, HitCoverage=12%, E-value=2e-10, Identity=39%"; Hit description =Putative uncharacterized protein
MLNQFHPCIQDSIENIIGVKANELTSWSEEYINLVGGIERFEELKRSLLVDDLSKVTMDKWVNITDMGYVIASRYNVIIVSLSQKQSMIFFPLRSQPPPDSSVHRVICTGHVYGNHFVQAKPTPYIARMQRYTSFSRLKIEFVDLGEP

SEQ ID NO: 136302 - protein, 219 aa, Glycine max
  Coding DNA Sequence Number=SeqID_44617
  Homolog annotation: Hit_ID=Q2HSV3; Match level="QueryCoverage=69%, HitCoverage=24%, E-value=7e-15, Identity=32%"; Hit description=IMP dehydrogenase/GMP reductase, putative
  Pfam annotation: Domain name=DUF1723; Domain location=135-184; Score =37.7; E_value=4.1e-08; Accession=PF08330.1; Description=Protein of unknown function (DUF1723)
MVRTRCLGRTLGRAIGKVLGRRDESDDDAPSSEGLLHQLDPPTAAEELIDDQTEAPVEKGVTDVGGFPGGSHDTSVLTDFENHIALRVWNGKECPKLKLSSHGRKMTKFERPAPEIEGLVAASGLSPLIACSLDTGNRGLMYAFMEHWHKKTKSFHLSVEEVTITLDDVASLLHFPIVEAFHNFKLLHVDDAVEMLVELLEVSAAEVRAETIQCHGSYV

SEQ ID NO: 136303 - protein, 89 aa, Glycine max
  Coding DNA Sequence Number=SeqID_44618
  Gene Ontology: Mol. function=transferase activity; Cellular component= cytoplasm; Biological process=response to stress
  Homolog annotation: Hit_ID=A7Q2N8; Match level="QueryCoverage=98%, HitCoverage=37%, E-value=2e-26, Identity=69%"; Hit description =Chromosome chr1 scaffold_46, whole genome shotgun sequence
  Pfam annotation: Domain name=GST_N; Domain location=1-59; Score=10.6; E_value=0.07; Accession=PF02798.11; Description=Glutathione S -transferase, N-terminal domain
MARIALNNKSVEYEFIEERLESKSQLLLQSNPIYKKIPVLIHRDKTHSEFFIIVQYVDDVWSSASPIVPSNPYDHAVACFWAAAYIDEK

SEQ ID NO: 136304 - protein, 662 aa, Glycine max
  Coding DNA Sequence Number=SeqID_44619
  Gene Ontology: Mol. function=transferase activity, transferring glycosyl groups; Cellular component=integral to membrane; Biological process=protein amino acid glycosylation
  Homolog annotation: Hit_ID=A7Q2N1; Match level="QueryCoverage=100%, HitCoverage=100%, E-value=0.0, Identity=67%"; Hit description =Chromosome chr1 scaffold_46, whole genome shotgun sequence
  Pfam annotation: Domain name=Gal-bind_lectin; Domain location=172 -382; Score=155.6; E_value=1.4e-43; Accession=PF00337.13; Description= Galactoside-binding lectin
  Pfam annotation: Domain name=Galactosyl_T; Domain location=428-621; Score=42.5; E_value=7.2e-10; Accession=PF01762.12; Description =Galactosyltransferase
  Pfam module annotation: Pfam domain module=Gal-bind_lectin::Galactosyl _T; Domain location=172-382::428-621
MKRVKKLYPFLVLPNRPKPLQIFMAVMFLYLLFTTFEIETSLGFRTRFVSVSSLLGNEDQHQRTHSSKASNFPSQGVFQGSLHRKALQGLQKVSTLSFIEALNDTTVEENMFSELHKAARHAWVEGKRLWEQVESVKETMNVARFKAENLSDSCQHSISLSGSELRKQNKGVMVMVLPCGLTLGSHVTVVGTPRWAHWEDDPKISVVKEEEGKVMVSQFMMELQGLKSVDKEEPPRILHFNPRLKGDYSGRPVIEQNTCYRMQWGSALRCEGWKSRADEDTVDGQVKCEKWIRDDDSHAEEAKATWWLTRLIGRTKKVTIDWPYPFVEARLFVLTVSAGMEGYHVSVDGRHVTSFPYRTGFSLEDSTGLSIKGDVDVHSIYAASLPTSHPSFAPQMHLELLPQWKAPPLVHVNVELFIGILSAGNHFAERMAVRKSWMQHKLIKSSNVVSRFFVALHGRKDLNMEIKKEADYFGDIIIVPYMDHYDLVVLKTIAITEYGIRSVAAKYIMKCDDDTFVRIESIISEARKVGSGRSLYIGNMNYHHRPLRSGKWAVTYEEWSEEEYPTYANGPGYTISADIAQFIVSNFEEHRLKLFKMEDVSMGMWVEQFNSSRPVEYVHSFKFCQFGCIEDYYTAHYQSPRQMTCMWDKLQQKGKPLCCNMR

SEQ ID NO: 136305 - protein, 174 aa, Glycine max
  Coding DNA Sequence Number=SeqID_44620
MEDHHREKVLPNPIRTFGAYRGASENFSFDPYSQPRKTTMGVGIHHTWNAYHRDPRKWESGNRGGPPASAQLPPGWKTMNIDLYDKLSDLDEHVDAFVAHMNLFTNDDAFMCRVFLTNLKGAVLHCPDVTLTSMIFSNNICKKPPTTLDELRARAHSGKIQQWQEGSREMPTIM

SEQ ID NO: 136306 - protein, 172 aa, Glycine max
  Coding DNA Sequence Number=SeqID_44621
  Gene Ontology: Mol. function=aspartic-type endopeptidase activity; Biological process=RNA-dependent DNA replication
  Homolog annotation: Hit_ID=Q69F85; Match level="QueryCoverage=61%, HitCoverage=7%, E-value=2e-22, Identity=43%"; Hit description=Gag -pol polyprotein
MNGIRLEFSNAWKHSKFSFEKNSISMNFGSTLEQDEKRFVYHIRCSSDENNDPEGMEGGICVSCDPETKETHFSLTYGTDAMIPVEIQEEACKRIATRKHESKLNKKGFRVGDLVWRMRGEAQKDHARGKITPNWEGPFRITAKMQNRAYRLKKLVGKEIPRTWKATHLNDM

SEQ ID NO: 136307 - protein, 350 aa, Glycine max
  Coding DNA Sequence Number=SeqID_44622
  Subcellular localization annotation: CTP_CleavageSite=50; ConfidenceScore=5.57e-01
MSSIIFISHDQQSSKKLNNSKTQIFHGFCFQSSSSPSSTKERWHSGVTLTGATTKEFSHWILEKLTNSNYLLRCQQVESVIKGHRLHHLLTNPQIPLDTPLLPIVILEIPHLSSYLGGNKISSYTCGYNPPFPAKFFQDSLVANRPNIFGTSFICIFSPLICFRSENVNIVLDGLPDEFESLITFVSGKFESLSVDEVATLLLAHETRLSCKKALTLINLTKADKSSFSLILLNKCFLATLLLQICKLKLLRASLAPHQTLDRITTTIMVEIGSLTLVVVVAVAEVATPMCSVRFAIKMDMRLLSAITGMMMIMFPLNQWITPTNTPITLNLCLHPKSQSLSQSGSKSEP

SEQ ID NO: 136308 - protein, 58 aa, Glycine max
  Coding DNA Sequence Number=SeqID_44623
MVFNILNLMCKGLIIYMNGNGMEKEEREETPLQGEDESRKSSPPYEAMDKSLKEEEDE

SEQ ID NO: 136309 - protein, 502 aa, Glycine max
  Coding DNA Sequence Number=SeqID_44624
  Homolog annotation: Hit_ID=Q6WAY6; Match level="QueryCoverage=33%, HitCoverage=33%, E-value=1e-13, Identity=31%"; Hit description =Putative uncharacterized protein
MGSDQMPSFKKRFYHVKVKNLELASLRELGQRMDQVRRQAFSKAYGKIWDLVMVEVSVEAIASLAQYYDQSLKYGVVDLAAINAFLAYHHSKESPIIAILADAYHTFDLRCEKSSARIICCRPVCPLQGMVGAFISWFPRWKEGGVGVLCSCEGFPNIPLMGTRGCINYNFMLAIRHLGYPVRGVPSEEIIAPFVVRGFIEPNAKILQRIRKVWSTVERKDKELRGSSNGVIGGYHKWLKSRTQGITWFPMLKCLSGKEPEVPEESEEVQALKVELEKMTVVKEKLKTTVTRVKKECDKLRDVNMTTIEALEQERKMAERDESRMENMVLEDKLKACQRAKRSLTKQLSRTEENMLTIIDQYKKKVNLSASHGQRLEDEHAKVSALQIEKEARERVIESLHREAMKWMNRFALTLNGSQELPRLLARAKAMADTYSAPNEVHGLFDYCHHMLSHYSLHFVFRSHCHHQKVTIVTKKNEHVLRHPYRTRAKARIMSEVEEVKE

SEQ ID NO: 136310 - protein, 77 aa, Glycine max
  Coding DNA Sequence Number=SeqID_44625
  Homolog annotation: Hit_ID=A5BQE3; Match level="QueryCoverage=61%, HitCoverage=3%, E-value=1e-11, Identity=65%"; Hit description =Putative uncharacterized protein
MDLPEENLDLPIALRKVSLPKNLCKALDHPGWRQAVIDEMKALEHNGTWELVLLPPGKETCWLSMGICYKSWGQWTD

SEQ ID NO: 136311 - protein, 288 aa, Glycine max
  Coding DNA Sequence Number=SeqID_44626
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=A7QX90; Match level="QueryCoverage=78%, HitCoverage=16%, E-value=1e-105, Identity=83%"; Hit description =Chromosome undetermined scaffold_215, whole genome shotgun sequence
MLGVWGCIGKNPNPTSAKNKAKLEYISEGQPLPLELAFGVELGLNLNSKNLRHYIAIFVNKKYFYLHLDSSEEGSAQFNPKNRFLVFLLTMFTLITLYSTIIPISLYVSIEMIKFIQSTQFINKDLCMYHNETNTPALARTSNLNEELGQVEYIFSDKTGTLTRNLMEFFKCSIGGEVYGNGVTEIERGLAERNGMKIEENRSPNAVHERGFNFDDARIMRGAWRNEPNPDVCKEFFRCLAICHTVLPEGDESPEKIRYQAASPDEAALVIAAKHFGFFFYRFNVQTS

SEQ ID NO: 136312 - protein, 98 aa, Glycine max
  Coding DNA Sequence Number=SeqID_44627
  Homolog annotation: Hit_ID=Q9C7V7; Match level="QueryCoverage=65%, HitCoverage=10%, E-value=3e-08, Identity=46%"; Hit description =Putative uncharacterized protein F15H21.4
  Pfam annotation: Domain name=KIP1; Domain location=2-67; Score=18.2; E_value=0.0019; Accession=PF07765.3; Description=KIP1-like protein
MLTTHKEEQLQEAKTEIEDKVKRILKLIKEDSREEDGTLVEHSKKEPLIELIEDFHNQYQSLYAQYDHLTGKLRKKIKGHGQKKQGKEGSPPFPVVHS

SEQ ID NO: 136313 - protein, 566 aa, Glycine max
  Coding DNA Sequence Number=SeqID_44628
  Homolog annotation: Hit_ID=O82360; Match level="QueryCoverage=41%, HitCoverage=67%, E-value=5e-55, Identity=51%"; Hit description =Expressed protein
MTNANCPQESLHSVSNGNLRLWKSIHYCFKSEGPSMKSLCESHNDIWTLMTALELPIIYVREPKVRKMKTISGHCVSVIDILVLKAAKILTNFISADNGASHVINAYIHRASASFNELKQLHKELGSSHSHKKHKRHRTENGNDSGKVVGNSIQSVDINKELNPGHVKFDQFKRQQSGSGNADQDDENFSQQLDGFIGYETENVDGGEMHKKKKKKKQEVESLHDIDSTVKFGVREADGKLPNGSQNESESTREHGNEGNINARMEEGRKQKSGKKHKVSTSSLSSYKGEADNGKDLEQQKEMEKTSCNGFEGENGGLGSSQDLQIKKKKNHNLDSASSKQYLQACSLLDDWRQHVSSRNPRIEKCSSMLDNLVGSLDLPKVKNSTKGKVLMQAMYGVKVKTVFICRVFTATFSGSSKKLSNLNVADIHSWAPDFRRLQNLVNEESRVRFSGGKFTVLNELEAVDASVKILYPTIQAGVDTIEIEWLVKTVEELHAGAEKLSQGNDLFAKGVDGFFEAVMTSRDTLLSSMRFDKTVNDHSPGRNRHMQHKLDFNLKFRGGVLTDTH

SEQ ID NO: 136314 - protein, 94 aa, Glycine max
  Coding DNA Sequence Number=SeqID_44629
MQINICGIFWPSYLSDNCQTLISSEYDVLSFTYDVLIIASRITVFGTDYSAKPGITLSFDQGNKKIQGKGGKRVILWIFLDPSSPRLAFGSPRP

SEQ ID NO: 136315 - protein, 633 aa, Glycine max
  Coding DNA Sequence Number=SeqID_44630
  Pfam annotation: Domain name=Transposase_23; Domain location=323-393; Score=-0.8; E_value=0.0015; Accession=PF03017.5; Description =TNP1ENSPM transposase
  Subcellular localization annotation: CTP_CleavageSite=26; ConfidenceScore=5.75e-01
MASPSASPPPPPSPPFAPSDASALPSAVKRTRKASRLRSLSTRPPGAERPVVHVDPATGKADGPHKKKLRTYLGIVARDKVDVTYENWKKVPTAQKGLTWEDIQAEFDIPEASDNRMKWKLLQTDGVEDTVCEKYGISKEKWAQFCQTRRDPSWENIAPHVPSRGGYDYLEQKLLAEKTKKKLQEATQSGSVDGVIDPPSLVKRHVKWKMACTKKTGEMTTEAAKEIAEKIIKHPGRVCAAGVVVKIKQYFGSTPRTPRNSSSLPPEELQQLTQQIRDQLGQMQSQMQSQGLALRFEPLVGPSGPRVSTKGSCVDPSRNYPETGDSDRCGLYIEADPARLVALGRVYEGSTIVHNSPFLRGQVKVGVEEVTDADAPIPVPTDEVSLVGQALHTFLAWPTHLVKSLSQQEKPPPKPDPEVDDPLYLMTLTIPKLFLRPYQVTWDATVFGVFNPNFPLYIKHKDLFEIAHGGQCLSISMLQLWILHLTDTSIRAGNSDIYGFLEPQPDNYLKGIINSALKGLDDAPQPKSKAPARWIVVKCNRQKGSTECGYYVMHWMSTIILGTFRNNWEAELLCKRYDGYNHHPVAASEFHATTSDSDSSSVIDLNHNEGEVKGNGSRIFDLDLNHPPPHEIA

SEQ ID NO: 136316 - protein, 116 aa, Glycine max
  Coding DNA Sequence Number=SeqID_44631
MELMRLNQHKENDKKKKGITLKASSSIQEGSDKEDLNEIEEDDDFRHLRVNCPSFKKRIERSEKKTFNDKKAKKAYITWEYNDMDTFEDSENEVVNLTLMAKNYESDEEVSLKKSW

SEQ ID NO: 136317 - protein, 175 aa, Glycine max
  Coding DNA Sequence Number=SeqID_44632
VYGEFVKTLDNDLLALVDGDWRRATGGGGSGAGGGAFGAAALAWARRGLRKGVKNDPLSVTQRCDQHWEPQLRGVGMGDLCDLARNEAAQVKVRKYAPCLSEHGEILLQQLPWGPIDVQDESASGDDGGVKEVINGLRIELDDMPPHLAVLLSTALWVIDVGVEFFDQGDIDLLL

SEQ ID NO: 136318 - protein, 97 aa, Glycine max
  Coding DNA Sequence Number=SeqID_44633
  Subcellular localization annotation: CTP_CleavageSite=59; ConfidenceScore=5.35e-01
MGREFAEAPSMGKFYPVSRVVTLTGAKVASFSSRSSPQPGHAPQDGHTLCFASKFRRVSGMEKEEREETPLQGEDESRRSSPPYEAMDKSLEEKEDE

SEQ ID NO: 136319 - protein, 242 aa, Glycine max
  Coding DNA Sequence Number=SeqID_44634
  Gene Ontology: Mol. function=nucleic acid binding
  Homolog annotation: Hit_ID=Q5XM22; Match level="QueryCoverage=54%, HitCoverage=89%, E-value=1e-37, Identity=50%"; Hit description =Resistance-like protein HAAS-2
MELLEVSGEEARAETVRAHGAYLRLSWLREVYQSRCHARRWIVVARAYLLHLAGCTLFSNKSATNVHVVHLEGFRDLGQTGVYAWGAAALVHMYDQLNEACKTPTRQMVRYLTLLQCWIYEHFPNVHQCVTDDAYAEMTPRASQWLTTKAHMRGITRAPYQERLDALTITDGQLRWGPIVVFVRPERVVRQFGYIQTIPPPPVSASLSYEEIDDRWMHFLDHVAPATEICVVPGQVSADYMD

SEQ ID NO: 136320 - protein, 156 aa, Glycine max
  Coding DNA Sequence Number=SeqID_44635
MTPRASQWLTTKAHMRGITRAPYQERLDALTITDGQLRWGPIVVFVRPERVVRQFGYIQTIPPPPVSASLSYEEIDDRWMHFLDHVAPATEICVVPGQNGCEGCEAIAERLERVLNLRMVTEGIELHEIMQDCLRIARGDASDGSLRARRRCRIDH

SEQ ID NO: 136321 - protein, 187 aa, Glycine max
  Coding DNA Sequence Number=SeqID_44636
  Gene Ontology: Biological process=transposition, DNA-mediated
  Homolog annotation: Hit_ID=Q1J7G7; Match level="QueryCoverage=17%, HitCoverage=45%, E-value=4e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPVTTFHRGLKGYQAYRYRRPRGGARYQLLFPLVRVNFELGVIMVIAVSFGKPVVPAALMNRPTRGERRFAYWALAECILAYYVGTDEGVSEVLHVAEKKGCT

SEQ ID NO: 136322 - protein, 151 aa, Glycine max
  Coding DNA Sequence Number=SeqID_44637
  Gene Ontology: Mol. function=sulfate transmembrane transporter activity; Cellular component=1-2nm peptidoglycan-based cell wall; Biological process=sulfate transport
  Homolog annotation: Hit_ID=P41032; Match level="QueryCoverage=100%, HitCoverage=61%, E-value=1e-63, Identity=78%"; Hit description =Sulfate transport system permease protein cysT
  Pfam annotation: Domain name=BPD_transp_1; Domain location=1-148; Score=29.2; E_value=1.6e-05; Accession=PF00528.13; Description =Binding-protein-dependent transport s
MAWILTRYRFPGRTLLDALMDLPFALPTAVAGLTLASLFSVNGLYVAMAFTSIPFVVRTVQPVLEELGPEYEEAAETLGATRWQSFRKVVLPELSPALMAGIALSFTRSLGEFGAVIFIAGNIAWKTEVTSLMIFIRLQEFDYPAASAIAS

SEQ ID NO: 136323 - protein, 185 aa, Glycine max
  Coding DNA Sequence Number=SeqID_44638
EWPQGSLPQRGPGRTRQPKELVPLRSMTVTALGALYTSSAFKAIKGWSFLRERRVQLRDDEYTDFQEEIGRRRWASLVTPMAKFDPEIVLEFYANAWPTEEGVFEEDQEYKYAQTRHDCDRLDEVPLGKVLIMPGQDFIRTAPGKRVRIMRTNMTTLTQIWMMLLLSNILPPDHNSDLPMPKCQL

SEQ ID NO: 136324 - protein, 148 aa, Glycine max
  Coding DNA Sequence Number=SeqID_44639
AFRLTDSKKVYMDNHSSISARQRVSKLNMTDLVSAEDDIAKKNVYTDNHSGISARQRESKVSMTDLVSAEDDAFRLTDSKKVYTDNHSGISARQRDSKVSMTDLVSAEDDAFRLTDSKKVYTDNHSGISARQRDSKVSMTDLVSAEDD

SEQ ID NO: 136325 - protein, 158 aa, Glycine max
  Coding DNA Sequence Number=SeqID_44640
MLQSIHQGKILLLQSLHVVAPPGSILSAEQFIEKVSWPRTLPFAVREGEVPSAQVPQQVQGASSEATIPGAFDFSGAGVEMRPNEDVLSEPIVAAPPTPVHERQADPPTPIMEMLEDPTTPVLRLSSTPSATPVLHLTDEEDMQDQDTQGTQDQSQEF

SEQ ID NO: 136326 - protein, 157 aa, Glycine max
  Coding DNA Sequence Number=SeqID_44641
MIDQGRLEVGIEGKEEPHICMQSTEGSGSCEAKPLVIYFTKSAASQKPGHPLMAKPVPFPYQNSHAVPWRYTPPGKKEEEVTDVSSLSAKVTNITGLSGVTRSGRVFAPPDLPVQPADVKGKGNVVEEQDGEAPHASNKDIPAKGSWRKRMVERRCR

SEQ ID NO: 136327 - protein, 222 aa, Glycine max
  Coding DNA Sequence Number=SeqID_44642
  Pfam annotation: Domain name=DUF1723; Domain location=108-158; Score =6.2; E_value=0.098; Accession=PF08330.1; Description=Protein of unknown function (DUF1723)
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPSSFHLPVGELTITLDDVSSLLHLSVRLPGLRKGSVVDRTYACNGYVISTSVDARQALRDLSQTGRYAWGVAALVRPTERCLYQQQPTAWRLDHTAA

SEQ ID NO: 136328 - protein, 17 aa, Glycine max
  Coding DNA Sequence Number=SeqID_44643
MANQQATKSKAKGREIP

SEQ ID NO: 136329 - protein, 145 aa, Glycine max
  Coding DNA Sequence Number=SeqID_44644
VNPMPPSDINPNESSNLRYGGQRFGKYGRPYDVQIQNEHTFPPYGLPPNYTPPNVAYTPNEDVNNFAPILIESRQPHHRIRSGPLNGGKAFMPLLTRRVVPIPNIVPLPNKEHALRRPYQTRARARVMGEVEEVQEQMKADMEAM

SEQ ID NO: 136330 - protein, 83 aa, Glycine max
  Coding DNA Sequence Number=SeqID_44645
MDSGRFQVSVPGDSYPTKTFMEEMYQQLLIFAYAPIFRQCIFRWFLGQVVPLYLSESDTLNLGGVTILGTRNKSSSGLAQQAH

SEQ ID NO: 136331 - protein, 145 aa, Glycine max
  Coding DNA Sequence Number=SeqID_44646
MTERYAWGVAALVHMYDQLNDASMSHSRQLGGYITLLQIYEYFPSLTDSTADQDYDEDSPRACRWITTKKTVKSIHHAIPVSCAGGLLLFITDQRGSGLVRQFGYTQIIPAPPVDSWVLYDDINDRLIHYSDHIVPAGEVCVVPG

SEQ ID NO: 136332 - protein, 104 aa, Glycine max
  Coding DNA Sequence Number=SeqID_44647
  Homolog annotation: Hit_ID=A0PAV3; Match level="QueryCoverage=36%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFRLRNCWEGRSVRASSLLRQLAKGGCAAKAIKLGNAKGFPKSRTL

SEQ ID NO: 136333 - protein, 128 aa, Glycine max
  Coding DNA Sequence Number=SeqID_44648
  Homolog annotation: Hit_ID=A7UQU7; Match level="QueryCoverage=73%, HitCoverage=16%, E-value=2e-13, Identity=41%"; Hit description=IMP dehydrogenase/GMP reductase, putative
MLVDLLMVSAEAARAETGQCCGPYAFRDLSQTGRYTWGVATLVHMYDQLNDASRQLGGYITLLQCWIYEHFPSIAESTTDQDYGEDSPHACRWIATKKTVKSIHTPAYRERLDRLQILDVCWIPYGEH

SEQ ID NO: 136334 - protein, 142 aa, Glycine max
  Coding DNA Sequence Number=SeqID_44649
MHYSDHIVPAGEVCIVSGQCASDYMDWFFRISHPFRTPGHASDPLPDGHAPQPRVVPQAPQMDIPHVPEPGALSTSIDEPRHAVEVCDEIVERLERHLSLGVVTPGSSTHEVIEECLRMARNVTQDHLVYVRSRRRRRTDQA

SEQ ID NO: 136335 - protein, 57 aa, Glycine max
  Coding DNA Sequence Number=SeqID_44650
MTEIVCAEDDINLRLSTGLFAAIDKGMTEIVCAEDDVNLRVSTGLLAVIDKGCKRQR

SEQ ID NO: 136336 - protein, 62 aa, Glycine max
  Coding DNA Sequence Number=SeqID_44651
  Subcellular localization annotation: CTP_CleavageSite=59; ConfidenceScore=5.28e-01
MFSPSGIEKSLEISEKNCFRKKNPSRGASVTLSRHFRKQFRGDSSPFFIVLRSFFVVLRSST

SEQ ID NO: 136337 - protein, 113 aa, Glycine max
  Coding DNA Sequence Number=SeqID_44652
MEAMMSMKKIMEASVVAVATTSAIAKYEWPHDVKIQNEHAFPPYGLPPNYTPPNVAYTPNEDVNNSTPILVESRQPHHVHVSQPMGETHEIPHLNLADFEPFLGYAIEGQAVG

SEQ ID NO: 136338 - protein, 39 aa, Glycine max
  Coding DNA Sequence Number=SeqID_44653
MHKEELRRSDFLSKEGVLSFETNVRGANTFLKHKYNSRT

SEQ ID NO: 136339 - protein, 271 aa, Glycine max
  Coding DNA Sequence Number=SeqID_44654
  Homolog annotation: Hit_ID=Q2HTA0; Match level="QueryCoverage=72%, HitCoverage=29%, E-value=9e-17, Identity=32%"; Hit description=IMP dehydrogenase/GMP reductase, related
ATNVHVVYLEALRDLSMTERYAWGVAALVHMYDQLNDASMSHSRQLGGYITLFTFPRLWSPPLIRTTTRLLRVRAGSAWTDSGFRMSVGSRMGEHREVQDFHVRSCYSGLLRWGPVAVYYRPERVVWQFGYTQTIPAPPVDSWVSYDDIHDRWMHYEDHIVPAGEVCVVPGACSSDYIDWFFRISHPFMTPGHALDPLPHGHAPQPRVVPQAPQTDIPRVPESGASSTSAEEPRHAVEVCDDIAERLKRHLSLGVVTLGSSTHEVIEEPGV

SEQ ID NO: 136340 - protein, 75 aa, Glycine max
  Coding DNA Sequence Number=SeqID_44655
MKTANTIADDVEAKLHDESRLIQRCFDYNKDDDKGDDKKLKGQSKNEFKMFKIDSRTLQDSRGKLKNTSRLKRKS

SEQ ID NO: 136341 - protein, 128 aa, Glycine max
  Coding DNA Sequence Number=SeqID_44656
MGAKYLEAVKQRLHATKQWSSDEIREPIGKITKKSYFPLTGDSVLDNGGRMNSARQSIHGAPNKMVEDARTTLGNQFAINSWGSGLDGGGCMNGNQFMGLRTRFDGGGCTNNARQSIRGAPDLMVEDA

SEQ ID NO: 136342 - protein, 114 aa, Glycine max
  Coding DNA Sequence Number=SeqID_44657
  Homolog annotation: Hit_ID=A0PAV3; Match level="QueryCoverage=57%, HitCoverage=31%, E-value=3e-07, Identity=52%"; Hit description =Restriction endonuclease
  Subcellular localization annotation: CTP_CleavageSite=84; ConfidenceScore=5.13e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWVRQGFPSHDV

SEQ ID NO: 136343 - protein, 136 aa, Glycine max
  Coding DNA Sequence Number=SeqID_44658
MAQKKLSTKRSRRDATREGSSAASEFDSHRFRSAEHQQHFEAIRGWSFHRERHVQLREDEYTDFQEEIARRHLTPLVTPMAKFDPKIVLEFYPNAWPTEEGVRDIRSWVRGQWIPFDTDALSQFLGDLLILEEGQQ

SEQ ID NO: 136344 - protein, 124 aa, Glycine max
  Coding DNA Sequence Number=SeqID_44659
  Subcellular localization annotation: CTP_CleavageSite=20; ConfidenceScore=5.05e-01
MEDAPVSPASPSRRRVAWPRAQPSSSGGGGASVAQERASEEPTTAAKGEDELTPPEPSYFDAGIHMAQEENASTNQIPKPSSTPIADDATPSSPAPELEQPISQDSPAAQVLDLNEHAQEQPQE

SEQ ID NO: 136345 - protein, 145 aa, Glycine max
  Coding DNA Sequence Number=SeqID_44660
  Subcellular localization annotation: CTP_CleavageSite=66; ConfidenceScore=5.06e-01
MGNQQRQGYTQGGFSGFQQGPYNQQGQWRTHPDNQFNKDQSGPSNRPIQQGPNIFQRTTKMEETLTQFMKVTMSNHKSIESSLKNLEVQVGQLAKQIADKSSNSFVANTNQNPKEECKAVMTRSKRFMEAEDEDNVVHKKKNADK

SEQ ID NO: 136346 - protein, 95 aa, Glycine max
  Coding DNA Sequence Number=SeqID_44661
  Subcellular localization annotation: CTP_CleavageSite=38; ConfidenceScore=5.49e-01
MTTRPRLQRAARPRLQRAARPRLQRAARPRLQRTTRPRLQRATCPRLQRGTRPHLQRAARHHLQKTTCPCLKRAARPRLQRTTCPHLQRDPRPCL

SEQ ID NO: 136347 - protein, 167 aa, Glycine max
  Coding DNA Sequence Number=SeqID_44662
  Gene Ontology: Mol. function=hydrolase activity, hydrolyzing O -glycosyl compounds; Cellular component=membrane; Biological process =carbohydrate metabolic process
  Homolog annotation: Hit_ID=Q1H1J7; Match level="QueryCoverage=98%, HitCoverage=19%, E-value=1e-72, Identity=75%"; Hit description =Glycosyl transferase, family 2
MTLIRAESLKGFGGWSEWCICEDTELGLRLLENNMELRYIDETFGRGLTPANFKALKSQRNRWAFGAMQILKHHMPKLLGKSSLNFSQRYHFLTGWFGWFGEALQLLFTIGSIGWTIAMLAFPKYFSLPVVVMIVPILCFLAIKAILGPVLYRKTMHCSWMDIFARR

SEQ ID NO: 136348 - protein, 258 aa, Glycine max
  Coding DNA Sequence Number=SeqID_44663
  Homolog annotation: Hit_ID=Q5XM22; Match level="QueryCoverage=43%, HitCoverage=89%, E-value=4e-24, Identity=42%"; Hit description =Resistance-like protein HAAS-2
LLEVSAEEARAETTRSRGAYVRLGWVRDIYEMRCQARRWVVAAHAYLLHLAFHELGQSGGYAWGVVALVHMYDQFDEASRTTTRQIGGYLTLLQCWIYEHFPSVHQCVTDDVYEETSPRASRWLTMKAHMKGITGASYRARCDTLTVTNVCWLPYSEHRGVREFKLISSFQGQLRWGPMVVTVQPERVLRQFGYIQSIPSSPVSASLSYDDIDDRWMHSADHVLAVGELCVVPGQVSTDYMERFFPDISPIHDTNPGR

SEQ ID NO: 136349 - protein, 78 aa, Glycine max
  Coding DNA Sequence Number=SeqID_44664
KDALPPQDECTPPPPPPQRDDSALMTEVLSELRALRTYVGERFDSLDNRFARMDIRLTQLEEDVGYIRQSFDLPSPPS

SEQ ID NO: 136350 - protein, 163 aa, Glycine max
  Coding DNA Sequence Number=SeqID_44665
AGNRYTDNVLGRNILPERKVELYHTELDDFKTELERRNFHKRLTNLVDGSIDLALVKEFYANLYSSEGPSPKQSRVRGHLVKIDADSLNTFLETPVVLAEGRGFILNTEGHPGKILRKDLTTLTRVWSVLSYSNLAPTSHTSDLTVDKARLIFGLVSRMVMNI

SEQ ID NO: 136351 - protein, 125 aa, Glycine max
  Coding DNA Sequence Number=SeqID_44666
  Gene Ontology: Biological process=transposition, DNA-mediated
  Homolog annotation: Hit_ID=Q1J7G7; Match level="QueryCoverage=31%, HitCoverage=55%, E-value=2e-15, Identity=97%"; Hit description =Transposase
MVKVGTSYVPINVSFFAKSIYSAQSSSGDAANFTDLMYDGVYEVLQWLLFLSAVPPVQLLTGWCVTAKAPPDISAGKCSGHAARRVPFAIQAAQLLGRAIGAGLFAITPAGERGMCCKAIKLGNP

SEQ ID NO: 136352 - protein, 26 aa, Glycine max
  Coding DNA Sequence Number=SeqID_44667
MVHDIFWCHPDAVKLVNTWLNMLTRL

SEQ ID NO: 136353 - protein, 242 aa, Glycine max
  Coding DNA Sequence Number=SeqID_44668
RMGPVHRHSRTIDLRRSPLSECGWVGYPMRGAPLKEELAPIIARGFNKTNVEALQKVRKAWETVQKKDKEFRGSNNGPIDGYRKWTAKREEVQAPEEDEEENAELRDVNIATTKALEQETKRARREEHGRNKFRGALWGSNRERKLLREERDQSRVDSLILKDELKACSRSKRMADEYAQVYAEKEARGRVIDSLHQEATMWMDRFALTLNGSQERPRLLAKAKVMADTYSAPEEIHGLLSY

SEQ ID NO: 136354 - protein, 302 aa, Glycine max
  Coding DNA Sequence Number=SeqID_44669
  Pfam annotation: Domain name=zf-CCHC; Domain location=101-118; Score =19.7; E_value=0.0016; Accession=PF00098.14; Description=Zinc knuckle
MKREKHDSYSSHNSCKSLSEELRDYYEGRNKPHLKPHSHRRENERKPQEANINLPYFHGKDNKDQGQGILGVTSSKPKDDKGKTIEKQPLKASMQEKTSSMKCFKCIGRGHITSQCPTKKTMIMRGQDIYSSQDEATTSPSSSESEEAKEEESSEEIYPQEEGQPLMVKEECKETLVSIATSLRLEFIPQVKELLDEGLVRKRLNPCALLVPKIGIIRHQIPKIGDVMNALGGATLFCKITRAPNIFMICVHRDSLGRNNQHENTEKGVEEKSPEFQEPRDLRSNPFQGGGNDAILPRKGIG

SEQ ID NO: 136355 - protein, 140 aa, Glycine max
  Coding DNA Sequence Number=SeqID_44670
MGSKIYPKVHENPKAFFINSSPILLEPLAHSSGNWSFPREDCITIMSISPCGRITPTRHPADPEKSNRVLGFPALITGLCQFYGVPVAPNKVIRPPTNRAFIKKYCVPQAGAWRDTITAWGWPATGNKRTATSSRAPQPQ

SEQ ID NO: 136356 - protein, 64 aa, Glycine max
  Coding DNA Sequence Number=SeqID_44671
  Homolog annotation: Hit_ID=P03845; Match level="QueryCoverage=65%, HitCoverage=100%, E-value=9e-12, Identity=76%"; Hit description =Putative uncharacterized protein 1
MGKYYTQGDKLLMPLAIQWLLPVVLLHVFPGWTQDDSYRIRRSGRTERGVRAYSPAWSELPTRN

SEQ ID NO: 136357 - protein, 88 aa, Glycine max
  Coding DNA Sequence Number=SeqID_44672
MPVCGRARRGSRVRFPREERCVESPPTFICGKRQKNRRKPVKKKIPSLEVVFAFEEGISTSHVDKSGALAPTYPPSKRKSDLRSSSLR

SEQ ID NO: 136358 - protein, 172 aa, Glycine max
  Coding DNA Sequence Number=SeqID_44673
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTLISANIGTKAGTGPPLEVDGIDKLDTARWKRAWPGWSAPNCVTPASPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 136359 - protein, 77 aa, Glycine max
  Coding DNA Sequence Number=SeqID_44674
ARDQQVITRLAQDVKEALLGGNLELATKKLPAKQSRKGTIEEDSNVAPQADTGFDKYQIPERGSSIAFRGHQRMVIP

SEQ ID NO: 136360 - protein, 151 aa, Glycine max
  Coding DNA Sequence Number=SeqID_44675
  Homolog annotation: Hit_ID=Q8LI60; Match level="QueryCoverage=74%, HitCoverage=20%, E-value=7e-07, Identity=26%"; Hit description =Putative uncharacterized protein OJ1634_H04.130
GIVARDKVDITYENWTEVPTAQKDLIWEDIQAEFDIPEASDTDQDGVEDTVCDKYDISKEKWAQFCQTHRDPSWEDVRIKAQAIKKQNIAPHKLLAEKTKKKMQEAAQSGNVDGVIDPPSPVRRHVKWKMARTKKTGEMTTKAAKEIAEKI

SEQ ID NO: 136361 - protein, 218 aa, Glycine max
  Coding DNA Sequence Number=SeqID_44676
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=72%, E-value=8e-24, Identity=69%"; Hit description=LacZ protein
  Subcellular localization annotation: CTP_CleavageSite=14; ConfidenceScore=5.32e-01
MTMITPSSKLTLTKGNKSWLGQVGLSFVGLQPVGLGVVGRRGGLLRAQGFGLGEFVGAAFYRRGVGGFGVVEAVRNHAAEDDDVECHEGGEKPLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 136362 - protein, 72 aa, Glycine max
  Coding DNA Sequence Number=SeqID_44677
MAGTFFLLKQQISLEIMSVIILGTPHRGPLLMACNLCLTASRYLAPIVAQYVKFRNVSEVKREHCGTIREVP

SEQ ID NO: 136363 - protein, 69 aa, Glycine max
  Coding DNA Sequence Number=SeqID_44678
MKMKANKTRNELKFSDSNTYRLKNEERTKNDEERRKIFTDLLTEMSRKHYGSTSTRFFFTKTCFFTQNS

SEQ ID NO: 136364 - protein, 127 aa, Glycine max
  Coding DNA Sequence Number=SeqID_44679
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=4e-24, Identity=100%"; Hit description=LacZ protein
  Subcellular localization annotation: CTP_CleavageSite=12; ConfidenceScore=5.08e-01
MCHWANRQQSARPSYKRPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPARQ

SEQ ID NO: 136365 - protein, 86 aa, Glycine max
  Coding DNA Sequence Number=SeqID_44680
MTKDNSWYLKALHWGNERFPTSRVQSCWMTGPLDGPTSCFLNKGGPLGTSTYLLQRATCPHHQRTTRPHLQRAASPRLQRTTRIQL

SEQ ID NO: 136366 - protein, 300 aa, Glycine max
  Coding DNA Sequence Number=SeqID_44681
  Gene Ontology: Biological process=transposition, DNA-mediated
  Homolog annotation: Hit_ID=Q6UUU1; Match level="QueryCoverage=35%, HitCoverage=90%, E-value=3e-31, Identity=59%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLAIIQKQGNRSYHYGLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPSCALLFLPFGLPGVIPLLWPRLSHSTPDTQFR

SEQ ID NO: 136367 - protein, 44 aa, Glycine max
  Coding DNA Sequence Number=SeqID_44682
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=72%, HitCoverage=4%, E-value=7e-11, Identity=96%"; Hit description=DNA -directed RNA polymerase subunit beta'
MCQEKLVQEAVDTLLDNGIRGQPMRDGHNKVHHFHYIDVDCPAK

SEQ ID NO: 136368 - protein, 128 aa, Glycine max
  Coding DNA Sequence Number=SeqID_44683
MTRSRLATMNEREKGIGAEKQQLKKETTVNLTEQEISEKEEKEKEQEKEKEKMRKMKKKKREKKKSKSEYAREKKREASPAEGKEVPYPLVPSRKNKEKTSSLISGYFQEAKNYHALWRSSTADAALC

SEQ ID NO: 136369 - protein, 135 aa, Glycine max
  Coding DNA Sequence Number=SeqID_44684
MKADTEALKEQMATMSIKEIMEVNAAAIAATSTIAEVDLTPPYGLNQINHPTSNMVGLEGKELGGTGGPHLVQKTSMPSHHMACLPTIRHPMWRTLLMRMSITPLLYSLRANNLNLIMHMSLDPWGRHMKCPTTI

SEQ ID NO: 136370 - protein, 116 aa, Glycine max
  Coding DNA Sequence Number=SeqID_44685
  Gene Ontology: Biological process=transposition, DNA-mediated
  Homolog annotation: Hit_ID=Q1J7G7; Match level="QueryCoverage=33%, HitCoverage=68%, E-value=9e-11, Identity=70%"; Hit description =Transposase
GHQDLFILRSDLPSQWLLFLSPVPPVQLLTGWCVTAKAPPDISAGKCSGRVPLAIQAAQLLGRAIGAGLFAITPAGERGMCCKAIKLGNARVFPVTTLNSIQDHILSRDMEGGHYP

SEQ ID NO: 136371 - protein, 101 aa, Glycine max
  Coding DNA Sequence Number=SeqID_44686
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=83%, HitCoverage=71%, E-value=1e-22, Identity=68%"; Hit description=LacZ protein
MQYLDNGLLPCPWKGYDLVSNSCSPGDPLVLERPPPRWSSNSPYSESYYNSLAVVLQRRDWENPGVTQLNRLAAHPPFASWRNSEEARTDRPSQQLRSLNG

SEQ ID NO: 136372 - protein, 61 aa, Glycine max
  Coding DNA Sequence Number=SeqID_44687
MLAELPTKRAVEEEPVVEKKASLKMACKTINEEEEPLWRRKENGFELRKHGEEEKQMGFVK

SEQ ID NO: 136373 - protein, 149 aa, Glycine max
  Coding DNA Sequence Number=SeqID_44688
  Homolog annotation: Hit_ID=Q6UUU1; Match level="QueryCoverage=40%, HitCoverage=40%, E-value=9e-19, Identity=78%"; Hit description =Putative uncharacterized protein
MVCELVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSHWRLPRALSLFLPFGLP

SEQ ID NO: 136374 - protein, 159 aa, Glycine max
  Coding DNA Sequence Number=SeqID_44689
  Homolog annotation: Hit_ID=A7PT07; Match level="QueryCoverage=73%, HitCoverage=7%, E-value=5e-10, Identity=35%"; Hit description =Chromosome chr8 scaffold_29, whole genome shotgun sequence
QQGFEQFNKLYNSKESRIPADLKYFSNFALSWIFSWQYRYGKTENNKQYPPLQRHTFVKWWSQFDTSKAAPDQVKNWFQSNPEFLKPADPETSLFLNQKSQLAAFLESSKSKESLAQNLKEVLQLLQQEVEEEPSKKEAESSETNDDQEDDPFYQNEDD

SEQ ID NO: 136375 - protein, 295 aa, Glycine max
  Coding DNA Sequence Number=SeqID_44690
  Gene Ontology: Mol. function=transcription factor activity; Cellular component=cytoplasm; Biological process=branched chain family amino acid biosynthetic process
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRQVKLTEYGEKFLQFAKTEWQNWQQFKQQLKDESNELCGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136376 - protein, 162 aa, Glycine max
  Coding DNA Sequence Number=SeqID_44691
MPPTRHPLDPDKSNRALGFPALITGLCQSFGVPVTPSKVIRPPITRAFIEKYCTPRQANPAGSLGMERYLQHLVRQQAANHRWQVQIHECLYQLSLSQQGQGFAHFACPTPEQFRDEVAWPGDWPEAQAGEAPTGAPDDAEEARMDEEMTDLLGFLGGSGAT

SEQ ID NO: 136377 - protein, 98 aa, Glycine max
  Coding DNA Sequence Number=SeqID_44692
NEDKGYVGVRELSWRWAIGDGGGTWRYVAGVRRPWGRQASSWQSTNKRTKTTKQGGLCGGWLAMSLDEIWDMASGNRLPRLENEIRKLGGLLVIDYQG

SEQ ID NO: 136378 - protein, 149 aa, Glycine max
  Coding DNA Sequence Number=SeqID_44693
  Homolog annotation: Hit_ID=Q6UUU1; Match level="QueryCoverage=55%, HitCoverage=47%, E-value=7e-19, Identity=62%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKDTRRFPPGGSLVRSPVPAFRFTGVIPLLWPRLSHSTPDTQFR

SEQ ID NO: 136379 - protein, 125 aa, Glycine max
  Coding DNA Sequence Number=SeqID_44694
  Subcellular localization annotation: CTP_CleavageSite=41; ConfidenceScore=5.17e-01
MAESLKKRKGTSSTTVAASHRRHGPSEAPTTPIHPSLSYPRSSTLFSLDDQRLRYNSQFSSRIILDPKYLDTNFFNDETFDYYQVFQNSGLVDFMSLKLPYYPELVKFFYSNLKIQDDIISSEVH

SEQ ID NO: 136380 - protein, 84 aa, Glycine max
  Coding DNA Sequence Number=SeqID_44695
MTHTKKTGQMTSEVAKEIAEKIMNGEWRRKRERRRHFKEKMSLEEAHHHRRPWIRAWRKKEMSEGIGREEHKILCSKRAMKSEV

SEQ ID NO: 136381 - protein, 149 aa, Glycine max
  Coding DNA Sequence Number=SeqID_44696
MGKVEEVQEQMKADMEAMKEQMATMMEATMSMKKIMEANAVAVATTSVVAKVNPMPPSGPHGKNPHAMAKMGKLDHLEERLRVVEGGRDYAFTEPRRVVPSTQIWSFPSSRCRTLTSTRGILAPKNHLKMYCRKMGAYAKDEKLPIHFS

SEQ ID NO: 136382 - protein, 279 aa, Glycine max
  Coding DNA Sequence Number=SeqID_44697
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNSISSRVPAIKERITQWFGRSLSFTLNQDEAIVRDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136383 - protein, 31 aa, Glycine max
  Coding DNA Sequence Number=SeqID_44698
MPYVFQKSSYACSTRSSQGSDAWSGRRPTKA

SEQ ID NO: 136384 - protein, 257 aa, Glycine max
  Coding DNA Sequence Number=SeqID_44699
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPAVKASMPRPIVDSASVIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136385 - protein, 56 aa, Glycine max
  Coding DNA Sequence Number=SeqID_44700
MWVQAIGLFAQATCAPEFGIPRPFNKRLLVLHIERSELSRIGSWTNGLSYLKKKGG

SEQ ID NO: 136386 - protein, 136 aa, Glycine max
  Coding DNA Sequence Number=SeqID_44701
VGRPRLTTGAGDDGISARQRDSKVCMTDLVSAEDDAFRLTDSKKVYTDNHSGISARQRDSKVSMTELVKVANKSEALAPTYPPMRNSDLRSADNRMVSPRATRFLGHGNKSGVVDKSEALAPTYPQMRNSDLRSSG

SEQ ID NO: 136387 - protein, 157 aa, Glycine max
  Coding DNA Sequence Number=SeqID_44702
MQSQGLALPLEPKVGPLVAHVSTKKSHVDPLGNDPDTGDSEKYRLYIKENPPHLVSLGRLYEGSTIVHNMPLRHNQIKFSVEEVRDEDSPIPVPTQEEKPVDRLNHDVDDPLYLMALTIPHLFLKSLQIMWDATTYDQTSIRAGNVDVYGFLKPRSI

SEQ ID NO: 136388 - protein, 148 aa, Glycine max
  Coding DNA Sequence Number=SeqID_44703
VTDADAPVLVPTNEVSLLGQTIHTFLTWPTHLVKSLSHQATVSSAKPPQKPHPEVDDPLYLMTLTIPELFLRPYQVTWDATMFRVFNPDFPLYIKHEDLSEIAHDGQCLSISVLQLWIMHLTETSMRAGNSNIYGFLEPQSIQRSGQS

SEQ ID NO: 136389 - protein, 47 aa, Glycine max
  Coding DNA Sequence Number=SeqID_44704
MTKARQKGVRKGKEGEACHPARPGELSWRNILEGPSGPGCHLHPPVY

SEQ ID NO: 136390 - protein, 157 aa, Glycine max
  Coding DNA Sequence Number=SeqID_44705
  Homolog annotation: Hit_ID=Q6WAY6; Match level="QueryCoverage=66%, HitCoverage=18%, E-value=3e-12, Identity=35%"; Hit description =Putative uncharacterized protein
DWDQHLAEIGGSAINWFPRWKEGKEGVLFSCGDYPNVPLIGTRGCINYNPALAIGQLGYPMRGAPTEGSLSPFLVKNLGAQGLKVVQRMHKAWKSPLRKDKELRGIRNGVKSEVIRSIPRPYYDQSVEVHRVMEDLQTRPTIARALDKKQIRALKEE

SEQ ID NO: 136391 - protein, 82 aa, Glycine max
  Coding DNA Sequence Number=SeqID_44706
MVPAGEVCIVLGQCASDYMDWFFHISHTFMTSGHASDPLLDVHALQPQVVPQALQTDISHVPEPGAPSTSARPAVEEPRHAV

SEQ ID NO: 136392 - protein, 25 aa, Glycine max
  Coding DNA Sequence Number=SeqID_44707
MAPQQKCMRTNGTERVCSMPLFGNL

SEQ ID NO: 136393 - protein, 72 aa, Glycine max
  Coding DNA Sequence Number=SeqID_44708
MCCKAIKLGNARVFPVYDVVKRRPVNCNTTHYRANWSSTSVAAALELVDPPGCRNSDQPNTFLHIGYYSTDL

SEQ ID NO: 136394 - protein, 222 aa, Glycine max
  Coding DNA Sequence Number=SeqID_44709
  Homolog annotation: Hit_ID=Q6WAY6; Match level="QueryCoverage=20%, HitCoverage=8%, E-value=2e-08, Identity=55%"; Hit description =Putative uncharacterized protein
GVLFSCGDYPNIPLIGTRGCINYNLALVIRQLGYPMRGAPTEESLSPFLMRDFGAQSLKVVQRVHKGVEKPLKIINEENFEAPEEDEEVQALKLELGKVRLTKEKFKSAATNIRKECAELREENAATARALEQETKRAHKEEHGRDKFRGALWGSNNELKLRREERDQSRDFAQAYAEKEARGRVIDALHQEAAMWMDRFALTLNGSQDLPRLLAKAKAIVE

SEQ ID NO: 136395 - protein, 133 aa, Glycine max
  Coding DNA Sequence Number=SeqID_44710
MGEVEEIQEKMKADMEAIKEKMATMMEAMMSVKKIMEANAVAIAATSVVAKAHISQTIGETHEIPHHNLADFEPWLGYATEGQAVGGIPFENPLEGPQYHPQLHLLHSTAVKNPHDYGRNGKVGSSRGKAQGH

SEQ ID NO: 136396 - protein, 58 aa, Glycine max
  Coding DNA Sequence Number=SeqID_44711
MATKGWSFVGASMVEEEEENGNSLAFLCTRRGQFSKVGNIYIKTLRMKPRAWFRGWFC

SEQ ID NO: 136397 - protein, 117 aa, Glycine max; identical to SEQ ID NO: 111924
  Coding DNA Sequence Number=SeqID_44712

SEQ ID NO: 136398 - protein, 310 aa, Glycine max
  Coding DNA Sequence Number=SeqID_44713
  Gene Ontology: Mol. function=protein kinase activity; Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPSFDFSNLDAFNVSNNNLQGQVPDVKGKFHEDSFSGNPNLCGKPLSQECPPPEKKDQNSFPNDLSIYSVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136399 - protein, 175 aa, Glycine max
  Coding DNA Sequence Number=SeqID_44714
ESEEAKGEESSEEIYPQEDGQPLVVKEKCKEISVSSKRLAKKETDFTIKTNIKETFPLKQPPHFLFCKKTLASIATPLGLEFIPQVKKLLDEGLVRKRLNPCALLVPKISIIRHQIPKIGGVMNALGGATLFCKITRAPNIFMICVHRDSLGVPMNPKRIKVLRKKAQSFKNLGI

SEQ ID NO: 136400 - protein, 153 aa, Glycine max
  Coding DNA Sequence Number=SeqID_44715
MDNEEGVQEQMKADLSALKDQMASISEVMLKLQKTIEDKATATASSTVREAELVLQPALNPGLDRNTVVFGRRYSPQAYPYGLPPDFTPRATPEDLSQGPTFEGQLPPYEDYPGQDDGEGDTHLGPLLHLKDPSPHELPQPNIVRHIPASPTP

SEQ ID NO: 136401 - protein, 53 aa, Glycine max
  Coding DNA Sequence Number=SeqID_44716
MAEPLKKRKGSSSTADATAHRCHGPSEASTAPTHPSLSSPRSSPLFSSDDQRL

SEQ ID NO: 136402 - protein, 101 aa, Glycine max
  Coding DNA Sequence Number=SeqID_44717
MGKSLFHIMNIKINRKNKFTNPNQHILYETYGVHSSFRNLAYLGICLMASSRGMFTSTHLKVSKISFSASSIFSFAIALSGNGRGIGDCGKSELLEEGPPA

SEQ ID NO: 136403 - protein, 209 aa, Glycine max
  Coding DNA Sequence Number=SeqID_44718
  Homolog annotation: Hit_ID=Q6WAY4; Match level="QueryCoverage=56%, HitCoverage=21%, E-value=3e-10, Identity=31%"; Hit description =Putative uncharacterized protein
MGSSQKPSLKKRFYQVKIKSLEVTSLRKLGQLMGQLQAFRKAYGKIWDLARVEVSMEPIASLSQYYDQPLRCFTFEDFQLVPNVKEFEEILGCPMGGRKPYLFSRFYPSTTRVAKVVKISAQELDRKEGRIRILSSCEGCPNVLLMGTRGCINYNPVLTIRQLGYPMREVPSDESITPFIAWGFSDHEREGTPRSSQGMGCGVKKGQRA

SEQ ID NO: 136404 - protein, 148 aa, Glycine max
  Coding DNA Sequence Number=SeqID_44719
MAFIIGESFGGSHTREGLLATLPQVHLISAGWLSFQEEGPNVKTNPLASHGKASVNAIQEDGPSQARRLGEVATSRRFIYQSLQAACMVSHGGGERDECLFHLGESHDMETCPAVEVLLQRFMDCGQLEVSIGGREEPQICMQSEEKK

SEQ ID NO: 136405 - protein, 235 aa, Glycine max
  Coding DNA Sequence Number=SeqID_44720
MDGPVEFRGLLGRGVAAGDAADPGHAGRAAVRARRRAEPGHRRHHGRRRLHRLAGGVPGRAAVRGRAGSRAGGRRVRPAARGADGAAGPVAARLGAGRDAAGHQPELLRLPRHLPQREHAADDHAVRRDEVPGRHSADRPGAGRADADDAAGAGRGADPGVGAEPHPGRPGDPHGGREPRRRRGPGPVGDQAAHGRHRRRLGADGRGRQLPHAGGLQRLLLQHGQRPRLGLRGAG

SEQ ID NO: 136406 - protein, 73 aa, Glycine max
  Coding DNA Sequence Number=SeqID_44721
MLTSPERAQMTILASAHQSHLGSLDDEVRITVRGLRGLPALGSWQQKGGVVDKSEALAHTYPPMRNSDLRSFG

SEQ ID NO: 136407 - protein, 184 aa, Glycine max
  Coding DNA Sequence Number=SeqID_44722
MASIGFSCYPVNSKSSVICAESLHFSLERFSTALFLDRWCMRAWTFFGKPLPPWSGWTHMNAITGMPLQFLIFPKNAGVPMPYGLLCIDIGNFVPKSLTRKGDMLSSVGAPLMGQPTDCSTSYPGQKLVPIYSPLFSTRAMAQERTWMSCVLLEQVRNQPNTEDGQATDDPQGKRRLLLVHQTI

SEQ ID NO: 136408 - protein, 237 aa, Glycine max
  Coding DNA Sequence Number=SeqID_44723
  Homolog annotation: Hit_ID=Q6WAY6; Match level="QueryCoverage=76%, HitCoverage=40%, E-value=1e-15, Identity=28%"; Hit description =Putative uncharacterized protein
MASQEKWGPFADILALLIFGVVLFPNVDGLVDLAAIDAFLAYHHSKESPVVAIFDRSAINWFSRWKEGKEGVLFSCGDYPNVPLLGTKGCINYNPALAIRQLGYPMRGAPTEESLSPLLVRDLGAQSLKVIQRVHKAWRSLMRKDKELRGIRNGVIGGYHGWLRVHTRGLDWLSKLKVIDEQNFEAPEEDKEEKFKSAATHIRKEFTELQEENAATARALEQETKRARKEEHGREKF

SEQ ID NO: 136409 - protein, 93 aa, Glycine max
  Coding DNA Sequence Number=SeqID_44724
  Homolog annotation: Hit_ID=A7PHV0; Match level="QueryCoverage=100%, HitCoverage=29%, E-value=9e-12, Identity=34%"; Hit description =Chromosome chr13 scaffold_17, whole genome shotgun sequence
MWAWERCGTLAPRRTHPIIEKKSLGHRWLRWENQHIGNDDLILFRYKLDIMKRHEFFWEPYSANVMSVLPPICLVESVAWCAVMPLICFQVIE

SEQ ID NO: 136410 - protein, 243 aa, Glycine max; identical to SEQ ID NO: 130442
  Coding DNA Sequence Number=SeqID_44725
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein

SEQ ID NO: 136411 - protein, 297 aa, Glycine max
  Coding DNA Sequence Number=SeqID_44726
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIESRCAGLAKQAARATAECSAGQRKNTFRKPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136412 - protein, 16 aa, Glycine max
  Coding DNA Sequence Number=SeqID_44727
MENCTKQSLRIAPNSK

SEQ ID NO: 136413 - protein, 88 aa, Glycine max
  Coding DNA Sequence Number=SeqID_44728
MTSRDQVWSFCTQDTRRYLTVIRTLLSSRGGGPDDKQRPSLVILHPRYAEIPYGYSHPFFCYLQFVKFWEQQVICMWRFYGHPRLSSN

SEQ ID NO: 136414 - protein, 328 aa, Glycine max
  Coding DNA Sequence Number=SeqID_44729
MVLKEELIACSRSKRSLSQRLCETETNMLAIIAKYEEELGLATAHEHRIADEYAQVYAEKEARGRVIDSLHQEATMWMDRFALTLNGSQELPRLLVKAKAMADTYSAPEEIHGLLGYWKNTITKRAARDPYRTRSKSRTMGDQEETQEQMKADMSALKEQMASMMEAMLGMKQLMEKSAATAAAVSSAAEADPTLLATTHHPPSNIVGRGRDTRGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPATEERRKLDLLEERLRA

SEQ ID NO: 136415 - protein, 44 aa, Glycine max
  Coding DNA Sequence Number=SeqID_44730
MASIIVAICSFMASMSAFLYSCTSSTSLITLALARVRGERKDHA

SEQ ID NO: 136416 - protein, 136 aa, Glycine max
  Coding DNA Sequence Number=SeqID_44731
  Subcellular localization annotation: CTP_CleavageSite=45; ConfidenceScore=5.38e-01
MVKVGTSYVPINVSFRQKLAQGFPWRIWFLSAVPSCSATEFGVVSASQFGTQAYRAGSISAASVAVPDAAANSPPAGLIAAATGRVPFQSGLRQLLMTASAGDRGGLLRYYAGAKGGCGVSQSKCCGKSDVRQQNM

SEQ ID NO: 136417 - protein, 96 aa, Glycine max
  Coding DNA Sequence Number=SeqID_44732
MAKFDPDIVLEFYANAWPTEEGVRDMRSWVRGQWIPFDADAISQFLGYPLVLEEGQEYEYRQRRNREASANYVHQHDHPDPDMDDVAAQQHPAQRS

SEQ ID NO: 136418 - protein, 83 aa, Glycine max
  Coding DNA Sequence Number=SeqID_44733
MPLKGKQLVVYPLKTLRKALSITPNHNPHVPQRFKTLMTMAGMGKLDHLEERLRAIKGGEDYAFANLEELFLVPNIITPPKFK

SEQ ID NO: 136419 - protein, 168 aa, Glycine max
  Coding DNA Sequence Number=SeqID_44734
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTLISANIGTKAGTGPPLEVDGIDKLDPTKLKDWDWVQRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 136420 - protein, 50 aa, Glycine max
  Coding DNA Sequence Number=SeqID_44735
GFIGALSGDFSKVALPLSSWGQREVEFDFDDRCKEAFDCLKRAVTTTPII

SEQ ID NO: 136421 - protein, 58 aa, Glycine max
  Coding DNA Sequence Number=SeqID_44736
MAKTSAKDPGRSVHSALHDHTQHPTYERGQKLVPKTLKGQCTMPPTNIHNMHMPMGIL

SEQ ID NO: 136422 - protein, 42 aa, Glycine max
  Coding DNA Sequence Number=SeqID_44737
MTDMENPPLRSFMALLICNEIMVLDQEPIEGDTIGNGVRKSW

SEQ ID NO: 136423 - protein, 64 aa, Glycine max
  Coding DNA Sequence Number=SeqID_44738
  Gene Ontology: Mol. function=aspartic-type endopeptidase activity; Biological process=DNA integration
  Homolog annotation: Hit_ID=A5C737; Match level="QueryCoverage=100%, HitCoverage=15%, E-value=1e-19, Identity=57%"; Hit description =Putative uncharacterized protein
MKKECPKYTAWRVKKDTWWVDSGATTHISMTMQGCLWSRLPSDDERFIFVGDGKKVAVEAIGTF

SEQ ID NO: 136424 - protein, 56 aa, Glycine max
  Coding DNA Sequence Number=SeqID_44739
MKLQKAHRIVKYLKLKRMNLSIELKELVLDKPKVLNLDPSLGEVNSSFVLRSLLLD

SEQ ID NO: 136425 - protein, 227 aa, Glycine max
  Coding DNA Sequence Number=SeqID_44740
  Homolog annotation: Hit_ID=Q2HW90; Match level="QueryCoverage=66%, HitCoverage=34%, E-value=2e-14, Identity=35%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVAKYQGSVWRKGQRPWQIKANGLSFIDILALLIFGVVLFPNMEGLVDLAAIDAFLAFHHGKESPVIAILAMYDTFNRGCEKSGARIDSIFMRRMSHERSAIRRKHHAFSSHEVSVTTTLGVLQGRFARAWGCGVKKGTESLGGRQ

SEQ ID NO: 136426 - protein, 141 aa, Glycine max
  Coding DNA Sequence Number=SeqID_44741
  Homolog annotation: Hit_ID=A6FJQ2; Match level="QueryCoverage=26%, HitCoverage=84%, E-value=2e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARKTQLQYHGLSVLTKLIQIKAAIAVIRNVRGLPPVQDFKKDGAFVDLFDFLQHCFGFQ

SEQ ID NO: 136427 - protein, 73 aa, Glycine max
  Coding DNA Sequence Number=SeqID_44742
MGLFWYNAVVSPVPLAIWPCKGSSQFDLDLQQARARLSKLFRFQMAVLFSNGRALDGVNGYSKWCWRDHAIWI

SEQ ID NO: 136428 - protein, 112 aa, Glycine max
  Coding DNA Sequence Number=SeqID_44743
  Homolog annotation: Hit_ID=A6T8V2; Match level="QueryCoverage=93%, HitCoverage=82%, E-value=1e-42, Identity=79%"; Hit description =Putative uncharacterized protein
GATRTDFNRHFSPVYRQRTNNEWEGLDGFAQHARKLREIIASGKIEVCDELRDGNLYATRHRVLCTKHNGEEVDMEVYMFAETDDDGRFIRVEEATLMLRGVESDRGLGKVR

SEQ ID NO: 136429 - protein, 185 aa, Glycine max
  Coding DNA Sequence Number=SeqID_44744
  Homolog annotation: Hit_ID=A5BYI9; Match level="QueryCoverage=96%, HitCoverage=11%, E-value=1e-11, Identity=29%"; Hit description =Putative uncharacterized protein
EPINILQYADDTAFEGDALWENVLVLKALLRGFELASGLKINYAKSQFGIIGGMEFQLRRDKRGFSNWWKDLRKIYHQSQHSIFHQNMVWKIGCGDRIDFWHDRWVGECTLKQQYNQLFMISSQQHNLISMMGNFSQDNWRWDLQWRRNLFDHEHDLAVSFMEDITSICIQRNVKDIMMWKAEPN

SEQ ID NO: 136430 - protein, 53 aa, Glycine max
  Coding DNA Sequence Number=SeqID_44745
MGSKFESRPSRNILEVGLLKESHNLPFGGRATCDSRDACSMKGIRAESPPTFI

SEQ ID NO: 136431 - protein, 172 aa, Glycine max
  Coding DNA Sequence Number=SeqID_44746
MPYVEAAEESLETAFQSFEVVSIASVDSFSGKPCLSDTAVMVARVMLGNSYEPRMSLGKDNDGRTCLISARGNHEKFGLGYKPIQADIRKSVAGRKSGGQGLRLVQEVEGGPPCHISRSFISAGLGHEGQVVVICKDDSPSGSVLVRPCPPGFRLGNWRVEENPDIYATSIM

SEQ ID NO: 136432 - protein, 244 aa, Glycine max
  Coding DNA Sequence Number=SeqID_44747
SRGSPVRGHLVKIDADSLNAFLETPVVLAEGETLPAYSRYCRLPTNFREIEAALCIPGRGFILNSEGHPGRILRKDLTTLAQVWSVLSYSNLAPTSHTSDLTVDRARLIFGLVSHLDMNIGALISGQMASIAQSNTSRLGFPTLITALCRARRVVSDSLTFERLSPVINLAYIWKNCWNPEDLTVSIRGMIAPPDSIHKEDEGPTAQVPEYMEDESSEATIPEPFDIGEEVEETQVRPVAATTP

SEQ ID NO: 136433 - protein, 110 aa, Glycine max
  Coding DNA Sequence Number=SeqID_44748
MSHHSSSVNGKGRHRSHLRPHSHRREKERKPQEVNIKLSYFHGKDNVEANLDWEIRVEQQLKKKSTSKSDGSHSYPKKDQGQGILGVTPSKPKDDTGKTIEKQAKMRLLL

SEQ ID NO: 136434 - protein, 123 aa, Glycine max
  Coding DNA Sequence Number=SeqID_44749
  Subcellular localization annotation: CTP_CleavageSite=51; ConfidenceScore=5.23e-01
MHTQGFTIPQFLRIGLTLKKVPSGVANCRNVPFCGRAKAWLTGALSKGGKMCGVATNVYLWKTLEKPKETGRNENSKFGSCIYVRGRSTKAGLLLLRTLHQRGNQTCVILPLKVNQAILLLER

SEQ ID NO: 136435 - protein, 97 aa, Glycine max
  Coding DNA Sequence Number=SeqID_44750
MGCGLWLENEVRKLREPLRDGSLVIDYQIVMAAQLIHDRVEMECLEGAWETLEGNTRCRFRGTIRFTATSLVHPDEPARTLQRTVEWTAFWISFVYF

SEQ ID NO: 136436 - protein, 84 aa, Glycine max
  Coding DNA Sequence Number=SeqID_44751
PRLFRFFRCFPQINVGGDSVRILFLENAPVSHVSPSRRRVGKWLRAHVQGLDWLPSLRTAKREEIEAPEEDEEVQALRTELEQA

SEQ ID NO: 136437 - protein, 133 aa, Glycine max
  Coding DNA Sequence Number=SeqID_44752
MLQMKWLRKKLSAKRSRWDAAAEGTSAAPEFDSHRFRSAEHQQHFEAIKGWSFHRERRVQLRDDEYTNFQEEIARRHWTSLVTPMAKFDPDIVLEFYANAWPTEDGVRDMRSWVRGQWIPFDANASASSWVTR

SEQ ID NO: 136438 - protein, 106 aa, Glycine max
  Coding DNA Sequence Number=SeqID_44753
  Homolog annotation: Hit_ID=B0HC01; Match level="QueryCoverage=25%, HitCoverage=57%, E-value=8e-07, Identity=100%"; Hit description =Putative uncharacterized protein
MFFPALSLILWITVLPPLSELIPLAAAERPSAASHWHDRFPDWKAGSERNAINETGMTMMPPTRPNVPPRSWPWRVVVTFAPGHARHRRERVPGGLRGAGPFPRGA

SEQ ID NO: 136439 - protein, 94 aa, Glycine max
  Coding DNA Sequence Number=SeqID_44754
MMITKDDHKGDDKKLKDQSKNNSSDQDRIKNNSRVQDRIKKNSRLKRKVKSQESRFKVQDLKNQDQDSRHKIQESRESLIKISMKSFSQKLSST

SEQ ID NO: 136440 - protein, 54 aa, Glycine max
  Coding DNA Sequence Number=SeqID_44755
MLQFTAVRAWRQGEQKADVTILLSPLQILLCLITLIMKVADPTCMTARTCSGSV

SEQ ID NO: 136441 - protein, 49 aa, Glycine max
  Coding DNA Sequence Number=SeqID_44756
MENDKHMATPMSTACYLDKDETDQSIDVKQYRDFNQIPNNHILVPLKES

SEQ ID NO: 136442 - protein, 61 aa, Glycine max
  Coding DNA Sequence Number=SeqID_44757
MEMYQLTWIVIGMQNKERKMQTISTNTHQKCTIAQVSVWGLAQQAALSAFCNTIFCNMRLA

SEQ ID NO: 136443 - protein, 122 aa, Glycine max
  Coding DNA Sequence Number=SeqID_44758
MSRESGDLGDIRWGAIVQNQAWLIPTQPGHSQSVRTCDVPKQASSWQSTNKRTKSTKQGDLCGGWPAMYLGWYLKITLWALVIDYQLCVIDYIVLPATGNRLPFMCNRLHSVTCRFQCAKVE

SEQ ID NO: 136444 - protein, 335 aa, Glycine max
  Coding DNA Sequence Number=SeqID_44759
  Gene Ontology: Mol. function=motor activity; Cellular component=cell projection
  Homolog annotation: Hit_ID=UPI00016621D1; Match level="QueryCoverage =76%, HitCoverage=41%, E-value=8e-26, Identity=38%"; Hit description =UPI00016621D1 related cluster
HALTFRGLHVLTFRGLQVLTFRGLHVLTFRGPHVLTFRGLHALTFTGLHTLTFIGLHVLAFRGLQVLAFRGLYGFLTFKGPYVLAFRGLQALTFRGLHVLAFRGLHVLTFRGLHALPFKGLHVLAFRGLHVLTFRAPHVLAFRGLHAFTFRGLHVLSFRGLQVLAFRGLHVLTFRGPHVVTFRGLHVLAFRGLHVLAFRGLDVLTFRGLHVLAFRGLHALAFIGLHVLAFRGLHVIAFRGLHVLAFRGLHICAFRELKAGAGRDTTTAWGWPTAGNRRTAATPRAPQLIYKSWSVAYDPWPTSTRPSPKPKLSKSTRPVTDKSSHVRLKTLKKRY

SEQ ID NO: 136445 - protein, 64 aa, Glycine max
  Coding DNA Sequence Number=SeqID_44760
  Subcellular localization annotation: CTP_CleavageSite=55; ConfidenceScore=5.01e-01
MSFLMVVVLDAGKNFSKNTLLRSSQLKMDLGARGLHGGTNNMEPLKMLMRIFTCKTMKLGQQMY

SEQ ID NO: 136446 - protein, 40 aa, Glycine max
  Coding DNA Sequence Number=SeqID_44761
MESAKHMATPMSIACYLDIKQYRDFSPILKQSHLSAVKRL

SEQ ID NO: 136447 - protein, 82 aa, Glycine max
  Coding DNA Sequence Number=SeqID_44762
EGTYWVRTSNLPLGSLEAHARCPSLPQCKALRYQSLSCFHSLVSNDSYVEARCFDVLMMPKDQVLPSFIQGKNPRIQEDQDI

SEQ ID NO: 136448 - protein, 19 aa, Glycine max
  Coding DNA Sequence Number=SeqID_44763
ADNQKVFPYATRLLGHDSK

SEQ ID NO: 136449 - protein, 101 aa, Glycine max
  Coding DNA Sequence Number=SeqID_44764
MAALEREGSSGLVSTEAQLTTSKDWKVVSNDSFVASTYALKGPLPRMNPRSPQEAAIGGIYVHHLKHHIASVGAYLNGNVDFPHHFPPSTIEGSYHHRTWF

SEQ ID NO: 136450 - protein, 179 aa, Glycine max
  Coding DNA Sequence Number=SeqID_44765
MARIAKVVKISAQELDQVKQNRNGVVRIPRKHLEEKAKALEDQGEWASFIDVLALLVFGVIFFPNVDGLMDLAAIDVFLAYHHSKESSVVAILADAHDTFDRSSWAKCITTAKPSIRALSAKENLAEHQHQCAKREISALSAKGAFSQAKRKTGANPISLTRAKPGGGAKRNVANSDPI

SEQ ID NO: 136451 - protein, 99 aa, Glycine max
  Coding DNA Sequence Number=SeqID_44766
MLQPCGIGTGLKEHSNWVYLSPRPTLQRIRQGLSLLIQFYLVALVIKLVGSPHWFPSQYSSFLKGLSINSSSLKGLNINSSPLKDLNINSSPLKGLIVV

SEQ ID NO: 136452 - protein, 50 aa, Glycine max
  Coding DNA Sequence Number=SeqID_44767
MKKIHGLKVPHGATSCGNWKGALVPYLEEFESRRKGPTTLRAIGLRSTPN

SEQ ID NO: 136453 - protein, 129 aa, Glycine max
  Coding DNA Sequence Number=SeqID_44768
  Subcellular localization annotation: CTP_CleavageSite=31; ConfidenceScore=5.39e-01
MPEYSFQVPSTSKVFYGPSQRFGTTFNTPPSAYNVPPLSSYYRPSLSTQMCHMGYEDEEEDDNNKNTNHNNDDDDNGGDHVPQQQHKITRDHPTLLQNVNSLEASIVERYIAEEAIEKKGYLFIQLRSI

SEQ ID NO: 136454 - protein, 184 aa, Glycine max
  Coding DNA Sequence Number=SeqID_44769
MERPGNSKWHLNDDKTMTMIVDTLPVFYYGKWWATHLQSFEDLVFASERIDVGMKKGKFSHPAWTNEKTGANEEGEKEGETHAVTAIPIRPSFPPTQQCHYSANNKPPPYPPPSYPQRPSLNQPQSLSTALPMTKTTFNTNQIHQQKGILQQTACRVHPKFRCHMLNLIPYPLDNSMVAITPSK

SEQ ID NO: 136455 - protein, 55 aa, Glycine max
  Coding DNA Sequence Number=SeqID_44770
MANRLQEDWARDAGEGPRVLMSLSHTLCMSFMLYMPHNSKAHLVENLGLDLGLVG

SEQ ID NO: 136456 - protein, 114 aa, Glycine max
  Coding DNA Sequence Number=SeqID_44771
MAEKTKNKLEEVAQSESTEAMIDPPSPIRRHMKWKMISTKKTRQMTSEAAKEIAEKIELLTAAIRRPKHPGRVCDTGVGGLALPPEPEVGPSAARVSTKESCVDPSGNDPDTDD

SEQ ID NO: 136457 - protein, 111 aa, Glycine max
  Coding DNA Sequence Number=SeqID_44772
MSEAQIIAHATQLHEAQQKKRAEDVVVVAITEKELVAILGREAISTIQVKTYAKVVGDTLCEKMKNKKVVVAGVSLSEACALSENYPLSEALSPLRELGKSRGESAQHLRA

SEQ ID NO: 136458 - protein, 138 aa, Glycine max
  Coding DNA Sequence Number=SeqID_44773
MAQPPPHERTLREMAACDILEFLPGIFSKISPHFYSKSQGEAIFGVVKHTSTLWGFEFQLFVKEFVESMLNLTCLIKLVEMMGRVNLGLNVRMVVMKSWAEQVRKRINKCERKEPFLGKCLCIASHGKSSTFRVPGRF

SEQ ID NO: 136459 - protein, 109 aa, Glycine max
  Coding DNA Sequence Number=SeqID_44774
  Subcellular localization annotation: CTP_CleavageSite=31; ConfidenceScore=5.08e-01
RDRTQETPSGPRKVQQGPGVSSSGYGPLSVLQGARTPPARSRHHRDRDCKTPSGPEEVQQGLGIFYGVPVTSSKGIRPPTNRAFIKKYCAPDRHRAKHHSSIGMVGSGK

SEQ ID NO: 136460 - protein, 259 aa, Glycine max
  Coding DNA Sequence Number=SeqID_44775
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=34%, E-value=1e-138, Identity=91%"; Hit description =Photosystem I P700 chlorophyll a apoprotein A1
  Pfam annotation: Domain name=PsaA_PsaB; Domain location=7-259; Score=- 69.1; E_value=2.2e-05; Accession=PF00223.10; Description=Photosystem I psaApsaB protein
MGKTRSFLKNIAKGPDTTTWIWNLHADAHDFDSHTNDLEEISRKVFSAHFGQLSIIFLWLSGMYFHGARFSNYEAWLSDPTHIRPSAQVVWPIVGQEILNGDVGGGFRGIQITSGFFQIWRASGISSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTG

SEQ ID NO: 136461 - protein, 158 aa, Glycine max
  Coding DNA Sequence Number=SeqID_44776
CVVGTKQVVVQAIGSIDRNTKLQGVPFVVELTILAAVSPMKNQLMKSIIWGTSQGKISMHVDIPGFNMASHIIHSRDSGGITLLADRPSSSFSANTEKNLKEECKVVMTRSRMTVQANEGRAEEKEEGYKQQSAAEPALELVSDFVELEEVVEDEDDQ

SEQ ID NO: 136462 - protein, 117 aa, Glycine max
  Coding DNA Sequence Number=SeqID_44777
  Subcellular localization annotation: CTP_CleavageSite=77; ConfidenceScore=5.15e-01
MLVRMIRTHLFAAARGKSCPGMHSRCVIASLSGCARTVGHRPISGVWIWSTLKMRTRSPLKARACSPLQARMCSPLMARTYSPLKVIGTSTQGSTFMRKQEIDSSRGPVIQQDWTRD

SEQ ID NO: 136463 - protein, 188 aa, Glycine max
  Coding DNA Sequence Number=SeqID_44778
  Pfam annotation: Domain name=Transposase_23; Domain location=43-113; Score=-4.5; E_value=0.0037; Accession=PF03017.5; Description =TNP1ENSPM transposase
SQFQSQMQSQGLALPPKPEVGRSATRVSTKESCVDPSGNDPDTGDSDKCGLYIEEYSPHLVALGRVYEGSTTIHNIPLLHDQVKVGVQEVRDADAPIPVPTKEVKVMGQTLNTFLAWLTHLVKPVGPVKLADRPNHEVDDPLYLMTLTIPQLFLKSLQVIWDATLFGLFNEDFPLYIKHEDLSEIAHG

SEQ ID NO: 136464 - protein, 133 aa, Glycine max
  Coding DNA Sequence Number=SeqID_44779
GEACRPARPGEQGCFLQKQHPSGGIFWRAQVGLELRKLTDCAKTPLFDFRHITEFHGSRKPASGDAHQAAGAPPPPRQADPAGPLGVERYLQHLVRHQAANHRGQGQGSAPFVCPTPEQFGAEVAWPRDWPGA

SEQ ID NO: 136465 - protein, 188 aa, Glycine max
  Coding DNA Sequence Number=SeqID_44780
MGKVEEVQEQMKADMEAMKEQMATMMEAMMSMKKIMEANAVAVAVTRAVAKVNSMPPSDLNQMNHPTLAMVGKDLGMRISITPLPYSLRADNPKLIMRMSLDPLGRHMKCPTTIKPTSSLASDMPLKGKQLVVYPCKTLWRALSITHNHSPCIPHRVKPSCYGRNGKVRSSRGSFRPIEGGEDYALLP

SEQ ID NO: 136466 - protein, 69 aa, Glycine max
  Coding DNA Sequence Number=SeqID_44781
DRRPQEVNISLPYFHGKDNVEIYLDWEMKIIGDPPVEYWNDLKSALRKRRIPPTMKESFWTSSKGLDKG

SEQ ID NO: 136467 - protein, 138 aa, Glycine max
  Coding DNA Sequence Number=SeqID_44782
MELQRLNQNEETDKRKRSIPLKVSSSMQEEEKEEESDDEEDFSLFVKKFHKFVKNRRMEKSHNFNNRKRSQEFSPTLKCYKCNQTSWPEKNEKKSYKERRSKKAYIAWDHNDSFDGLEKEINLLSKEYESDENISQEV

SEQ ID NO: 136468 - protein, 156 aa, Glycine max
  Coding DNA Sequence Number=SeqID_44783
  Homolog annotation: Hit_ID=A5B3J2; Match level="QueryCoverage=95%, HitCoverage=27%, E-value=2e-11, Identity=32%"; Hit description =Putative uncharacterized protein
MFSCMQRRSTAGDLIPIDLEINATCRRCNQERIRKILQDLEAATIPEEEPQSSEASFSFPITGHSHLDPIEDHIMDEEPRRVTLEDYSSSNVPQFFTSIAQLEVQAQTITYPPSLIQLIQNNLFHGLPNEDPYAHLATYIEICNTIRLVGVLEDAI

SEQ ID NO: 136469 - protein, 74 aa, Glycine max
  Coding DNA Sequence Number=SeqID_44784
MKHAGVGRYATSVELDRKDPAGLHRNVRSASSGDTSFSNLDRSSLLADAGLHCVRSVSANHIFLTRWANVFPAE

SEQ ID NO: 136470 - protein, 111 aa, Glycine max
  Coding DNA Sequence Number=SeqID_44785
MSSQLLRLNHLGRTLLGFGAIFTEFLRELSRASGILYLPTCVGFGYRNIHVAISTTPIGGDLTLTHPPWTNLCGGVPLGFRLIGFHVPQCYSGQANASSASSSTARAGPSL

SEQ ID NO: 136471 - protein, 139 aa, Glycine max
  Coding DNA Sequence Number=SeqID_44786
MMNVLSGATLFGKITRTPNIFMVCVHRDPLGSDQGVPMNPKRIKVIPEWPTPPTPLIELVRNRVPSWEEAQEMGFQTLSYFNIPNTTNTYVFVLFTGVEGRSPEYEEPRDLRSNPFQGGGNLMEACLWGFCGGWIFELQ

SEQ ID NO: 136472 - protein, 149 aa, Glycine max
  Coding DNA Sequence Number=SeqID_44787
  Homolog annotation: Hit_ID=Q2HST2; Match level="QueryCoverage=41%, HitCoverage=12%, E-value=3e-08, Identity=41%"; Hit description =Peptidase aspartic, active site
MAQEPTDIATTSKEVDPPVARGAEKKEGLQGKTVTLEEAHEFLRLIPPPQSTKQVLNDAHVAHDISVEGFEGIVNHITTNNYIAFAEEEIPIEGRGNNKALHVSVRCMDHVVAKLPLGKTVDSCPGSGPFNASPEIEVRSGWTFSDSIG

SEQ ID NO: 136473 - protein, 67 aa, Glycine max
  Coding DNA Sequence Number=SeqID_44788
RYRPLIGLSRASSPLGNRDGMVSQRALLRTSEGEAHGCAFQRRKDARSRHQRLFMENVGKTEGNRSK

SEQ ID NO: 136474 - protein, 163 aa, Glycine max
  Coding DNA Sequence Number=SeqID_44789
MEHNGDKGNFLLWDATCIKLSGKTAGECRDELIAVGDDIKVFPTCVDEILLKTWAVRFKFRSQLRQSSVLDVSEELHHIQSLIATLGLKEQSNKGKGIAVEPESSPPIFVPTPPLPQSSDYDPGNSTCLTPTKRISCQQSSSDFDSDEHAQYQLSTNKHIKAE

SEQ ID NO: 136475 - protein, 62 aa, Glycine max
  Coding DNA Sequence Number=SeqID_44790
MGFSSESQSSGRDDRPQPDNSTLLIECFASIRHAWTPYAGKDLPNTLIFLKRLNKKGGALPA

SEQ ID NO: 136476 - protein, 61 aa, Glycine max
  Coding DNA Sequence Number=SeqID_44791
MAGVGPYMAPTDIFQPTLGNFFYKCWPIMFFFYDRGSRLGFSVRAQPRVRSDGHWHVVLLI

SEQ ID NO: 136477 - protein, 96 aa, Glycine max
  Coding DNA Sequence Number=SeqID_44792
SAYKVLQEDHNNADEDRASKIMQRLKIPPRASAFSWRLFKNRLPTRDNLRRRQVTLPSYNCPLCEHKEESAKFYNQEMGIPVDSSVFVHLASQKWH

SEQ ID NO: 136478 - protein, 128 aa, Glycine max
  Coding DNA Sequence Number=SeqID_44793
  Homolog annotation: Hit_ID=A6FJQ2; Match level="QueryCoverage=29%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPGDAGLAGASSKEGKRAELPPTFIRGKRRKNQKRRGLRTLSE

SEQ ID NO: 136479 - protein, 69 aa, Glycine max
  Coding DNA Sequence Number=SeqID_44794
METYPVRPILQFPIFNFFLCLSSAENEVLMKWTYLSIDLTQLLLHNTGDANFAKRKLIMEPEMTRWNTR

SEQ ID NO: 136480 - protein, 67 aa, Glycine max
  Coding DNA Sequence Number=SeqID_44795
ITTHGSKLEGGGHMNENAIHGGAEKRLRMENCTKQSPRIGYKLEGGGHMNENAIHGAPKKIENGELH

SEQ ID NO: 136481 - protein, 120 aa, Glycine max
  Coding DNA Sequence Number=SeqID_44796
MEAPAIVEDIVLDIPADTGVEAVEDKHEGFPGGPSDPSVLTLYADHVACSVWTREKRLELKLSSHGRKVHSLGRPVPAIEGLVAGTRLSPLIACSVDTGDRGLSPRLWSSGTGRRLVSIS

SEQ ID NO: 136482 - protein, 69 aa, Glycine max
  Coding DNA Sequence Number=SeqID_44797
  Subcellular localization annotation: CTP_CleavageSite=50; ConfidenceScore=5.05e-01
MQKTTLVSACYHALSLRDSKRTFAGYRQVSPHVTGLLGHGNNGGVVDKSRAFAPTYTQFVMRNSDLRSS

SEQ ID NO: 136483 - protein, 18 aa, Glycine max
  Coding DNA Sequence Number=SeqID_44798
FMIPTWLAHEENARIMHE

SEQ ID NO: 136484 - protein, 147 aa, Glycine max
  Coding DNA Sequence Number=SeqID_44799
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLELGHVGVVVTGTELEFVIMVIAVSFGKPVVPAALMNRPTRGERRFAYWALFRFLAH

SEQ ID NO: 136485 - protein, 45 aa, Glycine max
  Coding DNA Sequence Number=SeqID_44800
RYARTSQGSRLEDGGHMNSARQWIHGAPWKVENWRTALRNNFAGL

SEQ ID NO: 136486 - protein, 201 aa, Glycine max
  Coding DNA Sequence Number=SeqID_44801
MADTYSAPEEIHGLLGYWKNTITKRAARDPYRTRSKSRTMGDQEETQEQMKADMSALKEQMASMMEAMLSMKQLIEKNAATAAAVSSAAEADPTLLATTHHPPSNIVGRGRDTLGHDGSPHLGYNRAAYPYGLPPNYSPPVLQEDAGHIASPVLEREPPQQPDEVHKDPQDYARRDVEFYPPIPKGRHPARCLNPTSRLNQ

SEQ ID NO: 136487 - protein, 76 aa, Glycine max
  Coding DNA Sequence Number=SeqID_44802
MHKCPRCAVSQYKVKDDDECSSDESSKTLHGMQMGEIAMECFAIRPIPPRERRLMVYIRILVKRQEILGLDLPLME

SEQ ID NO: 136488 - protein, 61 aa, Glycine max
  Coding DNA Sequence Number=SeqID_44803
MNTKSDQGLPMNPKRVKVILEWLTPPSVEERINEFQEPRDLTSNPFQGGGNDAILPSKGIG

SEQ ID NO: 136489 - protein, 136 aa, Glycine max
  Coding DNA Sequence Number=SeqID_44804
AIHYICPYLASSPYILAPLLFFAFIYTIQMNALSAAVALSAFIFSVELSGELAKCGYALSEYYMASRKRKASASVAQARYDRSKFTSQDAWDRYADNILGRKILPERNVKLFYAEFDEFRREVERRNWHKKLTNFS

SEQ ID NO: 136490 - protein, 138 aa, Glycine max
  Coding DNA Sequence Number=SeqID_44805
MAGTNSEGLCGVVTVCLRSKRSLSQRLCETETNMLAIISKYQAELNLATAHEHKVADEYARVYAEKEARGRVIDSLHQEATMWMDQFALTLNGSQELPRLLAKANAMADTYSAPEEIHGLLSYCQHMIDLMAHIIRNR

SEQ ID NO: 136491 - protein, 169 aa, Glycine max
  Coding DNA Sequence Number=SeqID_44806
  Homolog annotation: Hit_ID=A6FJQ2; Match level="QueryCoverage=22%, HitCoverage=84%, E-value=3e-11, Identity=92%"; Hit description=50S ribosomal protein L5
MTVKPRTHAAPGDGHSLSVSGCREQTSPSGRVSGCCRMRKEKIPHQAPFAIQAAQLLGRAIGAGLFAITPAGERGMCCKAIKLGNARVFPVTTLGHPVRPSAGGGYRARIRNHGHSCFLRETCRASCINESANARGEAVCVLGALPLPRSLTRCARSFGCGERYQLTQR

SEQ ID NO: 136492 - protein, 51 aa, Glycine max
  Coding DNA Sequence Number=SeqID_44807
MEKSEKKNINEKKLKKAYITWDENDMESSEDSENEEINLCLMAKSYESDEE

SEQ ID NO: 136493 - protein, 75 aa, Glycine max
  Coding DNA Sequence Number=SeqID_44808
  Homolog annotation: Hit_ID=B0HC01; Match level="QueryCoverage=44%, HitCoverage=70%, E-value=3e-11, Identity=100%"; Hit description =Putative uncharacterized protein
MEKRQQRGLFYGSWPFAGLLLTCSFLRYPLILWITVLPPLSELIPLAAAERPSAARNSYDHDYEFELGTSLNRRL

SEQ ID NO: 136494 - protein, 111 aa, Glycine max
  Coding DNA Sequence Number=SeqID_44809
MVYDLDDIFVSLPNKWTCFKKHDLQMGKLDMNLGISLDAKFDIAEATKVKTKVMSTVATRWRQFKSTLTSKFVFAKSEGQQTQDVVTKYGLDPEAWKQFEETRLTPNWEVS

SEQ ID NO: 136495 - protein, 63 aa, Glycine max
  Coding DNA Sequence Number=SeqID_44810
MLKIGNSGKVVIKQDMKGRRHKYGFNNNKREKAENKRVVDDETGDKHQLDEVLRMPCTILCLL

SEQ ID NO: 136496 - protein, 78 aa, Glycine max
  Coding DNA Sequence Number=SeqID_44811
MMIWKQRAKLVMATARWALKHPVYGIVILRLGTYTNRPNVSKLCSFISSMNPSILISDDVPKGKFYKIPQQTLSTNNE

SEQ ID NO: 136497 - protein, 72 aa, Glycine max
  Coding DNA Sequence Number=SeqID_44812
  Subcellular localization annotation: CTP_CleavageSite=42; ConfidenceScore=5.34e-01
MHTQGFTIPQFLRIGLTHKKVPSGVVNCRNMPFCGRAKARLMGALSKGGKMRGVATNIYLWETSENQRNRSK

SEQ ID NO: 136498 - protein, 145 aa, Glycine max
  Coding DNA Sequence Number=SeqID_44813
  Subcellular localization annotation: CTP_CleavageSite=67; ConfidenceScore=5.57e-01
MRGSGEFVPFLDTTSRGSKMPPRTFLRRRHGPSVGSPPASTPPPPPPPSPHSPPPPPPPSDASALPSAVKRTRKASRLRSLSTRPPGAERPVVHVDPAIWKADGPHRKKLRTYLEIVARDKVDVTYENWKEVPTAQKDLIWEDIQ

SEQ ID NO: 136499 - protein, 281 aa, Glycine max
  Coding DNA Sequence Number=SeqID_44814
  Gene Ontology: Mol. function=transporter activity; Cellular component= mitochondrial inner membrane; Biological process=transport
  Homolog annotation: Hit_ID=Q5QJQ3; Match level="QueryCoverage=38%, HitCoverage=87%, E-value=2e-51, Identity=88%"; Hit description =Putative uncharacterized protein
  Pfam annotation: Domain name=Mito_carr; Domain location=49-144; Score= 16.3; E_value=9.4e-05; Accession=PF00153.18; Description =Mitochondrial carrier protein
DAGSRQARQGASAGVGGCRGWLNYAASEQIVLRVHHMRAIGAGLFAITPAGERGMCCKAIKLGNARVFPVTTLSTLEDPQTRLQVATKDAVERNVFSVAKGLLKTDGIPGLYRGFGTVITGAIPARIIFLSTLETTKVTAFRMLEPFGYRARIRNHGHSCFLGISSLKGGNTVIRQNQGITQERTCSGPLTSITKIDAQVRGGETRQDYKDTRRFPLEAPSCALLFRPCRLPDTCPPFSLREAWRFLIAHAVGISVRCRSFAPSWAVCTNPPFSPTAAPYP

SEQ ID NO: 136500 - protein, 241 aa, Glycine max
  Coding DNA Sequence Number=SeqID_44815
  Homolog annotation: Hit_ID=Q2HW90; Match level="QueryCoverage=70%, HitCoverage=39%, E-value=2e-17, Identity=32%"; Hit description =Putative uncharacterized protein
MGQLQRQAFRKAYGKIWDLARVEVSMEPIASLSQYYDQPLRCFTFEDFQLVPTVKEFKEILGCPLGGRKPYLFSGFYPSTTRVKESVWRKGQRPWKIKANGLSFIDILALFIFGVVLFPNMEGLVDLAVIDAFLSFHHGKESPIVAILSMYDTFDRGCEKSDARIFCCALALFVWLVSHPFLQEGRPVYPLQGHRSGVEKGKANWDQLLASMEGRLLIGSLARRKEESGFYLHAKDVQMFS

SEQ ID NO: 136501 - protein, 65 aa, Glycine max
  Coding DNA Sequence Number=SeqID_44816
MTRARSWKANEALQQVLSILFEYKPKFQGKSSSCNKGPIGNLGISLLGDQMVAGLMAVGGDFWLP

SEQ ID NO: 136502 - protein, 124 aa, Glycine max
  Coding DNA Sequence Number=SeqID_44817
  Subcellular localization annotation: CTP_CleavageSite=47; ConfidenceScore=5.02e-01
SGIPWRVGGFGSKVIKCGAGSSLSTSSGKDGLDREAMPTLLVTTKRRSQERKEGLEPSTSALARLCSTIKLFPPATVVAKHYGAINGRLPFQSISGRSVPLLVRVVRSLGSRVELGRPFILVTG

SEQ ID NO: 136503 - protein, 34 aa, Glycine max
  Coding DNA Sequence Number=SeqID_44818
MVMQSYPPRALDRRHQEDWARDVREGLKVLMSLR

SEQ ID NO: 136504 - protein, 304 aa, Glycine max
  Coding DNA Sequence Number=SeqID_44819
MAEPSKKRKGTSTRSQRHSGSQEAPIPPSIPFGSLFSSEEQHIRYTNLFSSRSIVDPKFIDMEFFSNENFECFQAFENSNLIPFMSLKLHVYYELVKAFYSNLEIMKGALIDEWKFDFSVHDARRLVCTNQADMTGRLLADLIVMWAFHKGLQIDWAHLIRYRMHKALRLNAPLPYPHLVTLFLQHFNIPLDSEPYVPIKRSFLIGASVIASFGYIKEHDGSWVKKGARNIGEEGHEGEDSYLLSKILERFNGLQTFVGERFDTLELQVDMRFNEMESRMTKVEEDVSYIRLSFDLPPPPSPSS

SEQ ID NO: 136505 - protein, 436 aa, Glycine max
  Coding DNA Sequence Number=SeqID_44820
  Gene Ontology: Mol. function=GTPase activator activity; Cellular component=intracellular; Biological process=intracellular signaling cascade
  Homolog annotation: Hit_ID=A2R1D7; Match level="QueryCoverage=97%, HitCoverage=45%, E-value=0.0, Identity=82%"; Hit description =Similarity to hypothetical Rho GTPase protein - Schizosaccharomyces pombe
  Pfam annotation: Domain name=DEP; Domain location=126-208; Score =28.4; E_value=2.7e-05; Accession=PF00610.12; Description=Domain found in Dishevelled, Egl-10, and Pleckstrin
MVEAAKNHQKIASNIRELVVSPFRRWCDQHEARIQNSHDDLQARIKEHTKQADLVKKLRSHYFNKCRVVEDLEEENKLAFQAPEASPPVKAPPKIVLPEEAEDEEPMEIGDHVYTPEGLKQLLVHMLDNIKMGDVKVPIIGTYQNTSTGADIVEYTQKHMNATSVSYAERIGQDLVDNGLLRLVGNMGSTFANSSKMRYQWRPKVFQITGIPEKKTPLLRVTSMANSEDGSESPISTVSEMLAGWNPLNNAHPNETPAEKLRREAREADERYKAAVRKLDQIRCKLEEEIVENLRFMEQCELDRLKAIKAVVLDFSGAISNVIPNLQSTVDHMMLYQETIQPLGDLRYLLENYRTGGFVPRVQAYENYYGSVEGMISLIRSCARWTITDPSDQNFGVDLEARARADRKRVPVLVTTLLTYLDNRKIIAVPDFKHWH

SEQ ID NO: 136506 - protein, 363 aa, Glycine max
  Coding DNA Sequence Number=SeqID_44821
  Gene Ontology: Mol. function=oxidoreductase activity; Cellular component=periplasmic space; Biological process=electron transport
  Homolog annotation: Hit_ID=A7R2Z4; Match level="QueryCoverage=98%, HitCoverage=99%, E-value=1e-117, Identity=58%"; Hit description =Chromosome undetermined scaffold_466, whole genome shotgun sequence
  Pfam annotation: Domain name=GFO_IDH_MocA; Domain location=8-130; Score=133.1; E_value=7.9e-37; Accession=PF01408.13; Description =Oxidoreductase family, NAD-binding Rossmann fold
  Pfam annotation: Domain name=GFO_IDH_MocA_C; Domain location=142-255; Score=39.4; E_value=1.3e-08; Accession=PF02894.8; Description =Oxidoreductase family, C-terminal alphabeta domain
  Pfam annotation: Domain name=Semialdhyde_dh; Domain location=9-118; Score=-23.4; E_value=0.051; Accession=PF01118.15; Description =Semialdehyde dehydrogenase, NAD binding domain
  Pfam module annotation: Pfam domain module=GFO_IDH_MocA::GFO_IDH_MocA_ C::Semialdhyde_dh; Domain location=8-130::142-255::9-118
MSDDQTAVRFGILGCANISIKLCKALSKAPNAKLHAIGSRSLEKATAFAAEHGLPEAVRVYGSYEGVLEDEEVDAVYIPLPTGLHVTWAVRAAERRKHVLLEKPVAMNVAELDRILEACEAHGVQFMDGTMWVHHPRTAKMKEALSDAQRFGQLKWIHSCLTYNPGPEFLKNSIRVKPDLDGLGALGDTGWYCIRAILWAVNYELPKSVLAFPGAILNEEGVIISCGSSMHWEDGRSATFHCSFLSYVTFDVTVLGTKGCLRLNDFALPFEESLGFGKFLEASELDYGKIEQGMWCPKPNEHVVETGFSQDILMVKEFADLVRKVQGCEMKPEKTWPVLSRKTQVVLDAVKESIEKGYQPVEL

SEQ ID NO: 136507 - protein, 46 aa, Glycine max
  Coding DNA Sequence Number=SeqID_44822
MDTRLRVIGDPMNEVQRGWGHNPLSEDSPSEYGGGAAIVRYGLISK

SEQ ID NO: 136508 - protein, 68 aa, Glycine max
  Coding DNA Sequence Number=SeqID_44823
MTAIKANGFNNKDDNGKGSFNEMEGRGREVVVSKRIIKRTSVVKDLTFNTLSTYKTFQIQYKNFHGAI

SEQ ID NO: 136509 - protein, 140 aa, Glycine max
  Coding DNA Sequence Number=SeqID_44824
  Gene Ontology: Mol. function=cation transmembrane transporter activity; Cellular component=integral to membrane; Biological process=cation transport
  Homolog annotation: Hit_ID=O64455; Match level="QueryCoverage=53%, HitCoverage=16%, E-value=1e-22, Identity=73%"; Hit description =Ca2+/H+ exchanger
  Pfam annotation: Domain name=Na_Ca_ex; Domain location=3-138; Score =9.6; E_value=0.0023; Accession=PF01699.15; Description=Sodiumcalcium exchanger protein
MTVFIVVLSEYVVDTIEDASDSWGLSVSFLSIILLLIVGNAAEHAGAIVFAFKNKLDISLAVALGSATQIAMFVLMQLHNIGPIMCNHCLDNTYQYGPEFQPPRDRFPCIGNNSHGLHFTDQADVTNITLKPATNAVLSA

SEQ ID NO: 136510 - protein, 305 aa, Glycine max
  Coding DNA Sequence Number=SeqID_44825
  Gene Ontology: Mol. function=metal ion binding
  Homolog annotation: Hit_ID=A7Q9Q2; Match level="QueryCoverage=98%, HitCoverage=88%, E-value=4e-86, Identity=53%"; Hit description =Chromosome chr5 scaffold_67, whole genome shotgun sequence
  Pfam annotation: Domain name=DUF789; Domain location=1-298; Score =456.2; E_value=4.2e-134; Accession=PF05623.3; Description=Protein of unknown function (DUF789)
MSCFSDLNPLWQPLGKDTIEYFTLQDLWDCYYEWSAYGAGTPVMLEDGDTVTQYYVPYLSAIQIYTNKSVVASRNRREDSDGVEFESDSWSEDSSSDNLSRSLSNNSSKAWEDAVSEDSSCDQEGSWLRDNKLGCLYLQYTEMASPYSRVPLAEKIDELARSHPALLTLKSVDLSPASWMAVSWYPIYTVPCRNTEKDLEACFLTYHTLSSSFEDCAMECDDIDIGNDPHCSIQGEKCKEKNSGHVSLLPFGLATYKMQGDIWLNPEPYDNEKISYLYSAADSWLKQLNVHHHDFNFFTLHNNTL

SEQ ID NO: 136511 - protein, 459 aa, Glycine max
  Coding DNA Sequence Number=SeqID_44826
  Homolog annotation: Hit_ID=Q6H5V6; Match level="QueryCoverage=15%, HitCoverage=23%, E-value=6e-12, Identity=52%"; Hit description =Putative uncharacterized protein OSJNBa0014E22.25
MAMGRVGYGYCLPNPLPRLLNISPYPYPIPEGFEFIVPSPYPSVIPYPYPYSTFGYRGKPEPEPIPGQLGYYPSKSGWIQAVSYEVCFSVDPLKVQQCGWSHAASVPSEEPEAPKGQKRVPRHERRAMVESFVNKAENAGKFPRISDTQKQVGGSYYVIREIIQELEYKSKMNSSNSVKKIFVEKQFDESKLLTTESVNVSSGNIEIANESSVQDDSQSVVLDDKESVNTVYEHLEEKRGPQTSYLERRLSDEVEIMSTPEPCPSSLDMPNDIKTEEVVSTYSDSFAPEHSQEERKHSPLFSENDGTGYDKAQGHEYDFVNMENHQNVEEKCIKKADCERREQPDLEDLSRELLHSSLLEPNDVKSREAVSNSSDSVTQERHPLKEEIDQFSASFIEKSVSSCSEGQSHDSKFVDMEKHSAFVKKSFEKRYERKDQDAVDSLKHKIEQSQRSLEYDESK

SEQ ID NO: 136512 - protein, 157 aa, Glycine max
  Coding DNA Sequence Number=SeqID_44827
  Homolog annotation: Hit_ID=A2Q168; Match level="QueryCoverage=49%, HitCoverage=7%, E-value=2e-07, Identity=32%"; Hit description=RNA -directed DNA polymerase
MVDRGSLWGLVLKTKYGNVLDSPNVRQSQMESIWWGDIMDVTWCLEWWGVEHGSLGSGNLMHNEADKVLWKRDSIGDFSVKLAYDFVSFDLSLVENLFYRHIWKLYIPKNVGEFIWRLSLDRLPTCDNLQQCGIVTDSVMKWKKTWNTCCLRVDSHR

SEQ ID NO: 136513 - protein, 257 aa, Glycine max
  Coding DNA Sequence Number=SeqID_44828
  Gene Ontology: Mol. function=transmembrane receptor activity; Cellular component=intrinsic to membrane; Biological process=innate immune response
  Homolog annotation: Hit_ID=Q9M635; Match level="QueryCoverage=45%, HitCoverage=78%, E-value=1e-43, Identity=75%"; Hit description =Putative uncharacterized protein
  Pfam annotation: Domain name=LRR_1; Domain location=149-170; Score =9.8; E_value=4.8; Accession=PF00560.24; Description=Leucine Rich Repeat
  Pfam annotation: Domain name=LRR_1; Domain location=172-194; Score =9.3; E_value=5.9; Accession=PF00560.24; Description=Leucine Rich Repeat
  Pfam annotation: Domain name=TIR; Domain location=14-137; Score =126.2; E_value=9.5e-35; Accession=PF01582.11; Description=TIR domain
  Pfam module annotation: Pfam domain module=LRR_1::LRR_1::TIR; Domain location=149-170::172-194::14-137
MALRSCSSSLSYDVFLSFRGEDTHYGFTGNLYKALDDRGIHSFIDDEELQRGDEITPALPKAIQESRIAIIVLSKNYASSSFCLDELATILHCAQKKGLLVIPVFYNVDPSDARHHKGSIVSSKVDKFSANSSLLHNDFFSTSFTQLAQVETLSLRGNNFTFLPGCIKEFQRLRSLDVSYCEHLQEIRGVPPNLKRIQGKSLHILVFLEFKHIPLLVLLLAEIYSETTLIDLFLGFGLSLGNVPQMMRLKYGVFIMV

SEQ ID NO: 136514 - protein, 294 aa, Glycine max
  Coding DNA Sequence Number=SeqID_44829
  Homolog annotation: Hit_ID=A7PAX8; Match level="QueryCoverage=63%, HitCoverage=41%, E-value=1e-66, Identity=68%"; Hit description =Chromosome chr16 scaffold_10, whole genome shotgun sequence
  Pfam annotation: Domain name=DUF1308; Domain location=2-293; Score= -169.7; E_value=0.018; Accession=PF07000.2; Description=Protein of unknown function (DUF1308)
MHVFEINPADGKDVEGTNSGCSVQGSTVDSSQLEPSVGKAETQPQLLEENARSGDSFHLELSADETETLAQPTEENIRTNLGNMFCSILMKLCSMANKTSESANPGNLLVETDLVNFDTTSLIALVSGISNCGTEKLLATPESDMRQRFKGNYDFVIGQIMSEIQNPIHMEFGRILCGKNGLICESVLMEFKELVSMCGGPNEKLRSDRLINCLKRLNQVSVDAISCRIVNASKRMMDLPTTRKLALKNKVVFGTGDHWHAPTLTTNMAFVRAVSQTGMSLSTFEHRPRALPGD

SEQ ID NO: 136515 - protein, 503 aa, Glycine max
  Coding DNA Sequence Number=SeqID_44830
  Homolog annotation: Hit_ID=A7PAY0; Match level="QueryCoverage=100%, HitCoverage=99%, E-value=1e-178, Identity=67%"; Hit description =Chromosome chr16 scaffold_10, whole genome shotgun sequence
  Pfam annotation: Domain name=BRO1; Domain location=30-461; Score= -200.0; E_value=0.099; Accession=PF03097.9; Description=BRO1-like domain
MGCVVSTTKDSGGNRRRPGSIGEVSVYVPGLRIPKPVDFAQSLGNYLSKNIVEHLSALRMRIVIMAGQEGPTITRTKRKTQHGGSMLADLLQALEDYLPVVLGLVKDGSHLQYKVQFTWVNQEDDKEETTMSNAWYEVLSVLHLMAMLSLSQANLLLLPRSSSSDGHLPKVSEESRRTSVDIFLKAAGYLDCAVKHVLPQLPVELRRNLPVDLAEGVLRALCLQALGQNLCDGIYLYGESSWEKSSVIPILNGSLEKENGIDIQLGMAIDSTKATLAVKRRLACEMVKCWQQAQDNIMNLPLANGWGEKHCLFVKWKYVEAKTFLVVRNSVIWIYEIRYLHGSCGVVVNAQAAAYYYHGLILDEGNTEKSHGMAVAALQAADEYYKESKKLCEAFNAASPLSRKQGLAFFKNLLYQQLDVINPPPWGTVKYLSEKIPKDTSSKVRINRDLYSYERIMETAPTLPDFSLALKPDEYQLPQVDSSWRTENIKVGQTDPNHLKGDK

SEQ ID NO: 136516 - protein, 765 aa, Glycine max
  Coding DNA Sequence Number=SeqID_44831
  Gene Ontology: Mol. function=alcohol dehydrogenase activity; Cellular component=cytoplasm; Biological process=metabolic process
  Homolog annotation: Hit_ID=Q8LEB2; Match level="QueryCoverage=42%, HitCoverage=85%, E-value=1e-156, Identity=80%"; Hit description =Alcohol dehydrogenase-like 6
  Pfam annotation: Domain name=ADH_N; Domain location=149-274; Score =108.6; E_value=1.9e-29; Accession=PF08240.3; Description=Alcohol dehydrogenase GroES-like domai
  Pfam annotation: Domain name=ADH_zinc_N; Domain location=305-447; Score=126.3; E_value=8.8e-35; Accession=PF00107.17; Description=Zinc- binding dehydrogenase
  Pfam annotation: Domain name=TIR; Domain location=431-545; Score =40.7; E_value=5.2e-09; Accession=PF01582.11; Description=TIR domain
  Pfam module annotation: Pfam domain module=ADH_N::ADH_zinc_N::TIR; Domain location=149-274::305-447::431-545
MVKLGPYDGEVRSMGTPGVTGGVRWDSGVVLGKFLEHSVDSGMLVFQGNNIVELGSVLGSDVVYSEGDVLDLLETLVQLSGPNTTIFLAGELRNDAILEYFLETATDNFTIGRLDQKLWHPDYCSNPAVAWRAGEALVMEEVEVSPPQPMEIRIKVVSTSLCRSDLSAWESHAIFPRIFGHEASGIVESVGQGVTEFKEGDHVLTVFIGECMSCRQCTSGKSNTCQILGLERRGLMHSDQKTRFSLKGKPVYHYCAVSSFSEYTVVHSGCAVKVSPLAPLEKICLLSCGVAAGLGAAWNVADVSKGSTVVIFGLGTVGLSVAQASKLRGASRIIGVDNNPQKCENAKAFGVTEVVDPNSYKEPIAQVIKRITDGGADFSFECVGDTDTITTALQSCCDGWGLTVTLGVPKVKPEMSAHYGLLLMGRTLKGSLFGGWKPKSDLPSLVEKYLNKGNLTFIDDEELQSREEITPALLKAIQESRIAITVLSINYASSSFFLDELAYILECFKRKNLLKGSYEEALTKHQERFNHNMEKLENWKKALHQVANLSGFHFKHGDGYEYEFIGRIVELVSSKINHAPLPVAGYPVGLESQVLEVKKLSDRKIKQTWVTTSSKHPSLGNTWREGSQLNKCRTRSFNEGTLDSRKPDWFGPGSRVIITSPDKQLLAFHGVKRTYEVKVEDILCAHYVDCMKYHIGVLVEKSLSWYGRVTLHDLIEQMGKEIVRQESPKEPGKRSRLWLPEDIIQVLEVNKGTSEIEIMSGFAGI

SEQ ID NO: 136517 - protein, 131 aa, Glycine max
  Coding DNA Sequence Number=SeqID_44832
MPLVTLLRRVYYDRCKMRVIKDFFLVVLSPSTFPLNSHSHFRCPQTLSSFSAMVICKGDYVMPKAFNLRQSFHTQQSKKQDGLPTLQQQWEPQTVVTKQRAHGRHNTGDTMVDIERRGGEKWSSKWLEAQH

SEQ ID NO: 136518 - protein, 223 aa, Glycine max
  Coding DNA Sequence Number=SeqID_44833
MVEVVVGEMCVVALLSMVVEGNSIVIVAKVVVSGGWEQAEVVTATRRRNLDAKREIGCHGEGGANTVAEESTAITNHDRKGVNGGGGKNEELRDPSLHEIMGSAANGLSKLVTMSGTGEDSKSSELSSAMKKCRRGRGVAKGEGDEKQLGRWWSWSLSSCNLESTMACGNDNEIIIDGSLLLELEQSLVGIVVEGWRKVGFEVSATAVEKEGGDNGKKKKLRC

SEQ ID NO: 136519 - protein, 236 aa, Glycine max
  Coding DNA Sequence Number=SeqID_44834
  Homolog annotation: Hit_ID=A5BN38; Match level="QueryCoverage=17%, HitCoverage=6%, E-value=2e-09, Identity=73%"; Hit description =Putative uncharacterized protein
MVEAKKRNLTPSVPSIKFDAIVSADAFENLKPAPDIFLAASRILNVPPMRCTMLIYFFIPDTESAKVSRQQLKEAIYASLFDINVPVVCAINQNLFLLLSILSHRCKKVRSPKHLIKCSRSFTLCRLMSLDIGAKNLVYNYSNYHLLNATLALYAAKRTFGIVPNAALQKLILLLLWPSYSLMTISRSQASSLSNPLIQALHNPYLSLVKGLYNQIGFVMLMWWRLLMMTQHCWRI

SEQ ID NO: 136520 - protein, 108 aa, Glycine max
  Coding DNA Sequence Number=SeqID_44835
MAKKRGFSLRERLRLWISSLESFETRAPWAFPRGPSRAEPDLRAKRELHSERDFMVSLDFPAKRKLHAGPGLCTKRVVQFFQFFFNAFSSTFFINFPLKHFNSSFDFC

SEQ ID NO: 136521 - protein, 241 aa, Glycine max
  Coding DNA Sequence Number=SeqID_44836
  Gene Ontology: Mol. function=endopeptidase inhibitor activity; Cellular component=extracellular region
  Homolog annotation: Hit_ID=A7QTZ0; Match level="QueryCoverage=67%, HitCoverage=87%, E-value=3e-41, Identity=56%"; Hit description =Chromosome undetermined scaffold_174, whole genome shotgun sequence
  Pfam annotation: Domain name=Kunitz_legume; Domain location=29-185; Score=120.5; E_value=5e-33; Accession=PF00197.9; Description=Trypsin and protease inhibitor
MKMTLVTLVLMVALSTKALLGAAGPAPEQVLDTSGKIVRARGLDMASTGADCPLDVVAVDGYQGQPLIFTPVNFNKGVIRVSTDLNIYFPVGTSCPQTTVWKLKDYDYSASQWFVTTGGDFGNPGSQTMANWFKIEKYEDAYKLVYGPSVCNDCSYPCSDIGIYQDEYGKRLALSSEPYKVKWPLEWWKMAKTLCSGLTVDGWVSNCVLKEKYPRLFQIAENKLAQIAEVVSMVNGGRAYF

SEQ ID NO: 136522 - protein, 163 aa, Glycine max
  Coding DNA Sequence Number=SeqID_44837
  Gene Ontology: Mol. function=endopeptidase inhibitor activity
  Homolog annotation: Hit_ID=P93378; Match level="QueryCoverage=84%, HitCoverage=88%, E-value=3e-15, Identity=35%"; Hit description=Tumor- related protein
  Pfam annotation: Domain name=Kunitz_legume; Domain location=38-162; Score=-13.5; E_value=0.00036; Accession=PF00197.9; Description =Trypsin and protease inhibitor
  Subcellular localization annotation: CTP_CleavageSite=30; ConfidenceScore=5.06e-01
MKYMLLALLLLFSLSLSTQPLLGAANVSPRASIPAAITSGKKLQTGLSYYTVPAMQTITKCGKYECLNAEGLPLASIGESCPLDVVVVQRSFGLPLSFSPVNPDEGVVIPMSTDLNFIFSIGRTICAEYSPHFCKDVGVFVDENGCRRLALSDVPYKVMFQRA

SEQ ID NO: 136523 - protein, 221 aa, Glycine max
  Coding DNA Sequence Number=SeqID_44838
  Subcellular localization annotation: CTP_CleavageSite=45; ConfidenceScore=5.55e-01
MAISSSTRQLAPVSPSSMACCTKLGLASLTGELRVGVCSSQATCSSFAGGGTAFWWKTPVLLAICAAGKYIALQICDDEDVETMLESFKQQQEMSVLELYIEKDVAGGSMFHSANSLTSCGNYVSNDDTQPPTNMSNLNLDEDDDDDDDYLVSNSYVEESLDEDDSVDGISDTDDEVTDIPQPVRIVHPAEGAQRIENPFWNDALHYNNINWSYPDEEDIC

SEQ ID NO: 136524 - protein, 26 aa, Glycine max
  Coding DNA Sequence Number=SeqID_44839
MTENLEMGADQGLGGGQRVYVTAQRV

SEQ ID NO: 136525 - protein, 95 aa, Glycine max
  Coding DNA Sequence Number=SeqID_44840
MNGAKRSAEAVGCKKESVGERSALEGRTRASSAGRSGSENVGLSNANVEKIHHLFRVSKGLKEQNCLSGLCVRRFPFNLQWLKDKAIAFYRWSPR

SEQ ID NO: 136526 - protein, 302 aa, Glycine max
  Coding DNA Sequence Number=SeqID_44841
VETLRYMVSPQARNTWTVDDLVPYVDKLAIISEEQERITEPVSHGPASEREFPAPEFHILQSSVETRGIGRRREPVEAEQYSLQMMERGHGMYYTPATFSEYPSQMYQYPFAGHHTDTSETSHSFGGVAETQPHFSWPTMTPSQQHDAPMATPNAPFASQWNVPGAIPDMGDLLGVDLRQEFSAEAEQVRGLRDRVGWLGFGLWLGLEGFKGLGVGLGVRVRGVMVRVRSLRVKGWIRGYATQTPSLILSLAKKTYLKKKERHGRVIPNQPAEEVLVGPPPLLCHRAETTIPLWCTLGSYTR

SEQ ID NO: 136527 - protein, 349 aa, Glycine max
  Coding DNA Sequence Number=SeqID_44842
  Gene Ontology: Biological process=cell wall catabolic process
  Homolog annotation: Hit_ID=A9PH52; Match level="QueryCoverage=94%, HitCoverage=93%, E-value=3e-79, Identity=53%"; Hit description =Putative uncharacterized protein
  Pfam annotation: Domain name=LysM; Domain location=23-66; Score=31.3; E_value=3.5e-06; Accession=PF01476.11; Description=LysM domain
MSPSNGLQNGGGGGGNGVSYIEHQVSKLDTLAGVAIKYGVEVADIKRMNGLATDLQMFALKTLKIPLPGRHPPSPSPGPHEEPTKSGDASSERKPLRIGQSAMKEPLQSLRLKPPQPNISPAMSILQKFYGLKSSNSRDTLNGTEMAVYSSSTSDHSNGEWLPKALPISDLPSASNDYPRSTNLVYDLLTGDDEYVPLAEIGDAGAEKSDEKSVRRRQKAEVDNGASTPEKIMKEGNGNGSNGFSSTGKTLAMRPKSASRAALFPESESGWLDSIPVGLGESIFTDGFSGVRKSSSASSLREQEKNNSAAAWPPAIWGLKPDLQAAISKPIFDGLPIPISGRRSKAALD

SEQ ID NO: 136528 - protein, 219 aa, Glycine max
  Coding DNA Sequence Number=SeqID_44843
  Gene Ontology: Mol. function=heat shock protein binding; Biological process=protein folding
  Homolog annotation: Hit_ID=A5AXU1; Match level="QueryCoverage=89%, HitCoverage=33%, E-value=1e-35, Identity=46%"; Hit description =Putative uncharacterized protein
MTPTLRRRKTNNLGCHIEMMKEFPNVGNDLKHLLQMIDDGEAVDIKGTSEKSLTKHLKKLFLSLNLEDGNRVFLLHSKAHLNLDVVGPLIQSYMNMNPMNEQVETSTLVPESSSIPIDTGNEQMIDDHATTGPEDHSVGPRRRMIGPAMPSAELPLQFTSDDNDDHFDANVFRDIELDDTKLFVGPSPPALVSERESANEYFQYKGFPCQRSTVSSQTC

SEQ ID NO: 136529 - protein, 258 aa, Glycine max
  Coding DNA Sequence Number=SeqID_44844
  Gene Ontology: Mol. function=nucleoside-triphosphatase activity; Cellular component=intrinsic to membrane; Biological process=innate immune response
  Homolog annotation: Hit_ID=Q5JBT4; Match level="QueryCoverage=84%, HitCoverage=27%, E-value=7e-50, Identity=42%"; Hit description =Candidate disease-resistance protein SR1
  Pfam annotation: Domain name=TIR; Domain location=3-110; Score=45.5; E_value=1.8e-10; Accession=PF01582.11; Description=TIR domain
MCSSASEGKTHRGEEITPALLKAIHESRIAITVLSEDYASSTFCLDELATILHCAQEKGMLVIPVFYMVDPYDVRHLRGSYEKALAKQKWKKTAIRDGYEYKFIEKIVEQVSREINPVCLHVADYPVGLESQVLQVRWLLDVGTDDGVHMLGFHGMGGDINITSCQERATMIHDRLQQLKVLLVLDDVDRLKQLQEPVGRPDWYKVKELNEKDALQLLTQKAFENEKADPRPSIGFGSDRLQLGWKKYGRLETCYRKI

SEQ ID NO: 136530 - protein, 219 aa, Glycine max
  Coding DNA Sequence Number=SeqID_44845
  Gene Ontology: Mol. function=translation initiation factor activity
  Homolog annotation: Hit_ID=A9P9B6; Match level="QueryCoverage=98%, HitCoverage=98%, E-value=6e-38, Identity=44%"; Hit description =Putative uncharacterized protein
  Pfam annotation: Domain name=eIF3_subunit; Domain location=1-219; Score=176.5; E_value=6.8e-50; Accession=PF08597.1; Description =Translation initiation factor eIF3 su
MTVAEDEHIAPIDLTLKDPVKTNWDDEDVDENDVKESWEDEDEPAPAPAAPAVKTTVKAPKKSSDKDNDKKGKTVEPIKEEPLDPVAEKLRQQRLIEEADYKATKELFSGGNEKDEKNLDTFIPKSESDFLEYAELISHKLRAFEAVMRLSTTSLKGADAKDIASSVTAIANEKIKAEKEANAGKKKIGGKKKQLNVDKPDEDFIPADRYDALDDYDFM

SEQ ID NO: 136531 - protein, 153 aa, Glycine max
  Coding DNA Sequence Number=SeqID_44846
  Homolog annotation: Hit_ID=A0ST23; Match level="QueryCoverage=16%, HitCoverage=53%, E-value=1e-07, Identity=100%"; Hit description =Putative reverse transcriptase
MECLICLFFLQGECVGILKRGEQTAWVAIRQNGFRSLGQPGPLWTRVGKPVVPAALMNRPTRGERRFAYWALAECILAYYVGTDEGEKKGCTGASAEYVIQDIFPLPRSLTRYARSFDCGERKWLTNGAEISWEDARKILNREVRGPRQAVFP

SEQ ID NO: 136532 - protein, 236 aa, Glycine max
  Coding DNA Sequence Number=SeqID_44847
  Homolog annotation: Hit_ID=A5C5T0; Match level="QueryCoverage=97%, HitCoverage=98%, E-value=5e-66, Identity=54%"; Hit description =Putative uncharacterized protein
  Pfam annotation: Domain name=DUF599; Domain location=10-226; Score =266.2; E_value=6.8e-77; Accession=PF04654.3; Description=Protein of unknown function, DUF599
MEWRTCYLDMTLIPLGLLINIGYHVWLCYKVRTQASLTIFGIDADGRCSWVPAMIKDIEKNNIVAIQNIRNMIMGSIFMASTSILLCCGLGAMISSTYSVKKPLIDSIYGAHGEFVLALKYATLFTIFLFSFLFHSLSVRFLTQLSILICTPQDAIMTLVTPKYLTELLRKATFLNIVGNRILHTGLALLLWICGPVMAFLCSVAMLLVLHKLDFVARKEKIKVGITEESGTQPEI

SEQ ID NO: 136533 - protein, 382 aa, Glycine max
  Coding DNA Sequence Number=SeqID_44848
  Gene Ontology: Mol. function=DNA binding; Biological process =regulation of transcription
  Homolog annotation: Hit_ID=A7QK02; Match level="QueryCoverage=70%, HitCoverage=82%, E-value=2e-97, Identity=60%"; Hit description =Chromosome undetermined scaffold_109, whole genome shotgun sequence
  Subcellular localization annotation: CTP_CleavageSite=32; ConfidenceScore=5.09e-01
MKKNTYTVENSGGSGDGGIKAWSFGNHQLLVRRVMQVTMSIAGLAVLWMFLSNSASSIEFHTFSHYFSAQSIKAGYESKLESVLRTASMKDNKTVIITTLNDAWAKPGSIFDLFLESFRLGNETQWLLNHLVVITWDQKTNAYCLAMHKHCYQVETKGSNFTGEVFFMSPTYLRMMWRRTEFLTSVLEMGYNFVFTDTDIMWLRDPFKQFYEDADFQIACDAFNGNSSDINNYPNGGFKYIKSNNRTIWLNKFWFNSSKEYPGFGEQAVFNKIKLNPLISQMKLKIRFLSTSYFGGFCEPSKDLNKVSTMHANCCVGIDNKVNDLKILLEDWKKYMALPEIEKKQSNLTWSVPQSCSTSFERANEERKKNKGRLQRALVETV

SEQ ID NO: 136534 - protein, 67 aa, Glycine max
  Coding DNA Sequence Number=SeqID_44849
  Homolog annotation: Hit_ID=A5C5T0; Match level="QueryCoverage=73%, HitCoverage=20%, E-value=9e-12, Identity=61%"; Hit description =Putative uncharacterized protein
MDVMFVPSGLVILLAYHVWLWHKSRTQPFTTTFGRDADGRRLWVPAMMKVFCNYQANIKKSEFGYNN

SEQ ID NO: 136535 - protein, 490 aa, Glycine max
  Coding DNA Sequence Number=SeqID_44850
  Gene Ontology: Mol. function=dTDP-glucose 4,6-dehydratase activity; Cellular component=integral to membrane
  Homolog annotation: Hit_ID=A8G9N7; Match level="QueryCoverage=62%, HitCoverage=49%, E-value=1e-170, Identity=91%"; Hit description =Putative uncharacterized protein precursor
  Pfam annotation: Domain name=DUF839; Domain location=1-280; Score =132.3; E_value=1.4e-36; Accession=PF05787.4; Description=Bacterial protein of unknown function (DUF839)
HENAAVTVAKDGRLVVYMGDDERGEHIYKYVSKGVVDAANPANNRTLLDEGTLYVAQFDGDEAGTPLKGKGRWIALEFGKNGLTPENGFRDEAEVLIFARKAAQQVGATKMDRPEWIAVNPHDGRAYCTLTNNSKRGEEGMPLNAANPRPNNIYGQIIRWDEGGDATAGTFAWDIYALCGNPIAHPEGVNRGTPNITAENTFNSPDGLGFDRAGRLWILTDGKYSNKGDYAGQGNNQMLVGDPISGEIRRFMVGPKSCELTGITFTPDYKTMFVNVQHPGEEGDSHFPNNSPRPQRGQPAGVVGRLAAISGLREVTVVFPAQHRQIAAPAAACVQPDHAFRRALAFQRGPVAEDDGVFRIHQAWQIEPRFQRRGRGARRIFADHVELAVGEAITHARQRIGAETQTRQAAQLRRPVVRHIAVHGVEEQRHRLAAQPVDQLVGVRGLQQRGDAIFGFVAADAGVNRQQVQIVVAQAPCAPPGRAKRTKAQH

SEQ ID NO: 136536 - protein, 74 aa, Glycine max
  Coding DNA Sequence Number=SeqID_44851
MEKNEETKMEEKLACGPSMEAGSLSFNEPWKKELHHQDEPWIRSLERMLQWRKRKRERKREGEHEIEGRKRERS

SEQ ID NO: 136537 - protein, 259 aa, Glycine max
  Coding DNA Sequence Number=SeqID_44852
  Gene Ontology: Mol. function=transporter activity; Cellular component= integral to membrane; Biological process=transport
  Homolog annotation: Hit_ID=P96517; Match level="QueryCoverage=64%, HitCoverage=47%, E-value=6e-51, Identity=57%"; Hit description=MelY
  Pfam annotation: Domain name=LacY_symp; Domain location=97-259; Score= -113.2; E_value=1.1e-12; Accession=PF01306.10; Description=LacY protonsugar symporter
MAQGIVSEDKTYGLFMVSQLAMPDYTLMMPLRMPGLEASAQYRITLLDHPNIQITGRDCAADSGSGNRHSDWRGTRVRVTGRRPGPPLRIKIMNTTTCTHKDNPNFWIFGLFFFLYFFIMATCFPFLPIWLSDIIGLNKTHTGIVFSCISLSAIALPAGVGGDFGQAGVKKTSVVDYLRAAVSVCPLLPAYIERVSRNSFFEYGKARMFGCLGWGLCASTGGILFGIDPSYVFWMGSGAALLLMLLLVVAKPKPNQTAQ

SEQ ID NO: 136538 - protein, 107 aa, Glycine max
  Coding DNA Sequence Number=SeqID_44853
MKNDKEFPQNCLRKRYGSTSAWIFFAETCFLPKIAKMHSQGIRNILKQPALPIFRKKGGFQKFYGSPGNHFSKTGRRLPPSCFLLKQPNFRIVPEGPRFELLFTPLS

SEQ ID NO: 136539 - protein, 186 aa, Glycine max
  Coding DNA Sequence Number=SeqID_44854
QKLLAEKTKKKLEEAAQSGSVDGVINPPSPIRHHVKWKMARTKKTWEMTTEAAKEIAEKIAKHPGRVRAARVAADPANQGPARGVDHRKSDSTTHGIVQPDAVPVSVPNAILGTCTASEASGNDPETGDSERCGLYIEANPAHLVALTIRKYTFNIDYLEHSTSVLKPILKVPMLNVSMLTSVLEN

SEQ ID NO: 136540 - protein, 115 aa, Glycine max
  Coding DNA Sequence Number=SeqID_44855
MSLPSAVHVSSIIKREASEEKEGVETRVVITERAGRTKSVSYLCFPLISDERYVKRGNCHTLISSGYMMRAILHSQSFRSPMNWVIVHVSPPFKFGAMRRDCLGQFSILNLFGAP

SEQ ID NO: 136541 - protein, 200 aa, Glycine max
  Coding DNA Sequence Number=SeqID_44856
  Gene Ontology: Mol. function=motor activity; Cellular component=cell projection
  Homolog annotation: Hit_ID=UPI00006A2D9E; Match level="QueryCoverage =93%, HitCoverage=97%, E-value=6e-15, Identity=17%"; Hit description =UPI00006A2D9E related cluster
MLAFRGPHVLAFRGLHVLAFRGLHVLPSKDYMSSRLEGYTSLPLEGLHALAFRGLHVLAIRGVHALTFIGLHVLSFRGLHVLSFRGLDALTFKRLHVLAFRGLHALTIRGLHVLAYRGLHVLTFRGLHALAFRGLHVLAFRGHHTLTFRGLHVFAFRGLHVLAFKGLHALPIRGLHALTFRELHVLAFRGLHLLGLRGLH

SEQ ID NO: 136542 - protein, 89 aa, Glycine max
  Coding DNA Sequence Number=SeqID_44857
CVICGGAHDSGYCIPIEDTTHEVNYMGNQPRPNFNVGGYSGFQHGQQYNQQQGQWRTHPGNQFNKDQGGPSNRPQQQGPSLYDIMTKLE

SEQ ID NO: 136543 - protein, 449 aa, Glycine max
  Coding DNA Sequence Number=SeqID_44858
  Gene Ontology: Mol. function=L-gamma-aminobutyric acid transmembrane transporter activity; Cellular component=integral to membrane; Biological process=gamma-aminobutyric acid transport
  Homolog annotation: Hit_ID=Q4KJU4; Match level="QueryCoverage=97%, HitCoverage=83%, E-value=1e-166, Identity=67%"; Hit description=GABA permease
  Pfam annotation: Domain name=AA_permease; Domain location=17-441; Score=470.8; E_value=1.8e-138; Accession=PF00324.12; Description =Amino acid permease
  Pfam annotation: Domain name=Spore_permease; Domain location=12-342; Score=-137.0; E_value=0.0024; Accession=PF03845.4; Description=Spore germination protein
  Pfam module annotation: Pfam domain module=AA_permease::Spore _permease; Domain location=17-441::12-342
MTAQNADVLAQSLKPRHVRMLSIAGVIGAGLFVGSGHAIAEAGPAVLLAYIAAGALVVLIMRMLAEMAVASPDSGSFSTYADKSLGRWAGFTIGWLYWWFWVLVIPLEANAAGTILHGWFPQVAVWEYTLAITSFLTISNLFSVKNYGEFEFWFALLKVVAIVAFLCAGSLALFGLLPGSSTQGAVLAAILTTMFSFMGTEIVTIAAAESNEPRKQITHATNSVIWRIALFYLLSIFLVVALVPWNTPSLMKAGSYQTAMEMMNVPYARQIVDVVVLIAVCSCLNSALYTASRMLYSLSRRQDAPAAASRTTRSGTPWVAVLMSTAAAFLAVIANYLAPSAVFEFLLASSGAIALLVYLVIAASHLVLRKKREARGEQLSYRMWLFPGLTWATMVFIVGVLTSMLFNAQHRSEIIATGLLTLLVLVASQIVHRKRAARKNSEEMVALRS

SEQ ID NO: 136544 - protein, 65 aa, Glycine max
  Coding DNA Sequence Number=SeqID_44859
  Subcellular localization annotation: CTP_CleavageSite=32; ConfidenceScore=5.08e-01
DCHHQKGGYYGSNAFQDYFDDAKDSNSRIKSQASTKNQRVVQSKQVSRIKESFNQDSFSQDSRFK

SEQ ID NO: 136545 - protein, 72 aa, Glycine max
  Coding DNA Sequence Number=SeqID_44860
MAAEWRRKRERRRHFKEKMSLEEAHHHRRPWIRAWRKKEMNERRGREEHRILCSKRALKSESTNPRFSTKCA

SEQ ID NO: 136546 - protein, 51 aa, Glycine max
  Coding DNA Sequence Number=SeqID_44861
LSQPTLRQECDARLTGASSKKGKCAESPPMFIRGKCWKNRKMCGLRTLSVK

SEQ ID NO: 136547 - protein, 89 aa, Glycine max
  Coding DNA Sequence Number=SeqID_44862
MERYLQHLVRQQAANHRGQVQIHECLYQLSLSQQSQGFAPFACPTPDQFRTEVAWPGDWPEAQAGEAPAEAPGDAEEARIYSFHLGASS

SEQ ID NO: 136548 - protein, 134 aa, Glycine max
  Coding DNA Sequence Number=SeqID_44863
  Subcellular localization annotation: CTP_CleavageSite=26; ConfidenceScore=5.74e-01
MSFSNLASPPSPPPTSDASALSSSVKRTRKASRLRFLSTRPPGAERPVVHVDPAFGKADGPHRKKLRTYLGIVAPDKVDITYENWNKIPTVQKDLIWEDIQTVDERWRQFKSDLMRKWALAADQDGVDDTVCEK

SEQ ID NO: 136549 - protein, 137 aa, Glycine max
  Coding DNA Sequence Number=SeqID_44864
MIQHIKHQIKICLRLSSITYQTQETFFEMKKGKNFGFKMQVFPHSYCSSTSSTPPKTPKNQHKTHQNLEREHFYETSKSAYGRKQKWRIRREMVGSLTYEISPNSKKKLSHKVLCARDSRSHIREWWVVLERKKKVK

SEQ ID NO: 136550 - protein, 337 aa, Glycine max
  Coding DNA Sequence Number=SeqID_44865
  Homolog annotation: Hit_ID=Q6WAY6; Match level="QueryCoverage=30%, HitCoverage=18%, E-value=5e-12, Identity=35%"; Hit description =Putative uncharacterized protein
MDWDQLLAGIGGRTISWFPRWKEGKEGVLFSCGRYPNIPLVGTRGCINYNPTLAIRQLGYPMRGAPTEESMSPFLVRDLGAQNSKTIQRIHKAWETPLRKDQELRGIRNGIIGDWLAKLKVVSEENFEAPEEDEEVQALKSELGKAKLAKEKFKLAATHVRKECAGLREENAITARALEQETKRARKEEYGRNKFRGALWGSNSELKLRREERDQSRAHGMVLKEELVACSRSKRSLSQRLCETETNMLAIIAKYQEELGLAAAHEHRIADEYAQVYAEKEARGRVIDSLHQEATMWMDRFALTLNGSQELPRLLAKAKAMADTYSTPEEIHGLLGY

SEQ ID NO: 136551 - protein, 47 aa, Glycine max
  Coding DNA Sequence Number=SeqID_44866
MKKQQWKRSGRQRRRGEGRHHPLGNKPRKKELHHQELPWIRSLKRML

SEQ ID NO: 136552 - protein, 125 aa, Glycine max
  Coding DNA Sequence Number=SeqID_44867
MEFISISDHTPLVVTTELVVPRGNSPFKFNNAIVDHPNFLRIVADVWKQNIHGCSMFKVCKKLKALKAPLKNLFKQEFSNISNRVELAEAEYNSVLNSLKQNPQDPSLLALANCTRGQTIMLRKA

SEQ ID NO: 136553 - protein, 77 aa, Glycine max
  Coding DNA Sequence Number=SeqID_44868
MEEFDAQVAWPGHHLSSSGGGGASIAQELVTEKPPPPAPSPTATEEETTPTQTPQPSPPSAPAPEETQPSALDLNED

SEQ ID NO: 136554 - protein, 172 aa, Glycine max
  Coding DNA Sequence Number=SeqID_44869
  Homolog annotation: Hit_ID=Q6WAY6; Match level="QueryCoverage=50%, HitCoverage=15%, E-value=3e-09, Identity=39%"; Hit description =Putative uncharacterized protein
MGTRGCISYNPVLAIRQLGYPMRGAPLEDELAPVISRGFNKTNVETLQKVRKAWEVLQKKDKELRGSNNGLIGGYRKWLKAHVQGLDCLPSLRTTKREEVEALKEDEEVQALRAELEQAQTVKERARREEHGRNKFRGALWGSNNELKLQREERDQSRVDNLILKDELKACS

SEQ ID NO: 136555 - protein, 161 aa, Glycine max
  Coding DNA Sequence Number=SeqID_44870
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=4e-14, Identity=28%"; Hit description= UPI00006A17C9 related cluster
  Subcellular localization annotation: CTP_CleavageSite=43; ConfidenceScore=5.20e-01
MARTCSPLKVRTCSPLKVRACSPTKVKAHDPLTARTCSPLKVRACSPTKVKAHDPLTARTCSPLKLKACPPFENGEHVRACSPTKVKAHDPLTARTCSPLKLKVHDPLKARTCNPLKVKARTYSPLEVRACSPLVVRTCSPLKARTCSPLKARTCSPLTVR

SEQ ID NO: 136556 - protein, 139 aa, Glycine max
  Coding DNA Sequence Number=SeqID_44871
  Homolog annotation: Hit_ID=Q84VH6; Match level="QueryCoverage=70%, HitCoverage=6%, E-value=4e-07, Identity=39%"; Hit description=Gag -pol polyprotein
MDRRQNNHQFWMEPTMNTGKVGEYLSQNSRTWKAVIKGHLGTVKMLDTEGKPTQEAEKTCSLRTEEDELALGKVKEAKRSLMSLRNSVFLNSKLPWEKGMTNHKDAALEPRDNIGLDIRNEKKSKRIKWRCPTDEGEEA

SEQ ID NO: 136557 - protein, 272 aa, Glycine max
  Coding DNA Sequence Number=SeqID_44872
MEFFSNENFECFQAFENSNLIPFMSLKLPIYSELVKVFYSNFEIHEGTLNSEVYGIKMVIDQSLFYDLTKLPSEGVPYEGALIDEWKFDFAVHDARRLVCTNQADMTGRLLAGSLAFESRILHYLIVRILLPRSSNLAQAPLPYPHLVTLFLQHFNISLDFEPYVPIKRSFLIGASVIASFGYIKEHDCSCVKKGARNIGEEGHEGEDSSLLSKILERFDGLQTFVGERFDTLELQVDMRFNEMESRMTKVEEDVSYIRSSFDLPPPPPPSS

SEQ ID NO: 136558 - protein, 69 aa, Glycine max
  Coding DNA Sequence Number=SeqID_44873
STLEDPLKVKEECKETLFSIATPLGLEFIPQIKELLDEAPLIELVRNYVLSWENGIEERIPKFQEPLAL

SEQ ID NO: 136559 - protein, 174 aa, Glycine max
  Coding DNA Sequence Number=SeqID_44874
MAPKKLSSKRSRRDAAAEGTSATPEFDSHRLRSAKHQQRFEAIKGWSFHKERRVQLMDDEYTDFQEEIARRHWTSLVTPMAKFDPDIVLEFYANAWPTEEGVRDMRSWVRGQWIPFDVDALSQFLGDPLVLEEGQECEFRFCPDRCREAGADHAHQHDYLDPDVDNIAAQQCLA

SEQ ID NO: 136560 - protein, 95 aa, Glycine max
  Coding DNA Sequence Number=SeqID_44875
MYCRRMGAYAKDEKLLRHSFQRKSYWGSCYLGEDEGEARAVTAIPIQPSFPPTQQCHYSANNKPSPYPPPSYPQRPSLKSTTKPTYRTSNDKHHL

SEQ ID NO: 136561 - protein, 115 aa, Glycine max
  Coding DNA Sequence Number=SeqID_44876
  Subcellular localization annotation: CTP_CleavageSite=62; ConfidenceScore=5.47e-01
MSTYVRLVDQTIRLPLLSASLQGLLSSSFRPGQAFSLSRFGLGRCAPATSWQKSRLMGKPPPAAMVWGVRGCCPVANSKGLKFDAELFGCLIYSSTELHPTAPVLLVGFALKCLK

SEQ ID NO: 136562 - protein, 45 aa, Glycine max
  Coding DNA Sequence Number=SeqID_44877
MATTPPVLLKNGIPGLPGHPKQPSSPGRAKVAWASWAATSSPFFL

SEQ ID NO: 136563 - protein, 54 aa, Glycine max
  Coding DNA Sequence Number=SeqID_44878
MSKNLKILMHNPPIWALQKIPPEGGCFWRKQPCSPGRAELAWASWAATTSPILL

SEQ ID NO: 136564 - protein, 152 aa, Glycine max
  Coding DNA Sequence Number=SeqID_44879
  Homolog annotation: Hit_ID=Q9LJA5; Match level="QueryCoverage=53%, HitCoverage=27%, E-value=4e-07, Identity=36%"; Hit description =Arabidopsis thaliana genomic DNA, chromosome 3, P1 clone: MTO24
LLETEKLPSCGQLYIETHKRKDESFVYEAAKTIAEQIEVGLTQSIVEEYEVSPLDVVGRVLGLEHSGRVRCMGLGAVPSNTFRNTRLRAFSLSSSSSGVAFPSSNQWQEKYNNLESAFKAYMIMKEGRIPEELASYFTPDQTHVDFIVNQQY

SEQ ID NO: 136565 - protein, 55 aa, Glycine max
  Coding DNA Sequence Number=SeqID_44880
MDGEELPSPVNSDQGAESSQVTVRSQDKLTAEINQGTWGRMQVGIDRPIVALSRR

SEQ ID NO: 136566 - protein, 136 aa, Glycine max
  Coding DNA Sequence Number=SeqID_44881
MAALEREGSDGLGSTEAQLTTSKDWKTVSNDSSAASTYGAEEGQLTNMSSSPDTITKSPPTANFNFGEVSKGPLLAHESKVSPRDSYRRDLCPSLETPHFKCGGLFEWECQFPPSLPAEYHQRLVPPSSLVLNVTH

SEQ ID NO: 136567 - protein, 155 aa, Glycine max
  Coding DNA Sequence Number=SeqID_44882
  Subcellular localization annotation: CTP_CleavageSite=36; ConfidenceScore=5.18e-01
MGQLQRQAFAKPMGSTPHWPEFLKSPNLSAGIRPPKASRKWGGRNTEKIFGGSPLSKCGWVGGPGSDRRFLAYHNHKESPVVAMLADLYDTFDRRCEESNARIVCCTPALYVGLVSHLFFQEGRPVYPLQGYHSCVEKGKANWNQLLASMGGGVC

SEQ ID NO: 136568 - protein, 106 aa, Glycine max
  Coding DNA Sequence Number=SeqID_44883
MKVYDQDSSFSHVIGSDDENKNYIGSKDIDERQTTFVKGRQLLHGVLIANEVVEEARRSKRPCSQGSNLSKLAPCKHSNSHYSSAGNVAAEAKQHCYSIKNKKIKV

SEQ ID NO: 136569 - protein, 130 aa, Glycine max
  Coding DNA Sequence Number=SeqID_44884
  Subcellular localization annotation: CTP_CleavageSite=72; ConfidenceScore=5.03e-01
MGVDFLTRLFTPYLIGTSTRGRARSSLLLTTINVLTPHDHGFLCGALRGNVTSPKTFEAFNVASPFLGTSLRGAAPKILMQAPLELVGLGSSSSMDSFASWKINGSGMEKEEREETPLQGEDESRRSSPP

SEQ ID NO: 136570 - protein, 41 aa, Glycine max
  Coding DNA Sequence Number=SeqID_44885
APLKLKDPASIEAPQASFHQIKARTLSPVKDKDEDFESYER

SEQ ID NO: 136571 - protein, 65 aa, Glycine max
  Coding DNA Sequence Number=SeqID_44886
MVFHLRLVMSFKTKKGEHRLKGAIKGINSSKKDQQESSQGYCASNQWGKNTPNKIDDDGSNSHQG

SEQ ID NO: 136572 - protein, 100 aa, Glycine max
  Coding DNA Sequence Number=SeqID_44887
MGKKILQMGIEDQKISFDLFQEDKDPLAKMTMRQASDVKRALTGRQPNFSFSFLFFILISCIKRLRMFFAIVYPLSVDHALSAQSSRAKPELAHAKRIDP

SEQ ID NO: 136573 - protein, 103 aa, Glycine max
  Coding DNA Sequence Number=SeqID_44888
MSVSFGRDYEKVSFSIRKTQSTIASSDLYVDTCTLPRDVSVFQPRLRKRPTSPLTRGDLQSSALSETREVHGDVRMIASDYPQRYPSGYPYKHSFAIRQHQSP

SEQ ID NO: 136574 - protein, 153 aa, Glycine max
  Coding DNA Sequence Number=SeqID_44889
  Subcellular localization annotation: CTP_CleavageSite=22; ConfidenceScore=5.03e-01
MRAALFLAGAPSPIGALETILSVSSASSSPPSEQGLLLFTRLDDSAILPYFFPRIGRLLTKLRIGLSPYCLTRTTYHLLFESTSLIALKESVFDDRAWRSIGPPLRIYDQLTKQKGDSDSPGFMSIVEGSQIALDLGLLAWVENSSSWGRKGA

SEQ ID NO: 136575 - protein, 155 aa, Glycine max
  Coding DNA Sequence Number=SeqID_44890
  Homolog annotation: Hit_ID=A3BTE5; Match level="QueryCoverage=65%, HitCoverage=10%, E-value=4e-08, Identity=31%"; Hit description =Putative uncharacterized protein
WVECHEWLSIEAYNKTYQHFIEPVQGPQYLARHSIHILFPPHKRVQRGRPKKNRSRSVDEDNVTGHRLKRKLADFTCGRCGQTNHNIRSSLNEAEEAAAHVQQDPVEINLSQPHLSQDSDMELMVPVTIVPPIARNKLTITRDKQRKVADKDDAV

SEQ ID NO: 136576 - protein, 80 aa, Glycine max
  Coding DNA Sequence Number=SeqID_44891
MAKLRAVHSSTQHSPFDVVYGFNPLTPLDLLPLPNISDFKHKDAQAKVAKKVMILNIEGQMLSKKERMMRIVKLPKYKDL

SEQ ID NO: 136577 - protein, 356 aa, Glycine max
  Coding DNA Sequence Number=SeqID_44892
  Homolog annotation: Hit_ID=Q2HW90; Match level="QueryCoverage=88%, HitCoverage=61%, E-value=6e-39, Identity=32%"; Hit description =Putative uncharacterized protein
MGTNQNGKRFYQVKIKGLDVTSLKELGRLMGPLQRQAFRKVYGKILDLTTVDVFTEAVVSLAQYYDQSLRCFTFGDFQILLTVEEFEEIIGCLLGGRKPYLFSGFLPSLSKIAAVVGDSARELDRMKQTRNGVVGLPQKYLEGKARDMASQEEWVPFADILALLIFGVVLFPNVDGLVDLAVIDAFLAYHRSKESPVVAILVDLFDTFDRRCEKNNARIVCCLPALCVWLVSHLFQQDIRHPCPLQSYRSCVEKRRVDWDQYLAGIGGNIINWFPRWKEGKEGVLFSCGDYPNVPLIGTRGCINYNPALAIRQLGYPMRGAPTEESLSPFLVRDFGAQSFKIVHRVHKAWESLLRK

SEQ ID NO: 136578 - protein, 169 aa, Glycine max
  Coding DNA Sequence Number=SeqID_44893
MTQELVARGDTLRLSAPRHSVSPSVIDEQRPMWSSVPFLEMSASSGGDFFKSHKLSRTTGGWPDDTQRPMWSFCTLLSSRGGGPDDTQRPMWSFCTLLSSRGGRPDDTQRPIWSFCTLLSSRGGRPDDTQRPMWSFCTLLSSGGGGPDETQRQIMVILHPFVIQRRRAQ

SEQ ID NO: 136579 - protein, 169 aa, Glycine max
  Coding DNA Sequence Number=SeqID_44894
  Gene Ontology: Mol. function=aspartic-type endopeptidase activity; Biological process=proteolysis
  Homolog annotation: Hit_ID=A5AK77; Match level="QueryCoverage=57%, HitCoverage=12%, E-value=1e-11, Identity=36%"; Hit description =Putative uncharacterized protein
MAHPPARERTLRKLTAPDFTYESLCIQYPNEDVSYVLKTRLIHLLPKFHGLAGDDPHKHMKEFHIVCSTMKQPDVQEDHIFLKAFPHSLEGVAKDWLYYLAPSNMERSMIDAASGGALGDMTPVEARNLIEKMASNSQQFSARSDAIVIRAVHEVATNSSPSGETKKLE

SEQ ID NO: 136580 - protein, 166 aa, Glycine max
  Coding DNA Sequence Number=SeqID_44895
  Homolog annotation: Hit_ID=UPI0000ECBAF8; Match level="QueryCoverage =21%, HitCoverage=42%, E-value=2e-12, Identity=100%"; Hit description= UPI0000ECBAF8 related cluster
ATLPEGRKSDRYPVSGRVGTGERTRELPGGNACLWKNASNAAFLRFLAFCWPFAHMFFPALSPDSVDNRITAFEKRKSAQYANRLSPRVGRFTNAAGTTGFPTGKRAVSATQLMHASLALAVVYNVVTGKTLALPNLIALQHIPLSPAGVIAKRPAPIALPNSCAA

SEQ ID NO: 136581 - protein, 132 aa, Glycine max
  Coding DNA Sequence Number=SeqID_44896
MVVLEEASCTCWGSWAVGLPYEEKVGPQARLPSPETAQWKEWILEVPPPAKLMTGLRRSKVRLSETTPLARHRVVIRAGNPSLEELDWAIKVIWPEMRAHMFMSMRETRPKISLALSTVRLEVCDVGKVTWA

SEQ ID NO: 136582 - protein, 201 aa, Glycine max
  Coding DNA Sequence Number=SeqID_44897
MARRDKLWSFCTLLSSRGGRPDDMRRQNLVIPHPFAIQTQSCPMARRDKLWSFCTLLSSRGGRPDDMRRQNLVIPHPFAIQTQSCPMARRDKLWSFCTLLSSRGGGPDDMRRQNLVISHPFAIQTQLCPMARRDKLWSFCTLRQSRPTSPLTRRDYIIFSTHKICHTDFLSHSDERKYMNGYPYKHSFAICKSVRLIACRD

SEQ ID NO: 136583 - protein, 115 aa, Glycine max
  Coding DNA Sequence Number=SeqID_44898
  Homolog annotation: Hit_ID=A5BVM8; Match level="QueryCoverage=93%, HitCoverage=6%, E-value=1e-09, Identity=39%"; Hit description =Putative uncharacterized protein
MNVVFEEELVIYSDQLLVPIIVQDTTLVIEYNVQTIVIVPEQDNNEVLPQIPLEQLQQSQEVLLRRSIREMRSAISNDYIIFLQGHKNDVGLTEDDPINFCQAMLSSNCRSKASW

SEQ ID NO: 136584 - protein, 147 aa, Glycine max
  Coding DNA Sequence Number=SeqID_44899
  Homolog annotation: Hit_ID=Q9SKF2; Match level="QueryCoverage=72%, HitCoverage=17%, E-value=1e-08, Identity=35%"; Hit description =Putative Athila retroelement ORF1 protein
MTRGNPSDLQPFDPEIDRTFHRLVRHHFIPFDHSEHSITGESVHSVIGDFEHPDLEHYNFEHSDSEHSDFAHSENMAQPPPRERTLREDPHKHLKEFHIVCSTMKPPDVQEDHIFLKAFPYSLEGVAKDWLYYLAPRSITSCDDLKR

SEQ ID NO: 136585 - protein, 65 aa, Glycine max
  Coding DNA Sequence Number=SeqID_44900
MDVITESVKFREISERKQPKTQKWGSELIKIRDILEVGLLKEEATGRQAPPRFLKMVSGASVMFP

SEQ ID NO: 136586 - protein, 69 aa, Glycine max
  Coding DNA Sequence Number=SeqID_44901
  Homolog annotation: Hit_ID=UPI0000ECBAF8; Match level="QueryCoverage =59%, HitCoverage=48%, E-value=1e-16, Identity=100%"; Hit description= UPI0000ECBAF8 related cluster
GKGVYQFVDKYGANVDGMQAWHWPSFYNVVTGKTLALPNLIALQHIPLSPAGVIAKRPAPIALPNSCAA

SEQ ID NO: 136587 - protein, 50 aa, Glycine max
  Coding DNA Sequence Number=SeqID_44902
MAGDSSKFTHISSKKSGHVTYGDNNKGRILGVGKIAKMMIHGYGINVLLT

SEQ ID NO: 136588 - protein, 227 aa, Glycine max
  Coding DNA Sequence Number=SeqID_44903
  Homolog annotation: Hit_ID=UPI00016621D1; Match level="QueryCoverage =88%, HitCoverage=41%, E-value=4e-20, Identity=34%"; Hit description =UPI00016621D1 related cluster
MASLYDHKPKKFHLVTYQRMMIHCHPSMYLLVSFRGVKVLAFRGLKVLAFRGLKVLIFRGLKVPAFRGLKVLAFRGLKVLTFKRLKVPAFRGLKVLACRGLKVLTFRGLKVLTFRGLKVLAFRGLKVLAFRGLKVLAFRGLKVLVVRGLKVLTFIGLKVLTYRGLKVLTFIGLKVLAYRGLKVLAFIGLKVLAFIGLKVLAFVGLKVLAFVFHRTQGPLSFAFQRSS

SEQ ID NO: 136589 - protein, 167 aa, Glycine max
  Coding DNA Sequence Number=SeqID_44904
MGDQEETQEQMKADMSALKEQMASMMEAMLGMRQLMEKNTATAAAVSSAAEADPTLLATAHHPPSNIPDEAHKDPQDYARRDVEFYPPIPEGPAPSTLPQPNITTQPMVLSTEGPPPATEERRKLDLLEERLRAMEGFGDYPFADMTDRCLVPDRVITPKFKVPDLD

SEQ ID NO: 136590 - protein, 124 aa, Glycine max; identical to SEQ ID NO: 133164
  Coding DNA Sequence Number=SeqID_44905
  Homolog annotation: Hit_ID=Q84VH5; Match level="QueryCoverage=64%, HitCoverage=11%, E-value=1e-25, Identity=76%"; Hit description =Envelope-like protein

SEQ ID NO: 136591 - protein, 233 aa, Glycine max
  Coding DNA Sequence Number=SeqID_44906
  Gene Ontology: Mol. function=aspartic-type endopeptidase activity; Biological process=proteolysis
  Homolog annotation: Hit_ID=A7QBE5; Match level="QueryCoverage=98%, HitCoverage=47%, E-value=3e-47, Identity=39%"; Hit description =Chromosome chr13 scaffold_74, whole genome shotgun sequence
MVATAYQTSHECSEETIIDILVAGFSGQLKGWWDNYLTNEEKSKIYSAVKTDLNGKVITNDDDKEIPDAVNTLIFTIAQHFIGDPSLWKDRDTFLTRVYTREDSQQPFWKEKFLAGLPRSLGDKVRDKIRSQSANGDIPYENLSYGQLISYVQKVALKICQDDKIQRQLAKEKAQTKRDLGSFCEQFGLPACPKQKKKQTSRKEIQDHKPANRRGFSKRRYSQKPSTSKVWRP

SEQ ID NO: 136592 - protein, 80 aa, Glycine max
  Coding DNA Sequence Number=SeqID_44907
MAFVDNWAVGKEKTHIDPFVGEDLSQRALRGRARARLTGALSKGGKMRGVASNVYLWKTSEKPKETSQNENSKFGSCIYA

SEQ ID NO: 136593 - protein, 173 aa, Glycine max
  Coding DNA Sequence Number=SeqID_44908
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVLHETPVQPDRCALSGNYRLESNP

SEQ ID NO: 136594 - protein, 152 aa, Glycine max
  Coding DNA Sequence Number=SeqID_44909
  Homolog annotation: Hit_ID=A6FJQ2; Match level="QueryCoverage=25%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVDSRGSPKGVETRIVITERAGWVKSVSYLCFPLISDESEVQIAIRPTWAFQILPPEGCCFWRKQPCSP

SEQ ID NO: 136595 - protein, 168 aa, Glycine max
  Coding DNA Sequence Number=SeqID_44910
  Homolog annotation: Hit_ID=Q2HW90; Match level="QueryCoverage=86%, HitCoverage=29%, E-value=2e-11, Identity=31%"; Hit description =Putative uncharacterized protein
  Subcellular localization annotation: CTP_CleavageSite=23; ConfidenceScore=5.05e-01
MLGWPLGGRMPYPFSGFYPSMARVAKVVKISTQELDRVRQNRNGVVGVPMRCLEEKAKALANQCEWASFIDILALLIFGVVLFPNLDGLVDLAAIDVFLAFDHGKESPVVAILAYMYDTFDRRCEKSDTRIVCCTPALYVWLVSHLYCQEGRPVCPLQGYRSCTEKGQ

SEQ ID NO: 136596 - protein, 188 aa, Glycine max
  Coding DNA Sequence Number=SeqID_44911
MERSMIDAASGEALADMTPAEAKNLIQKMASNSQQFSARNDAIVIKGVHEVATNSSSSAETKKLEGKLDALVNLVTQLAMNQKSAPVARLCGLCSSANHHTNLCPSVQQSEAIEQPEAYAANIYNRPHQPQQQNQPQQNNYDLSSNRMLLAQADHTFLHQSSSNNNNSNSPRNNKQLRLLHNLPLKNL

SEQ ID NO: 136597 - protein, 125 aa, Glycine max
  Coding DNA Sequence Number=SeqID_44912
TLFLQHFNIPLDSEPYVPIKISFFIGAIVVTSFGYHKEHDGSWVKKGTQPNDDEGQLPVEGDSSLLQSILDRFDGLQTYVGERFDALEEQVDMQFDAMDSRITKVEEDVTIIRDCLDLPPQPPLV

SEQ ID NO: 136598 - protein, 58 aa, Glycine max
  Coding DNA Sequence Number=SeqID_44913
MDLVVTVISKGINHFLKQRSETMIGVEWRRRKGDCRYHFKEKMSQEQAHHHRKPWIRA

SEQ ID NO: 136599 - protein, 262 aa, Glycine max
  Coding DNA Sequence Number=SeqID_44914
EKLVSDDRQLKVDIHFPNGVVIHNECGVYFQSSTPVPMRVPNLCDFSTLKSIIHNTLQLNNNQVVDEIHYRRPLKDTGNNIHFHCMQLKHDMDVNTMLMCNDQFSCVEPIELLCTIGRTPDAILNLLECPSIRTHDAVLYYNGRWNMPRPNNFVGYAFTGINPQKFDVPKGCTIDELKDLIKQVTPKGNPPHGIHESQLVRRLFYQQPAHLEYSDKVLKFEIIELKSDDDVLKVLVESNYWKQFAPIKILALFSKVVLENDD

SEQ ID NO: 136600 - protein, 153 aa, Glycine max
  Coding DNA Sequence Number=SeqID_44915
  Homolog annotation: Hit_ID=A0ST23; Match level="QueryCoverage=29%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSIHPVFGGELNHDQIMGTELEFVIMVIAVSFGKPVVPAALMNRPTRGERRFAYWALFRFLAH

SEQ ID NO: 136601 - protein, 101 aa, Glycine max
  Coding DNA Sequence Number=SeqID_44916
MTDPLDESISCFLIRVNPWVLVPSPPKDYMSSPSEDYTSSTSEGPTPSPSEDYTSSPSEGRMPSPSENYTSSPSEDFTSSPLEDYTSSPLEDYTSSPSKGH

SEQ ID NO: 136602 - protein, 119 aa, Glycine max
  Coding DNA Sequence Number=SeqID_44917
  Homolog annotation: Hit_ID=Q2HTA0; Match level="QueryCoverage=72%, HitCoverage=14%, E-value=3e-13, Identity=47%"; Hit description=IMP dehydrogenase/GMP reductase, related
  Pfam annotation: Domain name=DUF1723; Domain location=42-91; Score =58.8; E_value=1.9e-14; Accession=PF08330.1; Description=Protein of unknown function (DUF1723)
RPELKLSSHGRKVHSLGRLVPAIEGLVAGTGLSPLIACSVDTGDRGLLSSFVERWHRETSSFHLPVGELTITLDDVSSLLHLPVVGDLHVFQLLHVDDAVQMLVDLLMVFAESAMAETA

SEQ ID NO: 136603 - protein, 117 aa, Glycine max
  Coding DNA Sequence Number=SeqID_44918
AELSCFHEESGCDKLVEYVCLNAVLVEVSLTRGIYGQCLIRIRLNYHEESGAERRRKLLQDKTVASILEEETHFSDLLSPDSPSSRESATQLPVAITMAEEHDQRITLEDYSSSSVP

SEQ ID NO: 136604 - protein, 114 aa, Glycine max
  Coding DNA Sequence Number=SeqID_44919
MKNFHKIAYGSVTEALRLDFSSRKRVFFAKIAEMHSQGVWNIFETAPSPIYREKERCFLPTDLMKKISKRTQITSEICLPKVFRNFTKALRKPRKPRKPFFKNVEELVAQLLPP

SEQ ID NO: 136605 - protein, 77 aa, Glycine max
  Coding DNA Sequence Number=SeqID_44920
ASQGCFVAHGRQDVLAIAIEQLQHPGCFRAARADVTIKQYFGSTSRSSRTSLSMALEDLEQLTQKIRDQLEELITEK

SEQ ID NO: 136606 - protein, 49 aa, Glycine max
  Coding DNA Sequence Number=SeqID_44921
MKILSSGVIFTLEEGISTSHVNKSVAFAPTYPPLKRKSDLRSSFLCVNQ

SEQ ID NO: 136607 - protein, 98 aa, Glycine max
  Coding DNA Sequence Number=SeqID_44922
  Gene Ontology: Mol. function=transition metal ion binding; Biological process=cellular iron ion homeostasis
  Homolog annotation: Hit_ID=UPI00004DB598; Match level="QueryCoverage =81%, HitCoverage=50%, E-value=3e-18, Identity=56%"; Hit description =UPI00004DB598 related cluster
  Pfam annotation: Domain name=Ferritin; Domain location=1-77; Score= -12.5; E_value=0.0051; Accession=PF00210.15; Description=Ferritin -like domain
IPNLQDLGRLRIGEDVPEMLQSDLTLELEGAKDLREAIAYADKVHDYVSRDMMIEILADEEHHIDWLETELDLIQKLESQAIAISVSPDNTPDWGVIC

SEQ ID NO: 136608 - protein, 81 aa, Glycine max
  Coding DNA Sequence Number=SeqID_44923
MRGYLMVTRTYRQPGENEPVDARRPTSSSSPFVDLTREVSDMWGYPMDLPSPFVTTGRRAVDAQRLTSSSAPLVVLTREVR

SEQ ID NO: 136609 - protein, 111 aa, Glycine max
  Coding DNA Sequence Number=SeqID_44924
MARRDQVWSFCTHDTRRYLTVICTPLLGRHSCVRWHAETKFGHSAPMIRGDTLRDQVWSFCTHDTRRYLTVICTPLLGRHSCVRWHAETKFGHSAHMIREDTLRLSARGIL

SEQ ID NO: 136610 - protein, 87 aa, Glycine max
  Coding DNA Sequence Number=SeqID_44925
MIALDYILSQPTLLRASEARLSGAFSKGGKCAESPPTFVCGKRRKNRRKPVMKNIPDLGVVFTFEEGRQKRGSCSYVPSIEEEIRPT

SEQ ID NO: 136611 - protein, 219 aa, Glycine max
  Coding DNA Sequence Number=SeqID_44926
  Pfam annotation: Domain name=Transposase_23; Domain location=48-118; Score=8.0; E_value=0.00016; Accession=PF03017.5; Description =TNP1ENSPM transposase
IAAADPANQGPSRGVHHRESDAAGHGILQPDAVPDSVADAISGNDPETGDSDRCSLYIEVDPARLVAMGRVYEGSTVVHNTPLLPGQVKVSVEEVTDANAPVLVPTDEVSLVGQALHTFLAWPTHLVKSLSQQVVVSPAKPPQKPDPEVDDPLYLMTLTIPKLFLRPYQVRWDATVFGVFNPDFPLYIKHEDLSKIAHGGNYDIYGFLKPQSIQRSGQL

SEQ ID NO: 136612 - protein, 90 aa, Glycine max
  Coding DNA Sequence Number=SeqID_44927
  Subcellular localization annotation: CTP_CleavageSite=50; ConfidenceScore=5.09e-01
MYPLFVLSIKTQSRCTLYLCHKGCTLQCVRTKNSQAVSLLNLWEGKNQKNSQAVSPLNSLGRGRRETQKKLRRLVLRFFWQEKEVNEEEE

SEQ ID NO: 136613 - protein, 115 aa, Glycine max
  Coding DNA Sequence Number=SeqID_44928
MGQPKFEQNSHKQSHHPNFAKSYSYIIGAFHRALGGRTFGHKLQENGDNVACPIASEYNIGLMPSHTNPQLNKTSMDSDANCFTNFAKNEQLKHQNTSMESQITKGNCTYLWGVN

SEQ ID NO: 136614 - protein, 88 aa, Glycine max
  Coding DNA Sequence Number=SeqID_44929
  Subcellular localization annotation: CTP_CleavageSite=78; ConfidenceScore=5.03e-01
MAPRKLPRRDLGRTLRPQGLVLLPSGRAIVSGALSTSSVSKPSMDGPSIERDASSLGTTILECYANAWPTEEGVTGPPVMGKGPVDTF

SEQ ID NO: 136615 - protein, 122 aa, Glycine max
  Coding DNA Sequence Number=SeqID_44930
MGKRRKLNIIQNDEQHIQEDSHVQSHTSLESASESSTKGKKRTRGYTHMLDVWDLPDGDPLLVEVDHWGNPMGWEGKTLLNAIGSLVRRHQCAPINFLSWKDMPKDYITDMVELIQVWYKTL

SEQ ID NO: 136616 - protein, 84 aa, Glycine max
  Coding DNA Sequence Number=SeqID_44931
QGHQVPPTNRAFIKKFCVSRKAQGETPQQPGDGQQRATDAPPSPLEFTSAHPQKGLSIAYTTWPTNRRPSPKPKVERYLGYACI

SEQ ID NO: 136617 - protein, 41 aa, Glycine max
  Coding DNA Sequence Number=SeqID_44932
AAVMMARVMLGNGYEPRMGLGKDNGGITSLISVKGNPHKRT

SEQ ID NO: 136618 - protein, 178 aa, Glycine max
  Coding DNA Sequence Number=SeqID_44933
QHSAQQPQCRSPPAEVSVGLCRHDIGIVPTRHPVDLEKSNRALGFPALVMGLWVAPTRHPVHPKEPNRALGFPALVTSLCQSYRAPVPPASSCHRDIGIVPSRHPVDPKKANRVLELPALITGLCQFYGVSVTLARSSSPLLIELSSRSIAPPGRRRVKHPSSLGTAGSGQQTHRHHL

SEQ ID NO: 136619 - protein, 106 aa, Glycine max
  Coding DNA Sequence Number=SeqID_44934
MKGRMSTSELLNVKDEDSFNRPRFKKGLRLCQWGLLSWEPDLDIWGKTNLGVKVSVLSMNFHIIPQGTCDNDDLETTCKISHGHSQVGTQASRLWHCDTTVGNLHK

SEQ ID NO: 136620 - protein, 86 aa, Glycine max
  Coding DNA Sequence Number=SeqID_44935
HLALRIFLRAVLLKEAPGSPGRAELAWRAGRQPPPLFAINRGGSEEEKAEALPKRFRNVFREEFRKGFNRSSTFFIRSSSFLSIFN

SEQ ID NO: 136621 - protein, 94 aa, Glycine max
  Coding DNA Sequence Number=SeqID_44936
MIRGDTLQLSAPFCHPEAAGPMTSRDQVWSFCTLVSSRGGGPDDTRRGGGPDDTRRYLTVIRTLLSSRGGGPDDKQRPSLVILHPCIIQRRRAR

SEQ ID NO: 136622 - protein, 154 aa, Glycine max
  Coding DNA Sequence Number=SeqID_44937
MAPKKLASKRSRKDKAAEGPRFEAIKGWSFLRERRVQLRDDEYTDFQEEIVRRQWASLVTPMAKFDPDIVLEFYANAWPTEEGVRDMRSWVRGQWIPFDADALSQFLGYPLVLEEGQECEYGQRRNRSDGFDEEAIAQLLCISEQDFARTAVGR

SEQ ID NO: 136623 - protein, 192 aa, Glycine max
  Coding DNA Sequence Number=SeqID_44938
MGSCCLVHMYDHLNDACISTSRQLAGYITLLQETMKTISTAMYRQRLDRLKIPDVCWMPYGEHRLFRYVQSIPAQPADSWESFDEIDDRWMHYSDHLSPATEMCVVPSQCAPDYIDWFFVISHSFMTTTQPSDLPRDAPVTHHVAFVEPHSPQVPEPTAASTHACSDVDQPRHAVERTSYQSHEQEAPRGLG

SEQ ID NO: 136624 - protein, 78 aa, Glycine max
  Coding DNA Sequence Number=SeqID_44939
MKAQVEKDEGPEAEALSRKLMLLKAQTNLKAQFWPNLLRRPMSIYDENHETGQIQAKGPSGEGRRPKWRRTKPPSGEG

SEQ ID NO: 136625 - protein, 91 aa, Glycine max
  Coding DNA Sequence Number=SeqID_44940
MGAKYLEVVKRGSHPNHGWSPDEIRGKNCSEFNVNNKTSKRAILNPQEKTTLEIQPSINNKNEIHQLETNCNTEMRMNLQTETENEIAIGN

SEQ ID NO: 136626 - protein, 77 aa, Glycine max
  Coding DNA Sequence Number=SeqID_44941
MEHLLVGDEQKHKTESKNAKKDDPRAANSSIPWRHSLLVSHRERQRSVGRDPIPACVRPASNKQPGMANLDRVITLP

SEQ ID NO: 136627 - protein, 263 aa, Glycine max
  Coding DNA Sequence Number=SeqID_44942
KRASLAKLPTLSRIFEELVPLSAAFKELSANPCGQLSRPCLAKRPMASRKRKSIGTRPTSQYDTRRFSSLDAWTRYTDNFLGRNILPERKAELERCNFHKRLTNLADWSIDLAFVKEFYANLYSSEDRPPKQFRVRGHLVKIDADNLNTFLETPVGQPGKILRKDLTTLAQVWSVLSYSNLAPTSHTSDLIVDRARLIFGLVSHLDMNIGALISGHMTSIAQSNTSRLGLTFKRLSPVINLAYIKKNYCNPEDLTVSIRGARK

SEQ ID NO: 136628 - protein, 113 aa, Glycine max
  Coding DNA Sequence Number=SeqID_44943
GSKGSLNCKHHQPHDEGSSIKSMLYKHFGQEQIYWIATAHFAVERKRKQDICFSTAIESSLFGGNHYPGLTNLQLFQKIQDNIYKWSNKELFHTQRLQSGFRSFYRWSARGMV

SEQ ID NO: 136629 - protein, 155 aa, Glycine max
  Coding DNA Sequence Number=SeqID_44944
  Gene Ontology: Mol. function=phosphoprotein phosphatase activity; Biological process=intracellular signaling cascade
  Homolog annotation: Hit_ID=A5C0F5; Match level="QueryCoverage=81%, HitCoverage=19%, E-value=3e-24, Identity=38%"; Hit description =Putative uncharacterized protein
MSNLGSKEDSFPKWLRRGNQHIGNDDVRVFRRKLDIMKRHEFVWEPYPSTVLSLLPPVCLVGSLAWYAVVPLICFQVIEWHQPDRVLRQFGMQQPVPESPSQPLNIHGITLKGKHDENWGQLFAPMIQQWNNRHAFRVDAYPRQEGLLSFNSDYM

SEQ ID NO: 136630 - protein, 76 aa, Glycine max
  Coding DNA Sequence Number=SeqID_44945
MCKDKWTQPWSMGSETYPEVHENPRAFFSNSSPILLEPLAHGSAEGRRKKDDSRPHFKEKMSQEEVHHHKKPWIRA

SEQ ID NO: 136631 - protein, 90 aa, Glycine max
  Coding DNA Sequence Number=SeqID_44946
  Subcellular localization annotation: CTP_CleavageSite=34; ConfidenceScore=5.78e-01
MATPPSSPPPPSPTDSTSHSPSTIKRTRKVTRLRSMATRPVRTKRPRVHVDPATGKTDGPYRKKLRTYLGIVARNKVDVTYENRKQVPAT

SEQ ID NO: 136632 - protein, 68 aa, Glycine max
  Coding DNA Sequence Number=SeqID_44947
MSQRALLWANEGEAHGCAFQRRKDVRSRHQRLFVENIGKTEGNRLTKAGLLLLRTLHQRGNQTYVVLP

SEQ ID NO: 136633 - protein, 238 aa, Glycine max
  Coding DNA Sequence Number=SeqID_44948
MGTRGCINYNPALAIRQLGYPMRGAPTEESLSPFLVRDFGVQSLKVVERVHKAWRSPLRKDKELRGIRNGIIGGYHEWLKVHTRGLDWLFKLKVVNEENYEAPEEDEEIQALKLELGKARLAKEKFKSAATNIWKECTELREENAATARALEQETKKARKEEHGRDKFRGALWGSNNELKLPEGGKRPATGTRHDLKGRISCLRKIQEEFGSTLGSHGAKHASHHRAVQGRVESVCDP

SEQ ID NO: 136634 - protein, 90 aa, Glycine max
  Coding DNA Sequence Number=SeqID_44949
PRQAEGETPQQPRDGQQQAIGAPPPTSRAPQLIHKKVRVLPTAHGRPIGDQFQSQSRTRLVAHDPGNLNKTSTSSEGSENTLDMHVVKIP

SEQ ID NO: 136635 - protein, 81 aa, Glycine max
  Coding DNA Sequence Number=SeqID_44950
  Subcellular localization annotation: CTP_CleavageSite=57; ConfidenceScore=5.17e-01
MHLGAISWICSVRTSRIKIGTNVLLLHSSGMRFDLIISLKSQVSQSRPLSPRVFHTSIGMLSGPTAFPLIIVFNASFTSGL

SEQ ID NO: 136636 - protein, 162 aa, Glycine max
  Coding DNA Sequence Number=SeqID_44951
  Gene Ontology: Mol. function=nucleotide binding; Cellular component =intrinsic to membrane; Biological process=defense response
  Homolog annotation: Hit_ID=Q2YE88; Match level="QueryCoverage=100%, HitCoverage=13%, E-value=7e-76, Identity=85%"; Hit description=NBS -LRR type disease resistance protein Rps1-k-1
LGGLSNLRGQLELRNLENVSQSDEALEARMMDKKHINSLQLEWSRCNNNNNSTNFQLEIDVLCKLQPHYNIESLEIKGYQGTRFPDWMGNSSYCNMTSLTLSDCDNCSMLPSLGQLPSLKVLEISGLNRLKTIDAGFYKNEDCRMPFPSLESLTIHHMPCWE

SEQ ID NO: 136637 - protein, 166 aa, Glycine max
  Coding DNA Sequence Number=SeqID_44952
MTLTIQELFLRPYQVTWDATVFGVFNPDFPLYIKHEDLSKIAHGGQCLSISVLQLWILMRAGNSYIYGFLEPQSIQRSGQSQFETESYIKSWMQSSKRNVYLGAYLNGRHWQMVVIVPKEHLVVWFCSLHNRPDNYLKGIINIALKGLDDAPQPKSKAPTRWIVVK

SEQ ID NO: 136638 - protein, 137 aa, Glycine max
  Coding DNA Sequence Number=SeqID_44953
MATAEALERETKKGPKGRTRCQQSFEGLYRAAIVSSSSEELSETEGNMWAVIDECKEKLNLAATHEQRLEDEYAKISAESEARERVIDSWHQEATMWTDRFALTLNRSQELPRLLAKAKAMADTYSAPKKIHGLLNY

SEQ ID NO: 136639 - protein, 160 aa, Glycine max
  Coding DNA Sequence Number=SeqID_44954
RCGCSVESRYGIESSKWAIFGKQNWRCGMNRKLGYGAQLRANLDPTKGVGRLRQQDGGHGSRNPLRTPMSRRARRSLQNPGREPGRSGSSVQILVGTGGSPSDSALLRVLRKGIGVKIPEPGRGGLTATLGSPETSAVAPERVILFLFNSLPTLVTAQSG

SEQ ID NO: 136640 - protein, 125 aa, Glycine max
  Coding DNA Sequence Number=SeqID_44955
ELVRYFPHYQGRDGKSSKCVKFLNGLQLEVKQVVNYQGPMKNKKNGPQNQEKSYLALPKQYDCPYPKKEHNGGGLNEQTRRPKDMVSLFTLNGVEALKSKDIIQDQWQRNGEEGKVIGDATLRRK

SEQ ID NO: 136641 - protein, 168 aa, Glycine max
  Coding DNA Sequence Number=SeqID_44956
  Gene Ontology: Biological process=transposition, DNA-mediated
  Homolog annotation: Hit_ID=Q1J7G7; Match level="QueryCoverage=24%, HitCoverage=71%, E-value=3e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDHAGAHDPHPSPGSDPGENPDLAPMAHGRQTLTFNKVELVVACLCPL

SEQ ID NO: 136642 - protein, 91 aa, Glycine max
  Coding DNA Sequence Number=SeqID_44957
MKVHIIWKPGAYGENKKEGGTQAVTVVPRWPNFPPAQQYQYLANITPSHYSPPYQPRTPNHPQRPPLNQPQNPPVAHPIPNTTGRGRTRIK

SEQ ID NO: 136643 - protein, 207 aa, Glycine max
  Coding DNA Sequence Number=SeqID_44958
EALERLRGLLRKTPTEWVPEPIKLNMFIDGLRPQTKQLLDASVVPSVVRLMKQANVFPLKKTLKKFTIWEINRDKDILKEDFQASSSVLITNKDSGDHTWQSIHQGPGTTKLEETLTQFMQVTMSNHKSTESALKALEVHVGQLAKQIADKSSNSFVANTEKNPKEECKAMMTRSKRFVEVEDEDSVVSKKKAVEKKGTDEKKDDVR

SEQ ID NO: 136644 - protein, 118 aa, Glycine max
  Coding DNA Sequence Number=SeqID_44959
  Homolog annotation: Hit_ID=A6N1F2; Match level="QueryCoverage=45%, HitCoverage=68%, E-value=6e-10, Identity=61%"; Hit description=Imp biosynthesis protein
HVWGLTPAQCRKVKEVGDLMTGEPTTEAPVNGGRNYNGPKVAKFLVGLGEIDMSVKMRTTCTWTERPYEASLFPGIGFGLFLRSLGGGQRRPPSGGARAISRQFLWGVGLPNGNGGVQ

SEQ ID NO: 136645 - protein, 25 aa, Glycine max
  Coding DNA Sequence Number=SeqID_44960
MKLKDLASIEAPQASFHHSYIYVIK

SEQ ID NO: 136646 - protein, 84 aa, Glycine max
  Coding DNA Sequence Number=SeqID_44961
  Gene Ontology: Mol. function=nucleoside:sodium symporter activity; Cellular component=membrane; Biological process=transport
  Homolog annotation: Hit_ID=A6BNE7; Match level="QueryCoverage=59%, HitCoverage=12%, E-value=9e-17, Identity=80%"; Hit description =Nucleoside permease
  Pfam annotation: Domain name=Nucleos_tra2_C; Domain location=1-71; Score=-106.2; E_value=5e-05; Accession=PF07662.4; Description=Na+ dependent nucleoside transporter
MLIGFIALISALNALFAAVLGISFQGILGYIFYPVAWVMGVPAHEALQVGKNCQHAFSARGRHPVRVPGLLRELLVHRYYRRGD

SEQ ID NO: 136647 - protein, 65 aa, Glycine max
  Coding DNA Sequence Number=SeqID_44962
MMEPPTSNVQQRFWGQGKKPKAWSCFRRNESLWQPGNDIDVYLTPLIEGLRKLWEDEVDVWDGCL

SEQ ID NO: 136648 - protein, 107 aa, Glycine max
  Coding DNA Sequence Number=SeqID_44963
  Gene Ontology: Mol. function=phosphoenolpyruvate carboxylase activity; Cellular component=cytoplasm; Biological process=carbon utilization by fixation of carbon dioxide
  Homolog annotation: Hit_ID=Q6Q2Z9; Match level="QueryCoverage=78%, HitCoverage=8%, E-value=4e-37, Identity=91%"; Hit description =Phosphoenolpyruvate carboxylase
LSFSSTFLQQLCGSGVLADGRLADLIRRVATFGMVLMKLDLRQESSRHAETIDVITRYLDMGTYSEWDEEKKLDFLTRELKGKRPLVPPSIEVRLLYIAKLYKLYIQ

SEQ ID NO: 136649 - protein, 155 aa, Glycine max
  Coding DNA Sequence Number=SeqID_44964
MAKFDPEIVLEFYANAWPTEEGVCDMRSWVRGQWIPFDADAISQLLGYPLVLEEGQECEYGQRRNRSDGFDEEAIAQLLCIPGRDFARTAAGRRVRIMRTNMTTLTQIWMTLLLSNILPSDHNSDLPLPKCQLVWRLPGTLWTQISPTEPWDFPH

SEQ ID NO: 136650 - protein, 103 aa, Glycine max
  Coding DNA Sequence Number=SeqID_44965
MVTKRVKKYEKMMTHQFVMMVDQPGKYRSTWLDSDISMEVRVDITAMEFSLFLTFLARVFDIREAEQYVEAHVILEKYKCLIRSPLIPNNDDLMYVPLIPPRE

SEQ ID NO: 136651 - protein, 79 aa, Glycine max
  Coding DNA Sequence Number=SeqID_44966
MNILTTHDQRWEQELILYNQYEEERTPNLESVFEEFMAYHASSKANQNSMKNHEIHFGDKSYNLTIKMKQKEVPIWINY

SEQ ID NO: 136652 - protein, 55 aa, Glycine max
  Coding DNA Sequence Number=SeqID_44967
MGNNDSGKRGIRTLGKQKAYIAVPMLRLEPLGHLSYIMMSRNRVNSESFIFLINA

SEQ ID NO: 136653 - protein, 305 aa, Glycine max
  Coding DNA Sequence Number=SeqID_44968
  Homolog annotation: Hit_ID=UPI00016621D1; Match level="QueryCoverage =82%, HitCoverage=42%, E-value=5e-16, Identity=33%"; Hit description =UPI00016621D1 related cluster
TPRPSLSGATCPPLQRTTRPLAFRGLHVPSPSDDLHGPRPLEATRPRLQGLDALTFRGLHVLAFRGLRALAFMGIHALPFRGLHVLAFREDYMSSPSEDYTCSPSEDYTFSLSEGYTPSPSEDYTLAFRGLHALTLKGLQVLAFRGLHTFAVRGLTVLAFRGQHALTLKGLQVLAFRGLHVLTFRVLHVLTFRGLHVLTLKGLHALAVRGLHTLTFRGLLVPSFKGLHVLTFRGLHVLTLRVLHALTFRGLHVPAFRGLHVLTFRRLHVLAITGINGLTFRVLHVLAFRGLHALAFVGLHALPSR

SEQ ID NO: 136654 - protein, 282 aa, Glycine max
  Coding DNA Sequence Number=SeqID_44969
  Homolog annotation: Hit_ID=A5BSR3; Match level="QueryCoverage=22%, HitCoverage=20%, E-value=5e-09, Identity=51%"; Hit description =Putative uncharacterized protein
MARTKKTGEMTTEAAKEIAEKIDSFEEQATQGSFVPHGRQDVLAAAIGRPEHPGRVRAAGAGVTIKQYFGSAPRASRSASSLPPNELQQLTQQIRDQLEESIIEKVTRQVMASFSQLQSQMQSQGLAVPPEPLVGPSGPRVSTKGSCADPSGNDPETGDSDKCGLYIEADPARLVAMGENADAPVPVPTDEVSLVGQALHTFLAWPTHLVKSFSQQVAVSPAKPPLKPDPEVDNPLYLMTLTIQELFLRPYQVRWDATVFGVFNPDFPLYIKHEDLSEIAHG

SEQ ID NO: 136655 - protein, 152 aa, Glycine max
  Coding DNA Sequence Number=SeqID_44970
MLYGALTELDGARVMGEVEEIQEKMKADMEAIKEKMATMMEAMMSVKKIMEANAVAIAATSVVAKPWLGYATEGQAVGGIPLQNPLEGPQYHPQLHLLHSTTSKDPHAMAEMGKLDHLEERLRAIEGGEDYAFANLEELFLVPDIITLPKFK

SEQ ID NO: 136656 - protein, 83 aa, Glycine max
  Coding DNA Sequence Number=SeqID_44971
MSVSACQQARLPLHIHNLTVNETSFLGAPPVLSSEGKGKKSYPGSRFMAKGLGFWLKRLAEGKTWRMSGYLLGKLLVLSSTEF

SEQ ID NO: 136657 - protein, 147 aa, Glycine max
  Coding DNA Sequence Number=SeqID_44972
  Subcellular localization annotation: CTP_CleavageSite=18; ConfidenceScore=5.22e-01
MGTERQPKNPASNCFFTSSFIFKDVTGFILLSFCFTGGHSGFRGNLCCTMSELKPGISWYDQAGGRRYQSAGMLILRGRTWSYPCLSLLPFLHCQLPSLLVLSLQDEAPFHGPPRRLSFPTPRKVPHPRSLRLLFDSFLARSRWAGP

SEQ ID NO: 136658 - protein, 42 aa, Glycine max
  Coding DNA Sequence Number=SeqID_44973
MSIRTCRKAWAEQMRKMSDKEKKCLCIAGYGKGSTYWVLDIL

SEQ ID NO: 136659 - protein, 73 aa, Glycine max
  Coding DNA Sequence Number=SeqID_44974
VKNRLSYEVPKATVELSSVVGLSVHPPLSAASVRLAQQKNLVGHQYQGCALSVRSVALSAAGAFSQAKPRDWH

SEQ ID NO: 136660 - protein, 274 aa, Glycine max
  Coding DNA Sequence Number=SeqID_44975
  Subcellular localization annotation: CTP_CleavageSite=33; ConfidenceScore=5.09e-01
MNVRALIFGQITSIAKSNSSRLGFPALITALCRTKGVASDNLVFERLSPVINLAYIRKNCWNPDDPTIIIRGARRPRARPAEAPSTSTTPHLASTSAAPPPACIAAAPSTLPPADFQRFEAMLQSIHQGQIILLQSLQLVAPPDSIPTVEQFNEWVAWPGTQPPHRDDEDPAALVPHQPVDESLESSTLEPLIRKRNVVVTQEAASTPEKSPEATPEPPAPMADTTSPQQAADPSTPEDQTTPVQSLNASLVYTPVLYLTDDKEVQTQDTQDQS

SEQ ID NO: 136661 - protein, 222 aa, Glycine max
  Coding DNA Sequence Number=SeqID_44976
MAKKEIEQRVGAHRGLTLLASRGKRHFCQIVYQRLAVFAAHDAVGGIAHQRAGRAVIERIALRQMIQHPVAPAFSQHRFVGHRQRQHHQLPAFVGIRQLRVGQIAQIGAGRRYRPGRQSSPPIQAVDDANGRGLFYDAGLPCSWPGSYRPDGSQIDSDLQQIRQLARAVIVAYIARAGGLIDQLLDDVHQSMDILRAGIAALRIDNGAVHVRHDLRDAGLQA

SEQ ID NO: 136662 - protein, 58 aa, Glycine max
  Coding DNA Sequence Number=SeqID_44977
MSEIEEVQEQVKADMEAMKEQMTTMTEAMMSTRKMKEDNTTTVVAASTATEMDPIHSA

SEQ ID NO: 136663 - protein, 118 aa, Glycine max
  Coding DNA Sequence Number=SeqID_44978
MSLGNLFSENPLWVINYKTLCNQLQHHQDIKTPVDPKKSNRVLELSSSNYGSLSVLRSTCHLQQGHQVPPTNRAFIKKFCVSRQAQGKTPQQPGDGRQRAIDTPPPPLEFTSAYPQKG

SEQ ID NO: 136664 - protein, 73 aa, Glycine max
  Coding DNA Sequence Number=SeqID_44979
MATSDIAILRDRAHIPTKKRCTICGGAHESGCCIPNEEQIAHEVNYMGNQPKGNFNKSGFPGFQNNQQYQQQR

SEQ ID NO: 136665 - protein, 88 aa, Glycine max
  Coding DNA Sequence Number=SeqID_44980
MENKNIAQCRPKNKHSSARISGKRRPISTETQRRLSSHEIPQATSMVKWWLDRNIEMAITEATGLQMRGFQNEVKGLVFKVNLGSRIT

SEQ ID NO: 136666 - protein, 243 aa, Glycine max
  Coding DNA Sequence Number=SeqID_44981
  Homolog annotation: Hit_ID=Q0ZCD0; Match level="QueryCoverage=71%, HitCoverage=16%, E-value=2e-07, Identity=24%"; Hit description =Integrase
MERSMIDNVSGGALGDMTPVEARNLIEKMASNFQQFRVHEVATDSSSFVENKKLEGKLDALVNLVTQLAMNQKFASAPVARVYGLCSSIDHHTDLCPSLQQSGVNEQPEAYAANTYNRPPQQQNQQQKNNYDLSSNKYNPGWRNHLNLRWASPPQQQQTIPPFQNVAGPSKPYVPPPMQQQQQQQQQRQQATKAPSQPSLEKLVRKMTIQNMQFQRDKSLHSESNKSDGADGYLVEPSSIPKF

SEQ ID NO: 136667 - protein, 111 aa, Glycine max
  Coding DNA Sequence Number=SeqID_44982
AADAPPPHQAGPAGLFDTEQYLRHLVRQQAANHRAHVQTHDCLYQMSLSLQSQGFTSFSCPTPDQFRAEVTWPGDWPEAQAGEAPAEAPDEADEACEDEEMTDLLDFLGGS

SEQ ID NO: 136668 - protein, 91 aa, Glycine max
  Coding DNA Sequence Number=SeqID_44983
MISKLQMLITFATVVRLRPTIYQNAQNSKENPDKGIWYTIFVEANLHGECDSKMMTKVMNKKLKDKKTSQVNQEKVKSSRIKKNSRLKKKA

SEQ ID NO: 136669 - protein, 118 aa, Glycine max
  Coding DNA Sequence Number=SeqID_44984
MNPGVATYPSAGGRRVTRGMRVPRKEYARSRHQRLFEENVGKTGKDAIYELLSERFGSCIYARGRGEMLRHWTINDLLFLKGENVKALGPLTISWGGRQKAGLLLLRILNCDEEIRPT

SEQ ID NO: 136670 - protein, 56 aa, Glycine max
  Coding DNA Sequence Number=SeqID_44985
MSGKAIREILVRWLDDLRQNNKEEVKQKLRRMKLEMSLKIKEEVKKQFDVDFLAVA

SEQ ID NO: 136671 - protein, 24 aa, Glycine max
  Coding DNA Sequence Number=SeqID_44986
EEATGAASSSTFLKNGFPGLSRLP

SEQ ID NO: 136672 - protein, 155 aa, Glycine max
  Coding DNA Sequence Number=SeqID_44987
MERVVADVLRDQRYLGNKGDGGWKRSALNAAAAVNVNVTSDNVKIRIKLWRSWYGISHKSAKPFRFKVLQNWDDIVDLCAKDRATGHGAETAMDADEAMSRETNEVEFMGLGATAIDLEESSSNTKEKRQGSTSSGTHPHKRKMGEKEGIAVSFG

SEQ ID NO: 136673 - protein, 292 aa, Glycine max
  Coding DNA Sequence Number=SeqID_44988
  Gene Ontology: Mol. function=cytosol alanyl aminopeptidase activity; Cellular component=cytoplasm; Biological process=peptide metabolic process
  Homolog annotation: Hit_ID=Q6D3E2; Match level="QueryCoverage=100%, HitCoverage=75%, E-value=1e-129, Identity=76%"; Hit description =Peptidase
  Pfam annotation: Domain name=M20_dimer; Domain location=106-209; Score=44.1; E_value=4.9e-10; Accession=PF07687.5; Description =Peptidase dimerisation domain
  Pfam annotation: Domain name=Peptidase_M20; Domain location=30-289; Score=9.3; E_value=0.00041; Accession=PF01546.19; Description =Peptidase family M20M25M40
  Pfam module annotation: Pfam domain module=M20_dimer::Peptidase_M20; Domain location=106-209::30-289
GADLCLNAQQDIWLRVAEHPEILPYVGQEIVFSDGTSVLGADNKAAVSVVMTLVENLRGEHGDVVVAFVPDEEIGLRGAKALDLETRFNVDFAWTIDCCELGEVVYECFNGASAEITFTGVPAHPMSGKGVLVNPLLMAHDFIARFDRLATPEHTAGREGYIWFNDMQANASQAVLKASIRDFDLKGSPRTIRTGHVALKINDIYSNISNAIGEDRRAIDLIFAALQQVGVEPKVIPMRGGTDGSALSAKGLLTPNFFTGAHNFHSRFEFLPIPSFVKSYQVAEALCYLAAR

SEQ ID NO: 136674 - protein, 125 aa, Glycine max
  Coding DNA Sequence Number=SeqID_44989
MSSIITLVYLNGKIYKTDDGITFEGPKKAIQIKRGISFESLKKRIHDKDSLDEDDDIDEISDTDDEAARLIKQLTVVQSGEGGSQTPLWDSASHYSNINWSHPDQEDICGLDMGSTFDMGQELYV

SEQ ID NO: 136675 - protein, 136 aa, Glycine max
  Coding DNA Sequence Number=SeqID_44990
MRHYHIHSLLLYFFVILKFLLILNPIFQSRDPFLIGAAAIASFGYCKERDGSWVKKGTQPADEEGNLPDEDNSTLLRRLMDKFDGLQTFVGDKFDAMELQVDMRFDAMESRITRVEEDVSFIRTCFDPPPPPPSSS

SEQ ID NO: 136676 - protein, 88 aa, Glycine max
  Coding DNA Sequence Number=SeqID_44991
MGIQKNSQAVKPFECFCIREWEESKEFSDCVVLNSLTREKGDTKEFRRLVPQEEFRRLVIGEFFLAKGEENEKMNSTSFQGLENQKTS

SEQ ID NO: 136677 - protein, 63 aa, Glycine max
  Coding DNA Sequence Number=SeqID_44992
MSFDHAALPDLATCTLLQFVTKHSDFVKITFLFTLCHVSESDRHTRYNPFLADASMSMRDNQD

SEQ ID NO: 136678 - protein, 133 aa, Glycine max
  Coding DNA Sequence Number=SeqID_44993
MDFPIHLLPVGQPCLVPGQVSADYIEWFFRISHPVMTPTQAADQQRDAPAADPEDYIQPPSPQVPVAFDPPPYVDDYEGYEAIAQRLERVLNLRIVTAGTELYDIMQDCLTIARGGPSADGTVRARQRRRTDH

SEQ ID NO: 136679 - protein, 212 aa, Glycine max
  Coding DNA Sequence Number=SeqID_44994
MGWLEYRENVWRQKQEPWLDGLVDLAAIDAFLAYHDHKESPVVTMLADLYDTFDRRYKKSNMRIICCTPALYVWLVSHLFHQEVRHACPLECHRSCTEKGGVNWDRLLANKEGASVNWFPRWKEGRIGEELAPVISQGFNKTNMEKLQKVRKAWEVVQKKDKELRGSNNEPIGGYRRTAKREEVEAPEEDEEVQALRAELEQAQTVKEKFKS

SEQ ID NO: 136680 - protein, 236 aa, Glycine max
  Coding DNA Sequence Number=SeqID_44995
MAMFDPDIVLEFYVNAWPTEEGVWDMQSWECEFSQRRNRADGFDEEAIAQLLCIPGQDFARTTAGRRVRIMRTNMTTLTQTWMTLLLSNILPSDHNFDLPLPKCQLAPSRTQISLTGALGFPQLITGLYQSFGGDAPQAAHAPPPPRQADPAGSLGMERYLQHLVRQQAANHWGQGFAPFACPTPDQFRDEVAWPGDWPEAQAEEAPAGAPDDAEEAWMDEEMTDLLSFLGGSGAT

SEQ ID NO: 136681 - protein, 57 aa, Glycine max
  Coding DNA Sequence Number=SeqID_44996
  Homolog annotation: Hit_ID=A5AGE5; Match level="QueryCoverage=87%, HitCoverage=3%, E-value=2e-16, Identity=78%"; Hit description =Putative uncharacterized protein
WWVSKKPTQSDDIPQALATLTLDNTIAETKWTSDTGASNHMTGMRNRETDYHWEAQG

SEQ ID NO: 136682 - protein, 189 aa, Glycine max
  Coding DNA Sequence Number=SeqID_44997
MKTPEKATELIENMSASDHAILCDRVHQPIKKSLLELSFVLPFVVVFMNLAIVFLLKNKRRKLVTWEINKGNDTTKEDLRFPARSLQLGGPSNRAPQQGPNIFQRTTKLEETLAQFMQVTISNHKSTESALKNLEIQVGQLAKQLVEKSSNNFGANTEKNPKEECKAVVTRSRKLVAAEEEDVVALKEQ

SEQ ID NO: 136683 - protein, 151 aa, Glycine max
  Coding DNA Sequence Number=SeqID_44998
INWAHLVRYRIHKALRANAPLPYPQLITLFLRHFQIPLDDEPFVQVKRSFAIGAGAVTSFGYRKDQNGQWLKKDALPPQDERTPSPPPQRDDSALMNEVLTELRGLRSYVGERFDSLDTCFAGMDIRLTQLEEDVGYIRQSFDLPPPPLPS

SEQ ID NO: 136684 - protein, 78 aa, Glycine max
  Coding DNA Sequence Number=SeqID_44999
MMITKDDDKGDDKKLKDQSKNNSSESKINQRTTQNQEEFKTQEESLETRIKIQGSKISRIKIKIQDSRFKNEEKTQSR

SEQ ID NO: 136685 - protein, 123 aa, Glycine max
  Coding DNA Sequence Number=SeqID_45000
MERSMIDAASGRALGDMTPTEARNLIEKMASNSQQLSAKNDAIVIRGVHELALNQKSAPVARLCGLCCSIDHHTDLCPSVQQPGAIEQPEAYVANIYNRPPQPQQQNQPQQNNYDLSDNRYNP

SEQ ID NO: 136686 - protein, 208 aa, Glycine max
  Coding DNA Sequence Number=SeqID_45001
  Homolog annotation: Hit_ID=A7UQS9; Match level="QueryCoverage=52%, HitCoverage=48%, E-value=6e-07, Identity=33%"; Hit description =Putative uncharacterized protein
VTGCTICGEAHEMGQLTRVYSRRIFGFQQGPYNQQGQWRTHPGNQFNKDQSGPSNRPIQQGPNIFQRTTKLEETLTQFMQVTMSNHKSTESALKNLEVQMGQLAKQIADKSSNNFVANTKQNPKEECKAVMTRSKRFVEAEDEESVVHKEKAAEKKGIEVKKNDVRGEGNHEKGKQIMIQNKELKDQEKEKEVEKEIENEKNEKEEKK

SEQ ID NO: 136687 - protein, 313 aa, Glycine max
  Coding DNA Sequence Number=SeqID_45002
  Pfam annotation: Domain name=Transposase_23; Domain location=125-190; Score=-17.5; E_value=0.099; Accession=PF03017.5; Description =TNP1ENSPM transposase
DSFVPHGRQDVLAAAIGCPEHPGRVRAAGAGVTIKQYFGSAPRTSRSVSSLPPDELQQLTQQIRDQLEESITEKVTRQVMASFSQLQSQMQSQAPPEPLVGPGPSGPRVSTKGSCVDPSGNDPEMGDSDRCGLYIEADPARMVSVGRVYEGSTLVHSTPLLLGQVKVSVDEVKDADAPVPVPTAEVAVSRPKPPPKPDPEVDDPLYLMTLTIPELFLRPYQVRWDATVFGVANPDFPLYIKHEDLSEIAHGGQCLSISVLQLWILHLTETCMRAGNYDIYGFLELQSIQRSGQSQFESESYIKSWMQSSQRNV

SEQ ID NO: 136688 - protein, 62 aa, Glycine max
  Coding DNA Sequence Number=SeqID_45003
MHSSLVIHRICSYSKRRIKCLGSSSSMDSFASWKMNDSGMEKEEREEMPLQGEDESRRSSPP

SEQ ID NO: 136689 - protein, 193 aa, Glycine max
  Coding DNA Sequence Number=SeqID_45004
MQALTLKIETLMGAQAQVPVTTPPFPTCDRCGIVPGLGECIVDYELNVLFYVTGCSTRIQEIGWPIQKKKSTGPDNPHCRPPYLYRPLFNNLKSPPWFNNIYELQIQIMRELACWSRHCEHINWMLPSINFWDFEPLLRTDEVVWSSAHHRVHETSYNTCISNIGHLLLDSIVLDLHAHNLFSNSHVLHLKFP

SEQ ID NO: 136690 - protein, 55 aa, Glycine max
  Coding DNA Sequence Number=SeqID_45005
MSNVKIIPVRKIKENGPLLPYATLTFILLLDLPSIQDDWVLESDDAYCRQFFSHV

SEQ ID NO: 136691 - protein, 55 aa, Glycine max
  Coding DNA Sequence Number=SeqID_45006
MEEAEKEILETFRKVEELGTNKQKLKGSERISMGRNVSALIGKYVPQITENVKIQ

SEQ ID NO: 136692 - protein, 100 aa, Glycine max
  Coding DNA Sequence Number=SeqID_45007
MVYPADGLSSVSDVLVFVGEYLSGVQVSGPCPSISGGILRFRVPACVAYAKRTSKGLRRKPRSRIRLFGYKIEKNALDGCPGIEKEGRFQRRKAMGRYRL

SEQ ID NO: 136693 - protein, 97 aa, Glycine max
  Coding DNA Sequence Number=SeqID_45008
MSLHVLYLWAFSGFPPGISCLLYLSLQSFKEMNVDSRLLVLTGRITLGYLLEWRQSMDRQKPIKVLKDERKRGWGHDRPIVALLCAKKSRECRCKAA

SEQ ID NO: 136694 - protein, 90 aa, Glycine max
  Coding DNA Sequence Number=SeqID_45009
MTQELVAREDTLRLSAPRHSVTPSVIDEQRSMWSSAPFRRCQHLPVETFSSLTSYQELRRSEFLIGGIHRSKSLAFCRPPKTKSLIARRD

SEQ ID NO: 136695 - protein, 278 aa, Glycine max
  Coding DNA Sequence Number=SeqID_45010
MRSWVRGQWIPFDADAIGQLLGYPLVLEEGQECEYGRRRNRSDGFDEEAIAQLLCIPGQDFARTAAGRRVWIMCTNMTTLTQIWMTLLLSNILPTDHNSDLPLPKCQLVWRLLGTLWTQISPTGPWGFPALITGLCQSFGVPVAPTKVIRPPITRAFMRSIVPRDRLRGMLHRPRARHHHSSGWPAGAFDMEAVFTAFGSPAGGQPPEHMYGPMTSQSFASFSCPTPDQFRAEVAWPGDWPETQAGEAPPEAPGDGEEAHEDEEMADLLDFLGGSGDT

SEQ ID NO: 136696 - protein, 191 aa, Glycine max
  Coding DNA Sequence Number=SeqID_45011
  Homolog annotation: Hit_ID=Q84VI1; Match level="QueryCoverage=98%, HitCoverage=27%, E-value=1e-74, Identity=79%"; Hit description =Envelope-like protein
MATSSKETAASGSPSVPSSPHQEQPELNIQPIQIIPGQASVPEKLVPRRPQGVKIAENPSPATSPREVDTEMDKKIRSIVSSILKDASVPEADEDVPTSSNPNVSVPDVKKDVPTSSAPNAEALPSSSEENHQRKMIKPQRRPPAPRAPEPAPGDFIDLEEVEFDEEPIAKKLAPGIAERLQSRKGKTPHY

SEQ ID NO: 136697 - protein, 32 aa, Glycine max
  Coding DNA Sequence Number=SeqID_45012
MGLKVEANQGKTVMRPQFAADVVSFFQMPHLP

SEQ ID NO: 136698 - protein, 187 aa, Glycine max
  Coding DNA Sequence Number=SeqID_45013
  Homolog annotation: Hit_ID=A7UQS9; Match level="QueryCoverage=55%, HitCoverage=45%, E-value=8e-07, Identity=31%"; Hit description =Putative uncharacterized protein
VTGCTMCGEAHETSQCIPTEENTQEIHFMGNQQRQGYTQGGFLGFQPIQQGPNIFQRTTKLEETLTQFMQVTMSNHKSTESTLKNLEVQMGQLAKQIADKSSNNFGANTENNPKEECKAMMTRSKRFVEAKDEENVVDKEQLSEKIGAEVKKNNVKEKSISGKAVEESVEVPYPVVPSKKEKDHDLE

SEQ ID NO: 136699 - protein, 146 aa, Glycine max
  Coding DNA Sequence Number=SeqID_45014
  Gene Ontology: Mol. function=helicase activity; Biological process =viral genome replication
  Homolog annotation: Hit_ID=Q2A9I1; Match level="QueryCoverage=89%, HitCoverage=9%, E-value=6e-26, Identity=49%"; Hit description =Putative uncharacterized protein
LHAYVRFGLYVRLHACLQKFRMRRDKLHFAAVPDLKMKLISQRQTNERLYNLPTTTEVAALIVGDEHSADKRDIIIEKQSGLLKRIHELHPAYFSLQYPLLYPKGEDGYRLNIPHKDHANIHAAKRKQVTLREYFAYRLQSRTDEA

SEQ ID NO: 136700 - protein, 129 aa, Glycine max
  Coding DNA Sequence Number=SeqID_45015
  Subcellular localization annotation: CTP_CleavageSite=36; ConfidenceScore=5.04e-01
MQPPPHEFGVMRSDCLVQFSILNPSFRSPMNCVFVHASSTHEFGAMRSDCLEQFSILYFYWSPMNCVFVHASSTHEFGVMRSDCLVQFSILNAFSEPHELCFRSCILTYKFGAMRSDCLVQFSILYPFS

SEQ ID NO: 136701 - protein, 173 aa, Glycine max
  Coding DNA Sequence Number=SeqID_45016
MATMMEAMMSMKKIMEANAVAIAATSAVAKVNPMPPSGLNQMNHPTSDMHTFPPYGLPRNYTPPNVAYTPSENVNNSTPILFESQQPQFDHAHVFRPIGETHEMPHHNLDDFKPCLGYASEGQVVGGIPLQNTLEGPQYHPQPHLLHSAAGKKPSCYGRNGKAGSSRGKAQGH

SEQ ID NO: 136702 - protein, 176 aa, Glycine max
  Coding DNA Sequence Number=SeqID_45017
  Homolog annotation: Hit_ID=Q6UUU1; Match level="QueryCoverage=34%, HitCoverage=40%, E-value=1e-18, Identity=78%"; Hit description =Putative uncharacterized protein
MALGKPWSLITSLKKSFEMWEASSTLWHGIKCSILLNLSTTTKIESTPLWVLGSPRTKSILMSTQGAEGMGKVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136703 - protein, 180 aa, Glycine max
  Coding DNA Sequence Number=SeqID_45018
  Gene Ontology: Mol. function=transcription factor activity; Cellular component=intracellular; Biological process=regulation of transcription, DNA-dependent
  Homolog annotation: Hit_ID=P41030; Match level="QueryCoverage=76%, HitCoverage=40%, E-value=1e-55, Identity=82%"; Hit description=HTH -type transcriptional regulator galS
  Pfam annotation: Domain name=LacI; Domain location=45-70; Score=50.9; E_value=4.5e-12; Accession=PF00356.12; Description=Bacterial regulatory proteins, lacI fa
MEWLWRRLTQLAAGKADNACFRCPDRIAPLRASRAFSPLWNNCMITIRDVARQAGVSVATVSRVLNNSSAVTSDTREAVLQAVESLGYRPNANAQALATQVSDTIGVVVMDVSDPFFGALVKAVDTVAQRMHKHVLISNSWHQEEKERHAIEVLIRQRCNALVVHAKTLTDAELARFMDQ

SEQ ID NO: 136704 - protein, 663 aa, Glycine max
  Coding DNA Sequence Number=SeqID_45019
  Gene Ontology: Mol. function=DNA binding; Biological process =regulation of transcription, DNA-dependent
  Homolog annotation: Hit_ID=A5BRG5; Match level="QueryCoverage=42%, HitCoverage=68%, E-value=5e-20, Identity=29%"; Hit description =Putative uncharacterized protein
  Pfam annotation: Domain name=B3; Domain location=1-67; Score=2.1; E _value=0.047; Accession=PF02362.12; Description=B3 DNA binding domain
  Pfam annotation: Domain name=B3; Domain location=288-357; Score=12.4; E_value=0.003; Accession=PF02362.12; Description=B3 DNA binding domain
  Pfam annotation: Domain name=B3; Domain location=360-435; Score=20.1; E_value=0.0004; Accession=PF02362.12; Description=B3 DNA binding domain
  Pfam annotation: Domain name=B3; Domain location=567-656; Score=30.8; E_value=4.9e-06; Accession=PF02362.12; Description=B3 DNA binding domain
  Pfam module annotation: Pfam domain module=B3::B3::B3::B3; Domain location=1-67::288-357::360-435::567-656
MSNPVVLLLRNGAEWKVKWKKLDVDVWLIDDWKEFADFCCLDQDHLLVFKYMGKSRFQVVIFYQNGLEMQYPLMEETIDGNSLCQPKRAKSPLPFSSSIKKVKTNPRKEPSSYPGHDHDVKTEPAQSQRRKVELSKKFHADDLDDAKPKKRGGRRRRIMCSNSRAIKRDELLQDTESSTALERAKAFRTDNPSFIRAMGKSYIERSVLDNNLKIGNVCVFEQIKKPGISFRVVIFRDPEESSPFKFPGLQNIIAKSGSDGIPKEHSGRNVFDDSESRRFNNNKVSENHFTISIKPSQLCHMNVPKKFIKNHDIDNTKEVTLQVGKRSWNVTLDCYGRFTSGWSEFMSQCDLEAGDRIPRSFVNKCWEGISNPVLLLLPNGVEWKVKWKKLDADILLIEDWKEFAEFCSLDKDHLLVFEYLRKSQFLVVIFDQNGLEMEYPLMGGTLDGDEKGNSLCQHKRAKSPLPFSSSIKKVKGKTLTSYPSHGVRTERAQSQRTKVEFSKEFLAEDLERGGRGRGMMNAKRRCSNSNALKSSTALERAKAFRSENPFFIHSEFRGCNNEVSENHFTLSIKPCQFYCMNVPKKFIRNHEMDGINEVTLQVGKRSWNVKLDCYGRFTSGLHDFMSQHNVEAGDVIHFELIDKKKFVFQVRVTRCISIDFELL

SEQ ID NO: 136705 - protein, 242 aa, Glycine max
  Coding DNA Sequence Number=SeqID_45020
  Homolog annotation: Hit_ID=Q2HVW1; Match level="QueryCoverage=53%, HitCoverage=53%, E-value=4e-10, Identity=29%"; Hit description =Putative uncharacterized protein
MNKEVSGNQFTLSIKPNPSYHEPIPLELIRNLGIDNVNDVNLHIGERSWPVRFPKHNYDVAGNVKLEYVGDDIVIMEGISDERIVEEMKNEEDSLLSIFHSAHKWNDEEYSGNRLALVQCLGIPLKAWNEVCFSKLVSEFGKFIFVDKVTASREKIDVARVMVQIATPSTIIFCDNVRINGIICNVRVVEETLQQVESCGRRIMYANRRCSKSKAVRSELLQEDTEGSTALDRTNSFRSENP

SEQ ID NO: 136706 - protein, 278 aa, Glycine max
  Coding DNA Sequence Number=SeqID_45021
  Gene Ontology: Mol. function=DNA binding; Cellular component=nucleus; Biological process=regulation of transcription
  Homolog annotation: Hit_ID=A7P441; Match level="QueryCoverage=99%, HitCoverage=99%, E-value=2e-50, Identity=43%"; Hit description =Chromosome chr1 scaffold_5, whole genome shotgun sequence
  Pfam annotation: Domain name=Myb_DNA-binding; Domain location=20-71; Score=36.1; E_value=1.3e-07; Accession=PF00249.22; Description=Myb -like DNA-binding domain
MGSCGREGSVRQYVRSKVPRLRWTPELHRCFVHAIDSLGGHHKATPKLVLQLMDVKGLTISHVKSHLQEHDDGCVDEGNDVGVEYSCSKPMGRESDSFFGHSNLPPKRARIETRSSISESLQCSQRLCDAVQNPYCFYDYLQQKKPMADEHKEFSTWQQAQPHSLLFPEFPNHTSFNSPNQQSDFLQVTKLNEGKSTSQPSNVLVNTTTETAIAEVEDELSLSLTLPNPSPQSSGSEISEAISSCPGFGNNYKDCSSSSTHTLKERINLDLSLALCGN

SEQ ID NO: 136707 - protein, 137 aa, Glycine max
  Coding DNA Sequence Number=SeqID_45022
MKVDTDPFHIQANYVKPVQIMMMRASIGTSKVSALLSEKEKQKFEKEVMLCPRCSVVFDRSIAKAFEASEIRKSFQKVPETEVKKRINPTSLKQMFQQGNKGYSSHFKEFEVNSSALRRGGATDGLRKGYYDYQNPP

SEQ ID NO: 136708 - protein, 190 aa, Glycine max
  Coding DNA Sequence Number=SeqID_45023
  Subcellular localization annotation: CTP_CleavageSite=45; ConfidenceScore=5.19e-01
MSPLLSLSLSSPLIVTTNTTSPPSTSLQPLVTTIITVITIGISIVVVTVDVIIHHTNGWGLDGDGQGTPLTYSIQLTTTRMTTSFCGDVLGTTVAYTRVPAIPGEGFVENIVGEVEREEWGRRICLRRGRGWRGMGGGQRVDKEHVGEVQVGVVEGGDMVTIVIGDTEPRAIRDGGISQRENEWCGVGND

SEQ ID NO: 136709 - protein, 139 aa, Glycine max
  Coding DNA Sequence Number=SeqID_45024
  Gene Ontology: Mol. function=anthocyanin 3'-O-beta-glucosyltransferase activity; Cellular component=integral to membrane; Biological process=metabolic process
  Homolog annotation: Hit_ID=A6XNC7; Match level="QueryCoverage=79%, HitCoverage=27%, E-value=3e-32, Identity=54%"; Hit description =(Iso)flavonoid glycosyltransferase
MIQIRLVGDMPKKKAKEKKKGCLHGLILRKEESVLYVSFGSMNKKIDEGATRVFLEEFEKRVQESSKGYLIWGWAPQLVILEHPVTGGVVTHCGINTVFESVIASLPMVTWPIYADQFFNEKLLVDVLRIGGERMEKLE

SEQ ID NO: 136710 - protein, 846 aa, Glycine max
  Coding DNA Sequence Number=SeqID_45025
  Homolog annotation: Hit_ID=A5AXV9; Match level="QueryCoverage=98%, HitCoverage=51%, E-value=1e-163, Identity=41%"; Hit description =Putative uncharacterized protein
MSGESKREDPTSERCGDKRKAGWISVIEDAKSESSKIIIARDSQTREQTSEGNTSKGGTKAEGLSNSFARQPLAMGKDRDNIKDGSRGCDIFEEKIRRLPGGETWDRKMKRKRSVGTVVARSIDGEGELKKVMHIRLANESGPQGSDAQGLRSGYSGSNSKLDGASVPATFTTANNEQEKVSRGSVDGSNKERVVLKGNKFNVRNNNYTGGIHTLTKGKASRPPRTGALMAGNSSSVPCSSEILDAEEQPSNVNKPHSVSGTINRKRPLPVGSSSSPMAQWVGQRPQKISRTRRANVVSPVPSSDEVHTSLEGCSPSDVITRKTTAATSGFLISNGAINGGIHPGKMKHESVSSPTKLSESEESGAGENGESKMEKGLESNEVDGSAINNSYNTSSSMLTSKKKKIPNKEEVGDGLRRQGRGSRGSSVLKNGISPMKEKLETPTLMKPIKNMKPASEKNGSKSGRPPLKKSCDRKSITRIGHPSTNNSPDIAVEDDDREELLAAANFASNASFLYLPVATFDIGCSSSFWKKLEPIFSPVSLKDMSYLKQLVKTTEADLRCLSQMLGIGSDALDRLTHTESPLSQSSISRARERSIVNQTDSKEISSMDDMVGQHLDVSILCQQMDSEGNKLVPLYQRVLTALIIDEEIVEDGNMPSLCERDDSPQVACHFQDVENQSSIRMDFEFNSDKVSCNGNATFTSCTDIHDQELGIFLQMNQGSLHLETERVSMLSENGNDESMGMHGVSCSASFSCHFEQMSMEDKLLLELQSVGLYPEPVPDLADGDCEAINQDIIQLQKGLFQQVNKKRECFMKLIQAVEQGREMEQGALEQVAMDKLVELAHKKKL

SEQ ID NO: 136711 - protein, 48 aa, Glycine max
  Coding DNA Sequence Number=SeqID_45026
MALELLFEECVDFLEAMPWMEEEDKSKLLSKTLKKHKLTRPIATKELE

SEQ ID NO: 136712 - protein, 1266 aa, Glycine max
  Coding DNA Sequence Number=SeqID_45027
  Gene Ontology: Mol. function=binding; Cellular component=microtubule; Biological process=beta-tubulin folding
  Homolog annotation: Hit_ID=A7PYD1; Match level="QueryCoverage=99%, HitCoverage=98%, E-value=0.0, Identity=69%"; Hit description =Chromosome chr15 scaffold_37, whole genome shotgun sequence
  Pfam annotation: Domain name=HEAT; Domain location=1150-1186; Score =4.1; E_value=6.5; Accession=PF02985.13; Description=HEAT repeat
  Pfam annotation: Domain name=HEAT; Domain location=382-417; Score =26.7; E_value=8.8e-05; Accession=PF02985.13; Description=HEAT repeat
  Pfam annotation: Domain name=HEAT; Domain location=510-544; Score =2.2; E_value=13; Accession=PF02985.13; Description=HEAT repeat
  Pfam annotation: Domain name=HEAT; Domain location=622-658; Score =1.8; E_value=15; Accession=PF02985.13; Description=HEAT repeat
  Pfam annotation: Domain name=HEAT; Domain location=714-750; Score =19.5; E_value=0.012; Accession=PF02985.13; Description=HEAT repeat
  Pfam annotation: Domain name=HEAT; Domain location=757-792; Score =12.2; E_value=0.4; Accession=PF02985.13; Description=HEAT repeat
  Pfam annotation: Domain name=HEAT; Domain location=941-977; Score =6.1; E_value=3.3; Accession=PF02985.13; Description=HEAT repeat
  Pfam module annotation: Pfam domain module=HEAT::HEAT::HEAT::HEAT::HEA T::HEAT::HEAT; Domain location=1150-1186::382-417::510-544::622 -658::714-750::757-792::941-977
MEANLEKVTMNQEDDELESKESVLQKYFLQEWNIVKSLLDDIVSNSRVSDPSSVHRIRSILDKYQEQGQLLEPYLETIVCPLMNILRSRTLELGVASDEILEIIKPICIIVYTLVTVCGYKSVIKFFPHQVSDLELAVSLLEKCHHTNSGTSLRQESTGEMEAKCVTLLWLYILVLVPFDISTVDTSIANNDNLTEFELSPLVLRIIGFCKDYLSTAGPMRTMAGLVLSRLLTRPDMPKAFTSFVEWTHTVMSSVTEDLLHHFQLLGVVEALAAIFKAGSRNLLLDAIPVVWNNTTMLYKSSDAARSPLLRKYLMKLTQRIGLTALPHRLPSWRYMGRVAKLNVSLNTSNKIDQSNLGVNSHDSNSNEMLDREEDEDMDVPENVEEIIEMLLSGLKDMDTVVRWSAAKGIGRISSHLTSSFSEEVLSSVLELFSPGEGDGSWHGGCLALAELARRGLLLPASLPKVVPVIVKALHYDVRRGPHSVGSHVRDAAAYVCWAFGRAYYHTDMRSILKEFAPHLLTVACYDREVNCRRAAAAAFQENVGRQGNYPNGIDIVNTADYFSLSSRVNSYLHVAVSIAQYEGYLFPFVDDLLDRKICHWDKSLRELAAEALSFLVKYDPQHFASTVMEKLIPCTLSSDLCMRHGATLATGEIVLALHQCNFALPSDKQRSLAGVAPAIEKARLYRGKGGEIMRAAVSRFIECISIYKVVLSEKIKKSLLDTLNENLRHPNSQIQNAAVKGLKHFIRAYLHASDNKGISDVTAKYLSMLTDPNVAVRRGSALAIGVLPYELLASQWRNVLLKLCGSCKIEENPEDRDAEARVNAVKGLTLVCETLINGREDTATSFVEDDFSLFILIKNEVMISLFKALDDYSVDNRGDVGSWVREAALDGLEKCTYMLCKIDKSVCLSGRSDGNEIEPIAYPSIDSMLKNNRELFLFNENLATNLVGGICKQAVEKMDKLREAAANVLCRILYNQMIHIPYIPFREKLEEIIPKEADAQWGVPSYSYPRFIQFLQFACYSRDVLSGLVISIGGLQDSLKRVSLLALLEYLEGVEYEDPSTRTSRVYMLSADILWVLQQYKKSDRVIVPTLKTIEILFSKKIFLNMEAHTPAFCGAVLDSLSFELKGSKDFSKLYAGIAILGYVASVQEPINMRAFSQLLNFLGHRYPKIRKASAEQLYLVLLENGDLVAEDKIDKALEIISETCWDGDMDSAKHQRLKFSEIVGLEVGSLGNNSDGTSRKTSSKKPTDLDENASYSSLVEASGF

SEQ ID NO: 136713 - protein, 94 aa, Glycine max
  Coding DNA Sequence Number=SeqID_45028
MVRVRGLGQTLDRVIVRTLGREPQEAPTDDVVSDVEGFPERLELKLFFYGRKVEKFGRFAPQIEGLVTTIGLSSLIACSLDTGDRGLLFAFAKR

SEQ ID NO: 136714 - protein, 82 aa, Glycine max
  Coding DNA Sequence Number=SeqID_45029
  Gene Ontology: Mol. function=transferase activity
  Homolog annotation: Hit_ID=A5BLF4; Match level="QueryCoverage=100%, HitCoverage=74%, E-value=1e-19, Identity=56%"; Hit description =Putative uncharacterized protein
MASGVILRRSVKHTLTATSTMEVEFVSFFEVTSHAIRERVKDKKVVIERISIELIIVDPLTKGMPPFKLKDHVERTRLGSTL

SEQ ID NO: 136715 - protein, 182 aa, Glycine max
  Coding DNA Sequence Number=SeqID_45030
  Gene Ontology: Mol. function=ribonuclease H activity; Biological process=RNA metabolic process
  Homolog annotation: Hit_ID=A7QL30; Match level="QueryCoverage=57%, HitCoverage=53%, E-value=9e-16, Identity=39%"; Hit description =Ribonuclease
MKLSNSSPSIKFVVAKKADSLYPIVSGASIVAKVIVRVVCAYQSSLTLGIVYRESDNLDEDGGGSNNKNRLSNVGFTTSKRSEEIESSGKGRCRFFQARKLEHLTYVELYIIRISSLYNIFCIYTFLDGTQSSKMCTSSPRQILGCLNGVVELPSVSRFGSEAGERDTSSPQQSCTRHLLAL

SEQ ID NO: 136716 - protein, 76 aa, Glycine max
  Coding DNA Sequence Number=SeqID_45031
MVKIGGGVAHGGNGLGNLPRLVGSANSKDCDVNPFAQGLKMDLQRVECKVFGSKFECVWMKNEDDNNGVQVELKNE

SEQ ID NO: 136717 - protein, 1552 aa, Glycine max
  Coding DNA Sequence Number=SeqID_45032
  Homolog annotation: Hit_ID=A7Q991; Match level="QueryCoverage=9%, HitCoverage=37%, E-value=1e-16, Identity=34%"; Hit description =Chromosome chr19 scaffold_66, whole genome shotgun sequence
MSAMEKHVVQIFERKKRIIDQSRQQCHLWEQHLFPKLRLNGIPPPPWLCNSSRHADPQGLSKDDLVSEVLISQPQYRVPFPSVCSNLDSVSYGVQYPIGLHNEGRALEKECNTGDGVSNFPDCPVNYAVCASSGPPELDSGAVSPPQNQIETRASDSHHDPAPSLAKLQRSKSRQKALELRNSAKAPRRLSGEDDNACVCAGTVTGSAPSTQEAEHAMESDVVKDFHSNIQSCSMEEMEACVYVTNYSGRMTRSKSSSQKFNSLNVASPSVAKEDGPLPNNLNESFEIVNQPCFANASCGINEANKREYQSKEAGKSVYDERLTESRSSSQARCNRELLKLDSTLGSGKGVDFCDHRQPITHAQLTDLSKASDCNNGSGRNTVKDGNSCLSKQESNIHGMIKLLRGSCPSPGHDLMMTGGFVRSIDKSVPLPQPSISQNSQDLVLSVVGTFNSQKDLDFSALKPNDRLSRSGSEKIEKVLKSSRYNFCEQSATCSESAGKKSWNVPPTKLDARRLSSSPEYSKLDTEIGRNSADKENVAALAASGKMRAVVTSANEGSLRPVSSSNLYGGPSNLESVYVEAAVDEKVLDVQENIPYGALPTDNVEHRSAAIVGKVEADFDGLVEKDPYCVIPKVGQNVSVLKPPTDFTMSVMPKQLDFDDVEETSMSGICSPDLKEGQQGVSPEEPLNSLEPVKLLEEETSSVCQSKCNSLGEMPSLQMQEVPIREEEPRMEYCASHLEEEDIARETLSAAPPNKEMPMVQNGFCILTSSLMNHSCPSQVAGENSSRSLSKEVMPTKFVSVNSTLENDESSAKLADSSEAVTGNDLHKSTDANVTNFTVAFPFSAPMADVNVGLARQGPNSITLCQDGDVLRKTLLSEGKITSFSPDFQIFRSSTKSFTYDVEHSCPQHKRRKIEIETERFRAASSNLLEKPCDSIDQRPASRNLSIEEDSREIALEVQNLPSDPEDDIGHQSISNIPTDEMQYNGECQTMEDSSLKVRKEEKCTLDGRDRSEDTLLLAVANPSGFSIDSTMGCTMDEKVESWHHQVSCGQECAEHLSCVEKSTSSRRVYPGGNAKFSDGMSASPGMQCLDLVGTDETIPELEGFIMQADNAQPCITGDQMDLEEMDLEKMDLEEIDLPKPYQSLPNGLLKGLGIRTSLPLSDGSPRSLSDCQPNCKDLPCITEENENVDEIPGTFQRGIGSEGMAGGRKDILSTEFNLSGTCDKVKNKLDKQDGNRKRFTRKGKENHNISLGANGVKRTAGSVCKRPKLSGKDSMKQGPINNIVSNVSSFIPLVQQKQAAAVVTGKRDVKVKALEAAEAAKRMAEKKENERKMKKEVLRLERERLELELQKKKKEEERKKKEEQMAAKKRQMEDEEKKEKEKKRKRVNDKKKQQQDHMKIQAKKEEIKIQRRATDEVQENKKIIDERENHKNLSVQDKRECNMEKISETEPLTMVDLANDKKESHPDYSESVNDCANNGQVMDNLIKATEDDDLIIKDSLQEQSYDISPYRGSDDEDEDEDDLPNNKLIPSWARFVTVQVFGAYLFYSAIL

SEQ ID NO: 136718 - protein, 84 aa, Glycine max
  Coding DNA Sequence Number=SeqID_45033
MASNRSSSWARGEGEGSRKRYAKEEGEGSRKKARGRKKSRSKKKAYFNKLLGAPAILLGAPSISPNKIIVSLSSAGLPYIPGNC

SEQ ID NO: 136719 - protein, 224 aa, Glycine max
  Coding DNA Sequence Number=SeqID_45034
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=65%, E-value=6e-33, Identity=100%"; Hit description=LacZ protein
MGKKSLKLPSLFKTKEAPRNHHHPWQFMPSCGHSKTLSFRGGDDDMFKTVNSMFFDPSAESTIETPKSWFTTSSESASISTESEDYYYCDGESLEMLVRGVRSERLFFEPGDTSSILEKAKASGFPFKGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 136720 - protein, 58 aa, Glycine max
  Coding DNA Sequence Number=SeqID_45035
MDEGAFEEVPSGVQEYDIGASAVGVVDDGNLVGMIEIDEDTNRAGKTPMTMMKPGAYK

SEQ ID NO: 136721 - protein, 582 aa, Glycine max
  Coding DNA Sequence Number=SeqID_45036
  Gene Ontology: Mol. function=binding; Cellular component=integral to membrane; Biological process=transport
  Homolog annotation: Hit_ID=Q535K6; Match level="QueryCoverage=99%, HitCoverage=98%, E-value=0.0, Identity=79%"; Hit description=Nitrate and chloride transporter
  Pfam annotation: Domain name=MFS_1; Domain location=29-477; Score =14.9; E_value=0.006; Accession=PF07690.7; Description=Major Facilitator Superfamily
  Pfam annotation: Domain name=Nodulin-like; Domain location=23-268; Score=504.0; E_value=1.8e-148; Accession=PF06813.4; Description =Nodulin-like
  Pfam module annotation: Pfam domain module=MFS_1::Nodulin-like; Domain location=29-477::23-268
MAIRGVDGWRDMKSLTVNVITGRWFVVFASFLIMAAAGATYMFGLYSSDIKTTLGYDQSTLNLLSFFKDLGSNVGILSGLINELTPPWVVLAIGAILNFFGYFMIWLSVTKKIAKPKVWQMCLYICIGANSQSFANTGSLVTCVKNFPESRGAVLGILKGYVGLSGAIITQLYHAIYYDDTRSLILLIGWLPAAISFAFLRTIRYMKPVRKPNELKVFYNFLYVSLGLAGFLMVMIIVQNKVDFTQSEFGVSAAIMLFLLFLPLTIVSVEEYKVWLSKRLALVDPSPVKIVTDQVMKPNEPTNNGNNSVSDDTKWWENVFSPPARGEDYTILQALFSVDMLILFMTCICGVGGTLTAIDNLGQIGTSLRYPKKTRSTFVSLVSIWNYLGRVFSGFVSEYFLQKYKFPRPLMLTLTLLLSCVGHLLIAFDVPNGLYVASVIIGFCFGAQWPLLFAIISELFGLKYYATLYNFGSAASPLGLYVLNVKMTGYLYDKEAKKQLAALGLKRIEGQELNCVGVHCFKLSFIIITAATFFGAIVSLILVARTRTFYKSDIYKRYRNAATESETEMAEKDSKHVVPAQK

SEQ ID NO: 136722 - protein, 151 aa, Glycine max
  Coding DNA Sequence Number=SeqID_45037
MRVAIAMERLDGEKVGEEMDLLAYEAHMAYFTGPRHNVTGWAYVVGYGSVQQQIIFHLLAQHPPTKTSTQIHHLHTTNPITIPNPSTTITHIQHGGRCKFNKTTNSTIDGGDQRKVVDVTTQISTGTRLPTQHGGITQDFNRTVNCHYGCG

SEQ ID NO: 136723 - protein, 149 aa, Glycine max
  Coding DNA Sequence Number=SeqID_45038
MKNDEEFPQNHLRKRYGSTSTRFFFTKTCFLPKIAEMHSSGVMNIFETAPSPIYREKERCLPPRGFLRKISKRTPITKFTPLFILYGKVTEALWKCFGFDFHLFFSSLSPMLSEICLSKVFGNFTEALRKPQKPFFNNVEELVVQLLPP

SEQ ID NO: 136724 - protein, 53 aa, Glycine max
  Coding DNA Sequence Number=SeqID_45039
MVVRCDVEVHGVIVMHVVVVGDWVVTRCWGAMVMEVWGELVMDISSREDEQER

SEQ ID NO: 136725 - protein, 294 aa, Glycine max
  Coding DNA Sequence Number=SeqID_45040
  Gene Ontology: Mol. function=hydrolase activity, hydrolyzing O -glycosyl compounds; Cellular component=vacuole; Biological process =carbohydrate metabolic process
  Homolog annotation: Hit_ID=A5C8A3; Match level="QueryCoverage=26%, HitCoverage=21%, E-value=5e-26, Identity=68%"; Hit description =Putative uncharacterized protein
  Pfam annotation: Domain name=Glyco_hydro_1; Domain location=36-294; Score=-246.9; E_value=2.7e-06; Accession=PF00232.9; Description =Glycosyl hydrolase family 1
MVMRNSSSTLVDTVIEDTHIINGKPVEIKQTIPREAAGWNSKDFRTKKIFVGGIPSTVTEGSVVRKICLKMQLLRVLPSLHPYVILFHWDVPQALEDEYGGFLSPHIVDDFRDYAKLCFKEFDNRVKHWITLNELRSVSKNGYANGRIIPSWALCHFIILADPLFLFLLASEGQDEYENDGFIMDKDEEEDEKEDRAESDDEPQKKKKRKKKEEYVLDEDDYELLEDNNINIHRRKESKKFKQLKKGRRDTEEEPFGLSDEEEFVGSGKVGRTIEEKLKCSLFGDDEVMPSVSD

SEQ ID NO: 136726 - protein, 253 aa, Glycine max
  Coding DNA Sequence Number=SeqID_45041
  Gene Ontology: Mol. function=aspartic-type endopeptidase activity; Biological process=DNA integration
  Homolog annotation: Hit_ID=Q69FA4; Match level="QueryCoverage=90%, HitCoverage=22%, E-value=3e-58, Identity=47%"; Hit description=Gag -pol polyprotein
  Subcellular localization annotation: CTP_CleavageSite=52; ConfidenceScore=5.19e-01
MAEATKPIINVDASKPTPPTATFAKSLPDVSKIEVLTSQNFRRRQERVRTLLDMHGVVFALSTPKPDAAIDANQLQQWVQANKRFIIPNYYQWTMNEEKDTKEQINEYHKLLEDLKPENISLLDEFISELLIEKLSKSWTNSKQQLKHRHKHMSLPDLIIHIITEDTNKKESVVARTKVTFAKANTKQDKPFHKKYVYKIDLNNKKNYKHNNLRDALSNPIPQCKYRVMKNDNPPKLKANLVEGDDIIVAVIY

SEQ ID NO: 136727 - protein, 42 aa, Glycine max
  Coding DNA Sequence Number=SeqID_45042
MVAEGVAVGRCFMVGKAAFSWMNDQTQKIDAIKIVDFSVHVA

SEQ ID NO: 136728 - protein, 376 aa, Glycine max
  Coding DNA Sequence Number=SeqID_45043
  Gene Ontology: Mol. function=oxidoreductase activity; Biological process=metabolic process
  Homolog annotation: Hit_ID=O81816; Match level="QueryCoverage=97%, HitCoverage=97%, E-value=3e-93, Identity=46%"; Hit description =Monooxygenase
  Pfam annotation: Domain name=DAO; Domain location=8-283; Score=-49.3; E_value=0.018; Accession=PF01266.15; Description=FAD dependent oxidoreductase
  Pfam annotation: Domain name=FAD_binding_3; Domain location=8-300; Score=-65.9; E_value=5.5e-08; Accession=PF01494.10; Description=FAD binding domain
  Pfam annotation: Domain name=GIDA; Domain location=8-165; Score= -244.5; E_value=0.059; Accession=PF01134.13; Description=Glucose inhibited division protein A
  Pfam annotation: Domain name=Pyr_redox; Domain location=8-97; Score= -3.7; E_value=0.01; Accession=PF00070.18; Description=Pyridine nucleotide-disulphide oxidor
  Pfam module annotation: Pfam domain module=DAO::FAD_binding _3::GIDA::Pyr_redox; Domain location=8-283::8-300::8-165::8-97
MESLLVEDIVIVGAGIAGLATSLALHRLGVQSLVLEYSDTLRVTGFALTTWTNAWKALDALGVGAILRHQHVQLKENVTTSLIMGQQTSSLSFEGTGKQQLMLEAIANVLPSGTIRFLSKVVAIEESGFSKIKIVRLADGTSIKTKVLIGCDGINSVVAKWLGFKEASFTGRYVIRGYKKVMDNHGLEPKFMHYFGKGFRSGVMPCDDKTVYWFLTWTPTSEEKELANNPSKMKQLVLRKVEKMPSNVCVVGDAFHPMAPDLGQGGCCALEDGIILARYLAEAFSRKTCKHVVKKMGEEGKAKEQYKKIDASLRKYAKERRWRNIDISVTSYVLGFVLQGDLKMVAHFRDKVLPDFLAELLLKKSDFDCGKLNASS

SEQ ID NO: 136729 - protein, 124 aa, Glycine max
  Coding DNA Sequence Number=SeqID_45044
MSEKLILTSIWLTLLGKTPPDKYVKSKMIYLSWLRQNFQQLHDVDDIVIAQYIRCNTPPSAYNLSPSSSCYRSSLPTQIHDMRHKDEEDDDNNTTNNNDDDDDNGGDHVPQQQHTITHEYPVTR

SEQ ID NO: 136730 - protein, 52 aa, Glycine max
  Coding DNA Sequence Number=SeqID_45045
MEWSLRLNLTQLGKTYQAKIYGGAWSFLVGGAICLVNSDNGRDLDLLTSSIY

SEQ ID NO: 136731 - protein, 148 aa, Glycine max
  Coding DNA Sequence Number=SeqID_45046
MTCCSRRTKGAEDYVSLCMPSSVLSTDSKRMFIRITTRVFPAYHRARRLWMIQGCRMTKLGFCLSSGPPPLDDKRVRITIRMTKLGLFLSSGPPPLDDKRVRITIRYLRVSWVQNDQTWSLLVIGPAASGRQKGANNHKVSPRIMGAE

SEQ ID NO: 136732 - protein, 262 aa, Glycine max
  Coding DNA Sequence Number=SeqID_45047
  Gene Ontology: Mol. function=catalytic activity; Cellular component =cellular_component; Biological process=biosynthetic process
  Homolog annotation: Hit_ID=Q2SMG9; Match level="QueryCoverage=98%, HitCoverage=98%, E-value=2e-83, Identity=60%"; Hit description =Predicted epimerase, PhzC/PhzF-like protein
  Pfam annotation: Domain name=PhzC-PhzF; Domain location=2-257; Score =164.6; E_value=2.6e-46; Accession=PF02567.7; Description=Phenazine biosynthesis-like protein
MKLELYQIDAFTDELFRGNPACVVPLKEWLPDETLLKIAMENAVAETAFFIDLGSRIHLRWFTPEIEMDLCGHATLATAHCLISVLNYNRNEIIFETKSGDLKVTYRDGLYYLDFPSRMPSPSSLPDLISKSLNIQPKEVFKSRDYVLVYDNEDDIRNIKIDRQIFDQINLDPGGVIVTAKGDHSDFVSRYFTSQASILEDPVTGSAHCSLIPFWSDRLGKKDLFAMQLSERLGKLYCEDQGDRVIIAGKAKTYAAGHLWTE

SEQ ID NO: 136733 - protein, 65 aa, Glycine max
  Coding DNA Sequence Number=SeqID_45048
  Gene Ontology: Cellular component=chloroplast
  Homolog annotation: Hit_ID=Q49KT9; Match level="QueryCoverage=47%, HitCoverage=27%, E-value=2e-10, Identity=96%"; Hit description =Putative uncharacterized protein ORF113
MGAGHARSRYLNRKEGDAEGRASDWSEVVTRALSHMDSLMCSSAPDPEMWIIQGTLAWRTSLFEP

SEQ ID NO: 136734 - protein, 112 aa, Glycine max
  Coding DNA Sequence Number=SeqID_45049
  Homolog annotation: Hit_ID=Q8GEG1; Match level="QueryCoverage=58%, HitCoverage=77%, E-value=1e-20, Identity=54%"; Hit description =Putative uncharacterized protein
MAYERGGDFLEDARKILNREVRGPRQSRFSIGSAPLTSITKSDAQISGGETRQDYKDTRRFPLAAPSFAPSWTVCTNPPFSPTAAPLSGNYRLEVQPGKDMQKHHWAAATGN

SEQ ID NO: 136735 - protein, 79 aa, Glycine max
  Coding DNA Sequence Number=SeqID_45050
  Subcellular localization annotation: CTP_CleavageSite=39; ConfidenceScore=5.26e-01
MDVLCLVGTSVKPTKHRGRMQSRNAGARGIVSFLDTTSRGSKVPQHTLVCLQRGSRQNPYAMHMQKTQCGNVHSMTIFT

SEQ ID NO: 136736 - protein, 300 aa, Glycine max
  Coding DNA Sequence Number=SeqID_45051
  Homolog annotation: Hit_ID=Q6WAY6; Match level="QueryCoverage=97%, HitCoverage=58%, E-value=7e-26, Identity=30%"; Hit description =Putative uncharacterized protein
MGSSQKPSLKQRFYQVKIKSLEVTSLRELGQLMGQLQRQAFRKAYGKIWDLARVEVSMEPIASLSQYYDQPLRCFTFEDFQLVPTVKEFEEILGCPLGGRKPYLFSGFYPSTTRVAKEWGSRSTKEVFGGKGKRPWQIKATGLSFIDILALWIFGVVLFPNMEGLVDLAAIDAFLAFHHGKESPVDAILAMYDTFDRGGEKSGARIVCCALALYVWLVSHLFLQEGRKNRDSIFIRRMSKGSLDGTRGCINYNPVLAIRQLGYLMRGVPSDESITPFIARGFSDHNARVLQGVRKAWDAA

SEQ ID NO: 136737 - protein, 123 aa, Glycine max
  Coding DNA Sequence Number=SeqID_45052
  Pfam annotation: Domain name=zf-CCHC; Domain location=69-83; Score =16.3; E_value=0.0053; Accession=PF00098.14; Description=Zinc knuckle
MELQRLNQNEETDKKKRSIALKASLSMQEENEEKNQMMKKTSHYLRIERSQNFNNGRRSQEDSQVLRFYKCNQLGHIKANCPSNEEWPEKSDKKRYDERRTKKRALHGMTMTHSTVPRRRSTF

SEQ ID NO: 136738 - protein, 137 aa, Glycine max
  Coding DNA Sequence Number=SeqID_45053
MKIEKHVSYSSHDSCKSLSEELSDYYRGHHTSHTKHHSQRREKDKRPQEGPPGPSRGFQQKAVPSGGSNPARLGELSPPGQAELALENWAATTSLFFPINRGKKAEEKCSVLLVFRILAKLVRKIVSVEKIQAEVLP

SEQ ID NO: 136739 - protein, 277 aa, Glycine max
  Coding DNA Sequence Number=SeqID_45054
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDDIALTFDFHDNPKSTPTVAKNEPVVSAPPLLLPPAPAPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136740 - protein, 129 aa, Glycine max
  Coding DNA Sequence Number=SeqID_45055
MIMRGQDIYSSQDEATTSPSSSGSEEAKGEESSEEIYPQEEGQPLMVKVECKEVSVSSKRFAKKESHFSINKKIKETSSLRQPPHLLLCKKTLVSTATPLGLEVIPQVKKLLDEDLVLLGTQHLHDSCT

SEQ ID NO: 136741 - protein, 46 aa, Glycine max
  Coding DNA Sequence Number=SeqID_45056
MSQNFTDCATMPSFDFRHITELHELPNDGCQEKGRICIYAYPARQS

SEQ ID NO: 136742 - protein, 127 aa, Glycine max
  Coding DNA Sequence Number=SeqID_45057
MQLWSGIRREDLDRVKQTRNGIVGLPRKYLEGKARDMANQEEWVPFIDVLALLIFGVVLFPNVDGLVDLAAIDAFLAYHHSKESPMVAILADLFDTFDEDVKRVVHGSSVVYPLFMYGWFRTYSNKT

SEQ ID NO: 136743 - protein, 114 aa, Glycine max
  Coding DNA Sequence Number=SeqID_45058
  Subcellular localization annotation: CTP_CleavageSite=38; ConfidenceScore=5.42e-01
MVFFEVLQWLLFLSAVPPCSATDGVVRNGQKHRRTSALASVAVTLRVTTTPAALNAPLQGASHSPFRLRNCWEGRSVRASSLLRQLAKGGCAARRLSWVTPVFSQFGRGKTKPR

SEQ ID NO: 136744 - protein, 296 aa, Glycine max
  Coding DNA Sequence Number=SeqID_45059
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSINKLSNKFVQKTSTGTWGRAVYIVLYDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136745 - protein, 52 aa, Glycine max
  Coding DNA Sequence Number=SeqID_45060
MGHCAPKCAILAIRIAIPWIIGLNQAHAFTKRFIKSRLKYGSDRPCKTGAKG

SEQ ID NO: 136746 - protein, 199 aa, Glycine max
  Coding DNA Sequence Number=SeqID_45061
MHPFVIQADTVVSDDKQRPSLVILHPRYAEIPYGYLHPFARQTQLCPMASRDQVWSFCTQDTRRHLTVICTPLLGRHSCVRWQAETKFGHSAPNDTRRYLTVIRTPLLGRHNCVRWHAETKFGHSAPMIRGDTLRDQVWSFCTHDTRRYLTVIRTPLPFRHSRVQWHAETKFGHSAHMIRGDTLWLFAPILLLSVRQNA

SEQ ID NO: 136747 - protein, 72 aa, Glycine max
  Coding DNA Sequence Number=SeqID_45062
  Subcellular localization annotation: CTP_CleavageSite=58; ConfidenceScore=5.11e-01
MGARDKSIMHKRFMQKSLLNVSRSLIIKDHTFTGLRLMRSFTINLTNQLTSSVMIIIPCSFSSNDYMFIQGI

SEQ ID NO: 136748 - protein, 49 aa, Glycine max
  Coding DNA Sequence Number=SeqID_45063
  Subcellular localization annotation: CTP_CleavageSite=40; ConfidenceScore=5.07e-01
MGVQIATRPTWALQKIPPEGGCFWRKSPCSLGRSSTFFVRSSSFFGLQR

SEQ ID NO: 136749 - protein, 180 aa, Glycine max
  Coding DNA Sequence Number=SeqID_45064
MIRGDTLWLFAPFCHPEAAGPMTSRDQVWSFCTLVSSRGGGPDDTRRYLMVIAPFCHPEAAGPMTSRDQVWSFCTLVSSRGGGPDDTRRYLMVIRTLLSSRGGGPDDKQRPKAAGPMTSRDQVWSSCTLVSSRGGGPDDTRRYLTVIRTLLSSRGGGPDDRQRPSLVILHPCIIQRRRAR

SEQ ID NO: 136750 - protein, 209 aa, Glycine max
  Coding DNA Sequence Number=SeqID_45065
IVDIKLNKGPFGSKSNGEDSSHCDWFHHWRVGVTVILTIFLVESFGDQACFIFVYGTIRVLFDPENPFAPDGSFMRRKRYQAPFQWIDERACCTVVGSVVVRLIVGKRGGEGEEVGVELGSMVEEAVEGKVGVGEAEALMYGEDVWLGKNSEIEDDPFFVKEEWQGKEMIAAMLRGAGPVGNPLKKGRFRGERKEMEDLATLVEESEGS

SEQ ID NO: 136751 - protein, 74 aa, Glycine max
  Coding DNA Sequence Number=SeqID_45066
  Subcellular localization annotation: CTP_CleavageSite=13; ConfidenceScore=5.11e-01
MSSCVRFSSNRTVATYPSAGGRRVTRGMRVPRKEYAQSRHQRLFEENVGKTGKDAIYELLSERFGSCIYARGSA

SEQ ID NO: 136752 - protein, 108 aa, Glycine max
  Coding DNA Sequence Number=SeqID_45067
VPPVQLLTGWCVTAKAPPDLSAGKAAQLLGRAIGAGLFAITPAGERGMCCKAIKLGNARVFPVTTLRFAYWALAECILAYYVGTDEGVSEVLSCGRRKKAAPVRQQNM

SEQ ID NO: 136753 - protein, 98 aa, Glycine max
  Coding DNA Sequence Number=SeqID_45068
MVFGNRLHRMCNRLPGLKRGPGSQDGFWELGRPSKEDPEEDPEELPPEPVVDALDFLERDEDPLPEEDSPEDVMSASEADSMEESGPREMATSGGSSS

SEQ ID NO: 136754 - protein, 259 aa, Glycine max
  Coding DNA Sequence Number=SeqID_45069
  Homolog annotation: Hit_ID=Q6WAY6; Match level="QueryCoverage=88%, HitCoverage=41%, E-value=3e-12, Identity=26%"; Hit description =Putative uncharacterized protein
GVLFSCGDYPNVPLIGTRGCINYNPALAIRQLGYPMRGAPTEESLSPFLVRDFGAQSLKVVQRVHKAWKSPLKKDKELRGIHNGIIGGYHEDEEVQALKLELGKARLAKEKFKSAAYKHPERVCGVTRGKMRLLQEPLNKKPRGPRKEEHGRDKFRGALWGSNNELKLRREERDQSRVHGMILKEELVACSRSKRSLAQHLEAMERSMLAIIGQYKEELNQSLTHEQKLVEDFAQAYAEKEARGRVIDALHQEATMWMD

SEQ ID NO: 136755 - protein, 134 aa, Glycine max
  Coding DNA Sequence Number=SeqID_45070
RGGRCKTQGASPGGAVVGADLGGTGEARLIALCARTPKGNRVKIPEPGPCPPWKRLQPGGTECLPTPGRTHNRIRSPKGEQPLVDGTIPEPVGCRWTARAASAARAGRRVPVGGRIGNGPFGASSPGVEQSTQN

SEQ ID NO: 136756 - protein, 73 aa, Glycine max
  Coding DNA Sequence Number=SeqID_45071
  Subcellular localization annotation: CTP_CleavageSite=26; ConfidenceScore=5.02e-01
MRTRSPLKVRACSPLKARMCSPLEVRASSPLLARMCSLLQGEGNAALCWRGRVVLSRVRACSPLLARTCIPLK

SEQ ID NO: 136757 - protein, 105 aa, Glycine max
  Coding DNA Sequence Number=SeqID_45072
MGIAPTKTPRGPEEVQQGPGVSSSGYGPLSVLQGARIAPARHLVDPKKANRVLELPALNTGLYQSYGVPVTSGKGIKPPTNRAFIKKYCAPRQAQGETPRQHWDG

SEQ ID NO: 136758 - protein, 138 aa, Glycine max
  Coding DNA Sequence Number=SeqID_45073
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MTRKTRQDFSVSKRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 136759 - protein, 53 aa, Glycine max
  Coding DNA Sequence Number=SeqID_45074
MKELHHQECALDKKLEKDALMEEKKESRGKHKIEGIKEGGKWNFESIFLEKLS

SEQ ID NO: 136760 - protein, 117 aa, Glycine max
  Coding DNA Sequence Number=SeqID_45075
MSKRLQEDWARATEEGPRVLVNLRDTKALAPKVKKKEKKGRCSSEKVVKKESHFSTKGDIKRALLLKQSFYLLLSRETSFSIATIPPLETIPLKVQELLQEFGDVFPKEIPPGVTSS

SEQ ID NO: 136761 - protein, 102 aa, Glycine max
  Coding DNA Sequence Number=SeqID_45076
  Homolog annotation: Hit_ID=Q8U5C3; Match level="QueryCoverage=100%, HitCoverage=100%, E-value=9e-51, Identity=94%"; Hit description =Putative uncharacterized protein
MLRDTKNKGNASQDPQETAAAILGWLANEPEMLGRFLALSGLQANMLRQAVSDPGFLAGLTDFLMSHEPDLMAFCAATDTSPETVAAAWHHFSGPGLDSGVY

SEQ ID NO: 136762 - protein, 148 aa, Glycine max
  Coding DNA Sequence Number=SeqID_45077
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MAKESSYSPEDRLLRAILGIQKRFVYIFYRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGCGGYAQRDRYTCQPLMSGGAFA

SEQ ID NO: 136763 - protein, 103 aa, Glycine max
  Coding DNA Sequence Number=SeqID_45078
MAIQAEESRADQKVKAFKPQLADELALEPVDDSVELEEIVEEAEGDEEGEPPIRDCQEKIKKKEEKEKKEEIKEKEEKKSSKMKNKKKRSLSLKRRRERVRLT

SEQ ID NO: 136764 - protein, 160 aa, Glycine max
  Coding DNA Sequence Number=SeqID_45079
MTSRDQVWSFCTLVSSRGGGPDDTRRYLTVIRTLLSSRGGGPDDRRDTKGGGPDDKQRPSLVILHPLYHPEAAGPMIRGDTLRLSAPLCHPEAAGPMTSRDQIWSFCTLVSSRGGGPDDTRRYLTVIRTLLSSRGGGPDDKQRQNLVILHPCIIQRRRAR

SEQ ID NO: 136765 - protein, 117 aa, Glycine max
  Coding DNA Sequence Number=SeqID_45080
MSKVSRERKVQVPENFERFYCGKICGDQSLKQEPGPFNSGHWSNSKFLDSIGLSFPHYHEESGCDKLVVYVCLNAVLVEFSLTRGICGRCLIRIRLNNHEESGFSISGDTIRTHEHC

SEQ ID NO: 136766 - protein, 146 aa, Glycine max
  Coding DNA Sequence Number=SeqID_45081
  Homolog annotation: Hit_ID=A5BZW2; Match level="QueryCoverage=34%, HitCoverage=4%, E-value=4e-08, Identity=50%"; Hit description =Putative uncharacterized protein
MGIKHFEVTNEGRMLIKNGPRMKLGFDRSSSVEAEKQRKDVSYDVRDWIYVHLQFYRQLSVFGTTYTMLAKHYYGLYKIIERVGALPPTFHDHHPLIQPLTILQSKWDQAFSPPFSGCWYNGWVYRLKMPLGKGGMSFHNLFTLRT

SEQ ID NO: 136767 - protein, 77 aa, Glycine max
  Coding DNA Sequence Number=SeqID_45082
  Subcellular localization annotation: CTP_CleavageSite=41; ConfidenceScore=5.12e-01
MVKVGTSLRADQRLIFAKKLAQGFPVSTGTPGFIYSANCPSCSATDGVVRNGKKHRRTISAGKCSGPAARNHHTPRA

SEQ ID NO: 136768 - protein, 157 aa, Glycine max
  Coding DNA Sequence Number=SeqID_45083
  Homolog annotation: Hit_ID=A0ST23; Match level="QueryCoverage=15%, HitCoverage=51%, E-value=3e-07, Identity=100%"; Hit description =Putative reverse transcriptase
MNDIVIGDSKRAKSGRGSKFAPIAIPMYEWASAEVNSYPSWLQTLVSIEGLKGRGEVDFVYMNEDVYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 136769 - protein, 148 aa, Glycine max
  Coding DNA Sequence Number=SeqID_45084
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=68%, E-value=1e-24, Identity=70%"; Hit description=LacZ protein
MPMKPNEVILGSLLAACRTQGNISLAENVMNYLIELDPGGDSNYVLLSNIPGDPLVLERPPPRWSSNSPYSESYYNSLAVVLQRRDWENPGVTQLNRLAAHPPFASWRNSEEARTDRPSQQLRSLNGEWDAPCSGAFKRGGVWWLRAA

SEQ ID NO: 136770 - protein, 147 aa, Glycine max
  Coding DNA Sequence Number=SeqID_45085
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=4e-25, Identity=56%"; Hit description =Putative uncharacterized protein
  Subcellular localization annotation: CTP_CleavageSite=41; ConfidenceScore=5.42e-01
MTMITPSSKLTLTKGNKSCFSIRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 136771 - protein, 180 aa, Glycine max
  Coding DNA Sequence Number=SeqID_45086
  Homolog annotation: Hit_ID=Q84VH5; Match level="QueryCoverage=100%, HitCoverage=32%, E-value=7e-87, Identity=76%"; Hit description =Envelope-like protein
MDLIKAAGLLKTVTKLGDCYEGLVREFIVNIPSDISNRKSDDYQRVFVRGKPTDGVIDIAVSEHQIAKEITAKQVQHWPKKGKLSAGKLSVKYAILHRIGAANWVPTNHTSTVATESFAVKLPIAFPTVLCGIMLSQHPNILNNIDSVMKRESPLSLHYKLFEGTHVPDIVSTSGKAAAS

SEQ ID NO: 136772 - protein, 61 aa, Glycine max
  Coding DNA Sequence Number=SeqID_45087
CKQWLLDLRTNTILVDFLPGLEPPDVGQSRNTLQTRKWRKHDSPSNNVHGAPKKGENGGLP

SEQ ID NO: 136773 - protein, 110 aa, Glycine max
  Coding DNA Sequence Number=SeqID_45088
MQRFQVIQGTCNRLPMVVVIIKKGENVNHEDFDDIKKNLLEKEGDVNHASFDGVEKKSHVCHHQKGGECEYSLKTKPCLKTKCFQDMQGSGNRLPGSVIDYQKTGLRNSC

SEQ ID NO: 136774 - protein, 106 aa, Glycine max
  Coding DNA Sequence Number=SeqID_45089
MTRGNPSDLQPFDPEIDRTFHRLVREHLIPFEHSVIGDFEHYSFEHSDFAHSENMAQPPPRERTLREMAAPDFTYESLCIQYPDEDVPYVLKTGLIHLLPKFHGLQ

SEQ ID NO: 136775 - protein, 124 aa, Glycine max
  Coding DNA Sequence Number=SeqID_45090
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=79%, HitCoverage=75%, E-value=3e-25, Identity=66%"; Hit description=LacZ protein
  Subcellular localization annotation: CTP_CleavageSite=32; ConfidenceScore=5.06e-01
MTMITPSSKLTLTKGNKSCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGDRYTCQR

SEQ ID NO: 136776 - protein, 105 aa, Glycine max
  Coding DNA Sequence Number=SeqID_45091
MLAIITKYQEELNLAAAHEHRVADEYAQVYAEKEARGRVIDSLHQEATMWMDRFALTLNGSQEFPRLLAKANAMVDTYSAPEEIHGLLGYCQHIIDLMAHIIRNR

SEQ ID NO: 136777 - protein, 74 aa, Glycine max
  Coding DNA Sequence Number=SeqID_45092
MSVKNLVGRLGVHDKTNHTLASQSGSQCFARMLEPYGINIGLKEHSNWVIPKAYTPKSPSGPLPPDSGPTQKTF

SEQ ID NO: 136778 - protein, 59 aa, Glycine max
  Coding DNA Sequence Number=SeqID_45093
MNSRNQSRYIGTDASGGGVTTDRSLPLLCAKQAENVAARQPSILCIHSFLLLFVCFKNK

SEQ ID NO: 136779 - protein, 53 aa, Glycine max
  Coding DNA Sequence Number=SeqID_45094
MSAIEFSIQSVNEVCMMSSGLFHDPLSAIEFSIQSLNEICMKSVRKCSIGAIR

SEQ ID NO: 136780 - protein, 75 aa, Glycine max
  Coding DNA Sequence Number=SeqID_45095
MKTFQFAHGKRCNKGEQYPISPAHRLSLPYEIPDEHSSGGQECERSGHRYIEQLSEMPQNVLYDAIGIYQRWYIQ

SEQ ID NO: 136781 - protein, 279 aa, Glycine max
  Coding DNA Sequence Number=SeqID_45096
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLVSLCHPGWSSVAPSQHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 136782 - protein, 195 aa, Glycine max
  Coding DNA Sequence Number=SeqID_45097
  Gene Ontology: Mol. function=aspartic-type endopeptidase activity; Cellular component=small subunit processome; Biological process=DNA integration
  Homolog annotation: Hit_ID=A5CB76; Match level="QueryCoverage=77%, HitCoverage=52%, E-value=9e-18, Identity=32%"; Hit description =Putative uncharacterized protein
  Pfam annotation: Domain name=zf-CCHC; Domain location=126-143; Score =13.8; E_value=0.012; Accession=PF00098.14; Description=Zinc knuckle
MKVTALKQTGHDMIAHVGKARAAVEELKKFLVADSLEEMNRKLDKFYMVLILRSLHSDFDHVRDQVLAGDQVPSMDSLITRLLCVPHALKEENPADVVETSTMVASRGREGGRNSRGGRNGKGGRPQCTYCKRMGHTQENCYSLHGFPEKVAKVAQTEKSESKFSDEEYQEYLKLKSEKSSSQLKEVVKSLCLPH

SEQ ID NO: 136783 - protein, 128 aa, Glycine max
  Coding DNA Sequence Number=SeqID_45098
MVKVGTSYVPINVSGFRKRWPSWASRWRTSYIPGLFGEGSVKLIGAIPDGFFEAPVAYHGFIAVPSCSATDGELGASAFQSEPVGNCLMNGQRAGDRGGFAIPGAKGGVYTGLLCLRVSSEVLHVRTL

SEQ ID NO: 136784 - protein, 81 aa, Glycine max
  Coding DNA Sequence Number=SeqID_45099
MDIVVAGTELLNSNVIHIHVRVVMLVRMIRTRLFAAARVKSCPGMHSRCVIASLSGCAHTVGRPPISGGGPGTDKRKLVAP

SEQ ID NO: 136785 - protein, 60 aa, Glycine max
  Coding DNA Sequence Number=SeqID_45100
MLPKFSTRHVRRYMEKNEETTMEEKGFGCFKSNSAPRMVNLQDSKFSFKQCTNFLFQSLL

SEQ ID NO: 136786 - protein, 132 aa, Glycine max
  Coding DNA Sequence Number=SeqID_45101
MPNSTLTGDSLVEAVDYTIKTREQITKLLHHNLLHAQERMKHYADLRRVDKEFKCGDCFDDVKKNLLDKGGECGSCIVLMMSQRNHLIVIIKKRENLMMPKKNQTRPLQRISICFKINSRMLQQTKSCFKIH

SEQ ID NO: 136787 - protein, 135 aa, Glycine max
  Coding DNA Sequence Number=SeqID_45102
MGEVEEVQEKMKADMEAMKEQMAMMMEAMMILKKIMEASAVEVAATSTVVKVNPMPQSGLNQMNHPTSAMVGKDLGSMGGPHDVQIQNVHAFPPCGLPLNYTPPNVAYTPNKNVNNSTPIPIESQQPQDDHAHVS

SEQ ID NO: 136788 - protein, 83 aa, Glycine max
  Coding DNA Sequence Number=SeqID_45103
MRGTVHEPQDDRPLSDESISCFLIRVDPWVLVPITFRGLHVLAIRGLHVLAIRGLHALTCRGLPVLALRGLHALTLGTSYPHQ

SEQ ID NO: 136789 - protein, 54 aa, Glycine max
  Coding DNA Sequence Number=SeqID_45104
THLLLEVASPLSLPFSIPLPFIFQEAKESIDEDDPRPTSSNGACITHTLRMRSY

SEQ ID NO: 136790 - protein, 173 aa, Glycine max
  Coding DNA Sequence Number=SeqID_45105
FAGLGELATPLRTTAAEYRRRVNLQRRDACATGGGGGTRRGDCQRTAGARSVAAGRAGRAVRDVVTRRQLLPGSHRRNRAAPRYHCAARVAAAANDSRLTALGGDLPQADRHADRLRGGGGRQGVGECAAGGFTPCVQTGRASRRYPPAAGRWRSSSAPRAHGATACSPSSPA

SEQ ID NO: 136791 - protein, 222 aa, Glycine max
  Coding DNA Sequence Number=SeqID_45106
  Gene Ontology: Mol. function=allophanate hydrolase activity; Cellular component=cytoplasm; Biological process=metabolic process
  Homolog annotation: Hit_ID=Q0VNA8; Match level="QueryCoverage=75%, HitCoverage=13%, E-value=1e-48, Identity=58%"; Hit description=Urea carboxylase/allophanate hydrolase
  Pfam annotation: Domain name=Biotin_carb_C; Domain location=7-116; Score=120.4; E_value=5.4e-33; Accession=PF02785.10; Description =Biotin carboxylase C-terminal domain
AQGHAIQVRLYAEDPAKQFQPSAGLLSHVQFPTALDHATLRIDSSVESGMEVSPFYDPMLAKILVHAADRQRALDGMIAALAQSELYGIETNLRWLRQLCTLPDVQQGRIITATLGSVAWQPPTLDILSGGTLTTVQDAPGRVGYWHVGVPPSGPFDSRAFQLGNRLLGMQLCAERRAAGGHPRQPAAGDASGAACAGRANPDAGRRARRLPKLSAAGGRAE

SEQ ID NO: 136792 - protein, 128 aa, Glycine max
  Coding DNA Sequence Number=SeqID_45107
MRGQDIYSSQDEATTSPSSSESEEAKGEESSEEIYPLEEGQPLVVKEKCKETLVNTATPLGLEVIPQVKELLDEGVPTDSKRIKVIPDWPPPPSVEGRSLEYEEPRDLRSNPFQGRGDDAILPPKGIG

SEQ ID NO: 136793 - protein, 46 aa, Glycine max
  Coding DNA Sequence Number=SeqID_45108
GRGCMARRIARAQQERPSRAPGDGEEAHEDEEMADLLDFLGGSGDT

SEQ ID NO: 136794 - protein, 156 aa, Glycine max
  Coding DNA Sequence Number=SeqID_45109
  Gene Ontology: Mol. function=serine carboxypeptidase activity; Cellular component=extracellular region; Biological process =proteolysis
  Homolog annotation: Hit_ID=A5AE13; Match level="QueryCoverage=68%, HitCoverage=25%, E-value=3e-37, Identity=66%"; Hit description =Putative uncharacterized protein
MISDQSYKSILKYCNFTAEETSKKCDDVYSYAVNYEFGNIDQYIIYTPTCTTAQNNTVRHLRFKNLHLISGYDPCTENYAEKYYNLPKVQIAMHANVTNIPYKWTACRKDKQKHCALIYNLKSKSNSSKFYEMTSFNTWLDTSSMESTNHHHDQYS

SEQ ID NO: 136795 - protein, 120 aa, Glycine max
  Coding DNA Sequence Number=SeqID_45110
  Subcellular localization annotation: CTP_CleavageSite=41; ConfidenceScore=5.15e-01
MNFVFVYVSSTFEFGAMRSDYLVQFSILNLFRSPMNCVFVQASSTHDFGAMRSDCLLQFSILNPFSEPMNCVFIHASSTHEFGAMLSDCLVQFSILNPFSNPHELRFRSGLLHPRVWSHA

SEQ ID NO: 136796 - protein, 102 aa, Glycine max
  Coding DNA Sequence Number=SeqID_45111
  Pfam annotation: Domain name=zf-CCHC; Domain location=30-47; Score =28.5; E_value=2.4e-05; Accession=PF00098.14; Description=Zinc knuckle
KFQKIVKRRRIERCQNFNNGRRSQEGSQVLRCYKCNQLGHIKENCPSNEEWPERSDKKRNDERRTKKAYIAWDENDSSDGSEKEINLLTKDYESDENIFQED

SEQ ID NO: 136797 - protein, 93 aa, Glycine max
  Coding DNA Sequence Number=SeqID_45112
  Gene Ontology: Mol. function=nucleic acid binding; Biological process= DNA integration
METTNSEEDNVNMWYLGTGYSNHMTGHKEWFVNIDDKVKSKIKFGYSMQMEDSQLKMFDSNKRLILKVPLSRNRTFKIGIQIAEFHLLGCFYK

SEQ ID NO: 136798 - protein, 118 aa, Glycine max
  Coding DNA Sequence Number=SeqID_45113
LDFQLSESINKAFLLPLIKGRELDPFQGYHRLLLIDIVVEGRSGYSNSRQFKSDLTRKWALAADQDGVEDTVCDKYGISKEKWAQFCQTRRDPSWEDVRMKAQAIQKQNTAPHVLSCG

SEQ ID NO: 136799 - protein, 70 aa, Glycine max
  Coding DNA Sequence Number=SeqID_45114
MGKAEEVQEKVKADMEAMKEKMATMMEAMMSMKKIMEVNAVTIAATSIVAKVNPTSPFDINQMNHPTSNM

SEQ ID NO: 136800 - protein, 102 aa, Glycine max
  Coding DNA Sequence Number=SeqID_45115
MQRRSTTSDLIPIDLEINATCKRRNAERIRKFLQDLEAAAILEEEPRSFEVSSSFPIPGQSHTNLIEEVNMAEEPRRVTLEDYSSSSVPQFFTSIAQPEVQA

SEQ ID NO: 136801 - protein, 106 aa, Glycine max
  Coding DNA Sequence Number=SeqID_45116
  Subcellular localization annotation: CTP_CleavageSite=59; ConfidenceScore=5.23e-01
MHDGMHMIQMQSRNAGARGIVSFLDTTSRGSKAPQHTFLRRRHGPSLVCLQRGSRQNPYAMHMQKTQYGNVHSMTIFTEHKQKGYMILMHGSCEKWHATCLLRAPI

SEQ ID NO: 136802 - protein, 79 aa, Glycine max
  Coding DNA Sequence Number=SeqID_45117
MVFHLRLVMSFKTKKWETRLKGAIKGINSRKHPQESSQGYCASIQTGKTHQKIMMMDGSNSHKGKLITFKLSFQNYHDM

SEQ ID NO: 136803 - protein, 86 aa, Glycine max
  Coding DNA Sequence Number=SeqID_45118
MVGYTPSSFPDLVFARERIDEGLKRGKFNHPAWANKKTGANKEGEDEGETHAVTAIHVRPSFPPTQQCHYSTLLLTYCPFIHKGHP

SEQ ID NO: 136804 - protein, 154 aa, Glycine max
  Coding DNA Sequence Number=SeqID_45119
MGSSQKPSLKKRFYQVKIKSLEVTSLRKLGQLMGQLQRQAFRKAYAVEVLHLWGLPAITNGIRPPKASRKWGGRNTEKIFGVLFPNVDGLVDLAAIDVFLAYHNHKESPVVAMLADLYDTFDRRCPSIRYKVTARALKKERRIGTNSWLAWGGV

SEQ ID NO: 136805 - protein, 228 aa, Glycine max
  Coding DNA Sequence Number=SeqID_45120
  Homolog annotation: Hit_ID=Q2HW90; Match level="QueryCoverage=73%, HitCoverage=37%, E-value=3e-15, Identity=33%"; Hit description =Putative uncharacterized protein
MGSSQKPSLKKRFYQVKIKSLEVTSLRELGQLMGQLQRQAFRKAYGKIWDLARVEVSMEPIASLSQYYDQPLRCFTFEDFQLVLTVKEFEEILGCPLGGRKPYLFSGFYPSTTRVSKYQGSVWRKGQRPWQIKANGLSFIDILALLIFGVVLFPNMEGLVDLAAIDAFLTFHHGKESPVVAILAMYDTLDRGCPSIRYKVTARASKKERRIGTNSWLAWGASVNWFPR

SEQ ID NO: 136806 - protein, 172 aa, Glycine max
  Coding DNA Sequence Number=SeqID_45121
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPNGAPYPVTIVLSPT

SEQ ID NO: 136807 - protein, 126 aa, Glycine max
  Coding DNA Sequence Number=SeqID_45122
MEEGCVASVNQIYHLAGSIADEEGAAGSGLLLKLHVLHGHLPHKFFDGRNVWSAWASNILEGRSRLLLLLLRARPSEIRVIPPSRVVSVAGEHKLRAAQLLQVAAWKGKGLYGGQQRSTNHRLLRQ

SEQ ID NO: 136808 - protein, 237 aa, Glycine max
  Coding DNA Sequence Number=SeqID_45123
  Homolog annotation: Hit_ID=A5C0V9; Match level="QueryCoverage=95%, HitCoverage=43%, E-value=1e-08, Identity=24%"; Hit description =Putative uncharacterized protein
MLQVPVPTNEVSLVGQALHTFLAWPTHLVKSLSQQVAVSPAKPPPKPDPEVDDPLYLMTLTIPKLFLRPYQVRWDATVFGVFNPDFPLYIKHEDLSEIAHGGQCLSISVLQLWILNLTETCMRVGNSDIYGFLEPQSIQRSGQSQFKSESYIKSWMQSSQRDVYLGAYLNGPDNYLKGIINSAIKGLDDAPQAKSKASAWWIVVKCNRQKGSTECGYYVMHWMSTIILGTFRNNWEV

SEQ ID NO: 136809 - protein, 122 aa, Glycine max
  Coding DNA Sequence Number=SeqID_45124
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLNSIGAVGGETGGILGNCSRCCYRCRKTRESA

SEQ ID NO: 136810 - protein, 445 aa, Glycine max
  Coding DNA Sequence Number=SeqID_45125
  Gene Ontology: Mol. function=magnesium ion binding; Cellular component=chloroplast; Biological process=metabolic process
  Homolog annotation: Hit_ID=Q672F7; Match level="QueryCoverage=96%, HitCoverage=71%, E-value=0.0, Identity=77%"; Hit description=E-beta -ocimene synthase
  Pfam annotation: Domain name=Terpene_synth; Domain location=2-117; Score=38.5; E_value=8.4e-12; Accession=PF01397.12; Description =Terpene synthase, N-terminal domain
  Pfam annotation: Domain name=Terpene_synth_C; Domain location=121 -390; Score=439.2; E_value=5.6e-129; Accession=PF03936.7; Description= Terpene synthase family, metal binding domain
  Pfam module annotation: Pfam domain module=Terpene_synth::Terpene _synth_C; Domain location=2-117::121-390
MSLVQFSDVCGLFTCVLSTHIFERFKDYNGNFKAILSRDVKGMLSLYEASFLSYEGEQILDEAKAFTSFHLKGALKEGRSNTMILEQVNHAMELPLHHRIQRLEARWYIESYAKRKDANMVLLEAAKLDFNIVQSTLQTDLQEMSRWWKGMGLASKLSFSRDRLMECFFWTVGMVFEPQLSDLRKGLTKVASLITTIDDVYDVYGTLDELELFTAAVESWDVKAVQVLPDYMKICFLALYNTVNEFAYDALKEQGQNILPYLTKAWSNMLKAFLEEAKWSRDKHVPKFDDYLNNAWVSVSGVVILTHAYFLLNHSITKEALQSLENYHALLRRSSTIFRLCNDLGTSKAELERGEAASSIVCYMRESGASEEGAYKHIRRLLNETWKKMNKDKVSQSPFPKPFIEIAINLGRISQCTYQYGDGHGAPDSTVENRIRSLIIEPIAI

SEQ ID NO: 136811 - protein, 70 aa, Glycine max
  Coding DNA Sequence Number=SeqID_45126
  Subcellular localization annotation: CTP_CleavageSite=22; ConfidenceScore=5.13e-01
MNPKAVSLLSPVIKTKKLYSLLAMNPKAVSLLSLVINQEANPLLEMNPKSVNLLSPVFNQEDLLLKNSHQ

SEQ ID NO: 136812 - protein, 144 aa, Glycine max
  Coding DNA Sequence Number=SeqID_45127
RVPHEGSTDGREPLAFPCERFRRAKSQDCTKSPQGVEKPDKEELRGIRNGIIGGYHEWLRVHTRGLDWLSKLKIINEENFEAPEEDEEVQALKSELGKARLAKENFKSAATNIRKECAELREENATTAKALEQETKRARKEEHG

SEQ ID NO: 136813 - protein, 130 aa, Glycine max
  Coding DNA Sequence Number=SeqID_45128
  Subcellular localization annotation: CTP_CleavageSite=44; ConfidenceScore=5.50e-01
MAKPSSAANVASAIIGFWASKKFPHRLKASPGRLPRQNPSPHPSVMVHVHGFFKLPFSHLTILGGVVLAEVLLADSRFTRPDMGFHPTKLNFVPSDADEAPLDVSICLHAFGIVGCGSFSGVKSCEREGA

SEQ ID NO: 136814 - protein, 120 aa, Glycine max
  Coding DNA Sequence Number=SeqID_45129
DAGSRQARQGASAVVAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSP

SEQ ID NO: 136815 - protein, 126 aa, Glycine max
  Coding DNA Sequence Number=SeqID_45130
  Pfam annotation: Domain name=zf-CCHC; Domain location=58-75; Score =19.0; E_value=0.002; Accession=PF00098.14; Description=Zinc knuckle
QQLKKKSTSKSYGSHSYPKKYQGQGILGVIPSKPKDDKGKTIEKQAPKASMQEKTSSIKCFKCLRREHITSQCPTTKTMITRGQDIYSSFIVAKMRLLLHLPLVKVKKQKGKNLVKKSTPKKKDNH

SEQ ID NO: 136816 - protein, 245 aa, Glycine max
  Coding DNA Sequence Number=SeqID_45131
  Gene Ontology: Mol. function=hydrolase activity; Cellular component =outer membrane-bounded periplasmic space; Biological process=cell adhesion
  Homolog annotation: Hit_ID=A5FHD9; Match level="QueryCoverage=98%, HitCoverage=30%, E-value=8e-90, Identity=63%"; Hit description =Putative alpha-1,2-mannosidase precursor
YQYDDPTIVGFSHTHFSGTGHSDLGDIQIMPTQGKIQLNPGTADRPQDGYRSPYSHTNERAEANYYSVLLDKHQIKAELTTTARVGIHRYTFKESDASHLIVDLTAGIYNYDGKNVWTVVKVLNDSTLVGYRQTNGWSRTRTVYFAIKTSKPFKNYGAKYEDGKSVYNGFWRKFDQQNNFPDLAAHNIKLHLDFDTKSQESILLKVALSPVSMKNALANMNVEAPDWNFDGYVKKGQEAWEKGAA

SEQ ID NO: 136817 - protein, 144 aa, Glycine max
  Coding DNA Sequence Number=SeqID_45132
  Gene Ontology: Mol. function=aspartic-type endopeptidase activity; Biological process=DNA integration
  Homolog annotation: Hit_ID=Q10LP7; Match level="QueryCoverage=61%, HitCoverage=8%, E-value=2e-08, Identity=34%"; Hit description =Retrotransposon protein, putative, Ty1-copia subclass
MAEEDALSLDNIEGGVCIEYTDAGVYGRRNSGSNKEAFEMGERRLNLSWTHSERLVMEQYNELLRILGQFTQHDLKMDESIAVSSIIDKLPSSWKDFKHTLKHKKEELTLVQLGSHFMIEESLRAQEIDKVNDKNVYSSSAVNM

SEQ ID NO: 136818 - protein, 212 aa, Glycine max
  Coding DNA Sequence Number=SeqID_45133
MHVAHGGVGAEPTGLRHQFATQFGRAIDGDAGRSQAGVAPLVDLHLRHIEPGGAEVQADLLAQGAQFIARADDRQARRAAAAAHGGGTIDAGAAQEQVEETHSDLHCVMGAAFAHTRAREAHGARRTGTERRARALTLRLAAVLAVYVGKNPRKPWACAAARHETRGGGYNRNLFNRLRQTEFCVDLSNSGVDARSTTFAGIGIHEDCSWDG

SEQ ID NO: 136819 - protein, 344 aa, Glycine max
  Coding DNA Sequence Number=SeqID_45134
MVVVYVWVAMGWLDGLTLLHRHAARDQLAAFVRHQRVVLGADADIPVGLGHVVGRAHIDAGLDRQHHAGLQRAPRAFGAGRRARLAVVAHVVHVQPQPMAGAVHVEAAVVARLDHPVQRTLEQFQVQHALRQHADGGFVAVVPAAAGRGGLRRRFLGRHRQVVQGALRAAVAAVDRKGAGDVAGIAIDLAAGVDQHQVAVAQHRFAGGVVQHAGIGAGRHDAVVGHRLGAMPAELVQQFRFQFVFAHAGARGPHGARMGAGGDLGGPPHRGDFAGVLDQPHLGQDWPDVLLARGRLVAAAAGFARGRQPAVHAAVAALVARQRRIQGRLVLQQLRHQFVQSVQR

SEQ ID NO: 136820 - protein, 85 aa, Glycine max
  Coding DNA Sequence Number=SeqID_45135
  Subcellular localization annotation: CTP_CleavageSite=39; ConfidenceScore=5.19e-01
MTHQDFQVQAIGLFAQATCAPEFGLPRSFNQRLLVLHVGGGSVKQRGQPFPCVQESPTTRDPRSLNPFSEIRKREEEISLKRDGL

SEQ ID NO: 136821 - protein, 287 aa, Glycine max
  Coding DNA Sequence Number=SeqID_45136
  Gene Ontology: Mol. function=hydrogen ion transporting ATP synthase activity, rotational mechanism; Cellular component=proton -transporting ATP synthase complex, catalytic core F(1); Biological process=plasma membrane ...
  Gene Ontology: Biological process=ATP synthesis coupled proton transport
  Homolog annotation: Hit_ID=Q7HDI4; Match level="QueryCoverage=100%, HitCoverage=64%, E-value=1e-148, Identity=87%"; Hit description=ATP synthase subunit beta
  Pfam annotation: Domain name=ATP-synt_ab; Domain location=79-287; Score=283.7; E_value=3.7e-82; Accession=PF00006.16; Description=ATP synthase alphabeta family, nucleotide-binding domain
  Pfam annotation: Domain name=ATP-synt_ab_N; Domain location=1-56; Score=44.4; E_value=4.1e-10; Accession=PF02874.14; Description=ATP synthase alphabeta family, beta-barrel domain
  Pfam module annotation: Pfam domain module=ATP-synt_ab::ATP-synt_ab _N; Domain location=79-287::1-56
MPNIYNALIVKGRDTVGQQINVTCEVQQLLGNNRIRAVAMSATEGLMRGMEVIDTGAALSVQSAPAFIQLDTKLAIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAK

SEQ ID NO: 136822 - protein, 174 aa, Glycine max
  Coding DNA Sequence Number=SeqID_45137
MEADMEAMKEQMAAMMSVKKIMEANAVAIAATSVVAKMNLRSPSGINQMNHPTSDMVGKDLGSTGGPHDVQIQNEHAFPPYGLPLNYTPPNVAYTPNKNTHEIPHHNLADFEPWLGYATEGQAVGGIPLENTSEGPQYHPQLHLLHSTTSKNPCAMAEMEELGSFRGRLRAIEE

SEQ ID NO: 136823 - protein, 175 aa, Glycine max
  Coding DNA Sequence Number=SeqID_45138
  Gene Ontology: Mol. function=transferase activity, transferring glycosyl groups; Biological process=metabolic process
  Homolog annotation: Hit_ID=Q2HT79; Match level="QueryCoverage=44%, HitCoverage=16%, E-value=3e-24, Identity=70%"; Hit description=UDP -glucuronosyl/UDP-glucosyltransferase
PTNCRYICKEWEIGIEIDTYVKREEVEKLDNDFMAGEKGNKIRQKIVELKKKAEEATTPSGCSFMNLDKFIKEEPIKATEKSHPFSVLQQQQGMHSQLGMSSSGSQGLHMLQSEATNVGGNATIGIGGGFPDFVHIGSGKQDIGISSEGRGGNSSGHSGDGGETLNYLKAAGDGN

SEQ ID NO: 136824 - protein, 102 aa, Glycine max
  Coding DNA Sequence Number=SeqID_45139
  Subcellular localization annotation: CTP_CleavageSite=18; ConfidenceScore=5.16e-01
MVLDFQQTLSTITKYALTQQSKQNVCTKHMTTETTKTNVRPSSHRNEITYKYESGDPTVMWLRMPPDSWVTVTKGGVVDKSRAFAPTYPQFVMRNSDLRSSG

SEQ ID NO: 136825 - protein, 116 aa, Glycine max
  Coding DNA Sequence Number=SeqID_45140
LGRIDGDPVLRETRIWATWEYVSSVGGGQPGMSGTLRYVAGVRRPWGRQVGRAPDNQQIKGTKTTKQGGLCWLASCEFCVIYGLWPLVIDYQGLENEASGNRLLACVIDYTEGWVT

SEQ ID NO: 136826 - protein, 51 aa, Glycine max
  Coding DNA Sequence Number=SeqID_45141
MVGPSGPRVSTKESCVDPSGNDPETVKVGVEEVKDAQAPVPVPPDEVTLVG

SEQ ID NO: 136827 - protein, 17 aa, Glycine max
  Coding DNA Sequence Number=SeqID_45142
MEEPRGIPDAILSRKGI

SEQ ID NO: 136828 - protein, 208 aa, Glycine max
  Coding DNA Sequence Number=SeqID_45143
  Homolog annotation: Hit_ID=Q652R5; Match level="QueryCoverage=44%, HitCoverage=35%, E-value=2e-24, Identity=66%"; Hit description =Putative uncharacterized protein P0603C10.50
MCKCRSHGTFPLFGLQSSHLNICYYHQDLHRRPLRPGSRPGFCSDRRALPTHRGLVLAPTAGTRPAGSSYPEGNFGGNQLLDGSISLSPLYPKSDERFARQYRCGPPPEFPLASPRSGIVHHLSGPDRYALTRTLHRRSGSVGGATHRGIPPISFLAPYGFTRPLTRTHVRLLGPCFKTGRMGSPQADARSAQVPRHAKGARCHPQSR

SEQ ID NO: 136829 - protein, 55 aa, Glycine max
  Coding DNA Sequence Number=SeqID_45144
VHPYEKARDRLIERAGHPKWARFGHLDGVGKHRLTVLLKESLDHFGVTAMESFDV

SEQ ID NO: 136830 - protein, 99 aa, Glycine max
  Coding DNA Sequence Number=SeqID_45145
MIMRGQETEKAKGEESSEEIYPQEEGQPLVVKEKCKEVSVSSKRLAKKETHFTIKTNIKETFPLRQPPYFLFCKKTLASIATPLGLEFIPQVKKLLDEG

SEQ ID NO: 136831 - protein, 53 aa, Glycine max
  Coding DNA Sequence Number=SeqID_45146
MLGKLGRIDGDPVLRETRIWATWEYVSSVGGGQQGMVDMFLVEIGIVGARYAG

SEQ ID NO: 136832 - protein, 228 aa, Glycine max
  Coding DNA Sequence Number=SeqID_45147
MRGQDIYNSQDEATTSPSSSESEEAKGEESSKEIYPQEEGQPLMVKEECKEVSVSSKRLAKKQRHFEIKTNIKKISPLRQPPHFLLCKKTLVSIATPLRLEFIPQVKELLDEGLVRKSLNPCALLVPKIGIIRHQIPMIGGMMNVLSGATLFCKITHAPNIFMICVHRDSLGRNNQHENKEKGMFYSITFLNFLNSDQGLPMDPKRIKVILEWPTPACLREIWGFNDF

SEQ ID NO: 136833 - protein, 82 aa, Glycine max
  Coding DNA Sequence Number=SeqID_45148
MEVEEWKVVTFVAKAEAHNVAPCRACMPWIFFITRVLRFLKINGSRKEKEEREMKYRQVHGVIKYLKLKQSDLSIKLKELAY

SEQ ID NO: 136834 - protein, 105 aa, Glycine max
  Coding DNA Sequence Number=SeqID_45149
LGHPDFEPPPHLSDGKTRESERATTSLDKESERSAASLVGDSGGVAASPDGESKMIIKGGDGGTTLKAGVAAHDVQRYVKESDWAAQCTRQDKMSNEELKLQDPR

SEQ ID NO: 136835 - protein, 85 aa, Glycine max
  Coding DNA Sequence Number=SeqID_45150
MKMLLIPHDVSSLRACLPRIFFINGFLCFLEDEWQRNGERKRERRCHFKEKMSLEEAHHHSRPLIQDQFQDSPLSVLRCHETCKA

SEQ ID NO: 136836 - protein, 95 aa, Glycine max
  Coding DNA Sequence Number=SeqID_45151
PGDGHSLSVSGCREQTSPSGRVSGCWRVSGLAELCGIRADCTESAPYAAPFAIQAAQLLGRAIGAGLFAITPAGERGMCCKAIKLGNARVFPVTT

SEQ ID NO: 136837 - protein, 145 aa, Glycine max
  Coding DNA Sequence Number=SeqID_45152
MAPEELKQLTQQIRDQQEESITEKIQSQGLALPPELEVGASAARVNTKGSCVDPSMTDPDGDSDKCGLYIKENPLRLVALGRVYEGSTMEHNIPLLLGQVKVGDEEVKDVEAPVPVPIDEVILVGQTLNTSLAWPTHLAKRLSDQ

SEQ ID NO: 136838 - protein, 121 aa, Glycine max
  Coding DNA Sequence Number=SeqID_45153
MIDVYADTLSMEFSDIVVHFNILDAMKHPSEDHSIFRVEIIDQIVDDYMFDFDSILHESKCTHHVAGSTYTFDLLYEVQAEEPSSSPTLVPPTVQPPPTSELKPLPASLKCAYLEDKEKFP

SEQ ID NO: 136839 - protein, 175 aa, Glycine max
  Coding DNA Sequence Number=SeqID_45154
MSKSGGFGMTGPLDESISCFLIRVEPWVLVPITFRGLHVLALRGLHVLAIRGLHVLAIKGLHVLAIRGLHALTSRGLPVLALRGLHALTLGLHALTFRGLHVLALRGLHALTLGLHVLAIRGLHALTSRGLPVLALRGLHALTLGLHVLTIRGLHALTSRGLHVLALRGLHALTL

SEQ ID NO: 136840 - protein, 101 aa, Glycine max
  Coding DNA Sequence Number=SeqID_45155
  Homolog annotation: Hit_ID=A5AEB7; Match level="QueryCoverage=53%, HitCoverage=4%, E-value=5e-15, Identity=74%"; Hit description =Putative uncharacterized protein
MGRTKQLSLKLSRRGMVKYHLKLILRRWQSVSFARRIAPDSRNGLRRKGMQNLRKPVGIEQSILSGNKLGSHVEAIGTFISTLSSDFILKLERTFYVPSFS

SEQ ID NO: 136841 - protein, 140 aa, Glycine max
  Coding DNA Sequence Number=SeqID_45156
  Homolog annotation: Hit_ID=A6FJQ2; Match level="QueryCoverage=27%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFQLPSEKELVALDPANKPPLVAVSRPAGMQAWHWPSFYNVVTGKTLALPT

SEQ ID NO: 136842 - protein, 273 aa, Glycine max
  Coding DNA Sequence Number=SeqID_45157
  Homolog annotation: Hit_ID=UPI00016621D1; Match level="QueryCoverage =82%, HitCoverage=41%, E-value=2e-12, Identity=28%"; Hit description =UPI00016621D1 related cluster
MIDPLNESISCFLIRVDLWVLEPIAFRGPSVLAIRGLHALNFRGLHDYTSSPSEGCTPSLHRTTRPHFIGLHVLAFRGLDVLTLRGLHVLAIRGLHALTFRGLHVLVFGGLLVLTLRGLHVLAFIGLHVLAIKGPHVLAIRGLHVLANRGLHALTFRGLYILAFRGLHILAIRGLHVLAIRGLHALAFRGLHILTFIGLHALTFRELDFLAFRGLDVLTFRGLDVLAFRGLHALAFIGLRVLAFIGLHALTFRGLHILTFRGLRVLAFVGGIL

SEQ ID NO: 136843 - protein, 172 aa, Glycine max
  Coding DNA Sequence Number=SeqID_45158
  Homolog annotation: Hit_ID=Q6WAY4; Match level="QueryCoverage=88%, HitCoverage=27%, E-value=9e-17, Identity=34%"; Hit description =Putative uncharacterized protein
MGTNQIGKRFYQVKIKGLDITSIKELGRLMGPLQMQAFHKVCGKILDLTIAEISTEAIASLTQYYDQPLRCFTFGDFQLVLTIEEFEEILGCPLGGRKPYLFSRFLPSLSKIAVVVRDSARGLDRVKQTRNDIVGLPRKYLEGKARDMANQEEWVPFMDVLALLIFGVVLFQ

SEQ ID NO: 136844 - protein, 49 aa, Glycine max
  Coding DNA Sequence Number=SeqID_45159
MVNKPSEFNIHRKVERNWKGGLMPSLEEFESRSKGPTTLRAIGLRSTPN

SEQ ID NO: 136845 - protein, 297 aa, Glycine max
  Coding DNA Sequence Number=SeqID_45160
  Homolog annotation: Hit_ID=Q2HW90; Match level="QueryCoverage=91%, HitCoverage=61%, E-value=2e-27, Identity=30%"; Hit description =Putative uncharacterized protein
MGTNQNGKRFYQVKVKGLDVTSLKELGRLMGPLQRQAFRKVYGKILDLTVAEVFTEVVVSLAQYYDQPLSCDWRFSKRVGLHEANSERRSGLPRKYLEGKARDMASQEKWGPFADILALLIFGVVLFPNVDGLVDLAAIDAFLAYHHCKESPVVAILADLFDTFDRRCEKNSARIVCCLPALFVWLVSHLFRQDTRHPCPLQSYRSCAEKGRVDWDQHLAGIGGNAINWFPRWKEGKEGVLFSCGDYPNVPLIGTRGCINYNPALAIRQLGYPMRGAPTEESLSPFLVRDLGAQSLK

SEQ ID NO: 136846 - protein, 16 aa, Glycine max
  Coding DNA Sequence Number=SeqID_45161
MKLRYHLFGFFKDLHS

SEQ ID NO: 136847 - protein, 51 aa, Glycine max
  Coding DNA Sequence Number=SeqID_45162
MLQDEQIYNSCTRLTKSVEGFAACYGEVVSTIGVGGSGVASGDFSGVVAAS

SEQ ID NO: 136848 - protein, 30 aa, Glycine max
  Coding DNA Sequence Number=SeqID_45163
MEVPATIVPPIARNKLAITRAKKRKVAEYE

SEQ ID NO: 136849 - protein, 79 aa, Glycine max
  Coding DNA Sequence Number=SeqID_45164
HPRDDHIQTLPQLDTKDLRMKVDSNFEAAWLAVNDARRTAVCKILWKPNSQRKRLSMDGGHTHEISHGVVFGPTIKDKL

SEQ ID NO: 136850 - protein, 56 aa, Glycine max
  Coding DNA Sequence Number=SeqID_45165
  Homolog annotation: Hit_ID=Q1SKV6; Match level="QueryCoverage=75%, HitCoverage=7%, E-value=3e-08, Identity=57%"; Hit description=RNA -directed DNA polymerase
GGDMDNHKIAWVSWEPACLSKEKGGLGIRDLTKFNQALLGMWKGDLFHPMLLMTDG

SEQ ID NO: 136851 - protein, 100 aa, Glycine max
  Coding DNA Sequence Number=SeqID_45166
MSIRSFGSIAPITSIPHIENDQGAAKTFKGMGGALALSTKAWHLWHFLTWMQQSFSIVSQIFPLRKKSAANLSNVLLSLSEASCGLAMTSKFDCMGNPRA

SEQ ID NO: 136852 - protein, 265 aa, Glycine max
  Coding DNA Sequence Number=SeqID_45167
  Pfam annotation: Domain name=Peptidase_C48; Domain location=77-255; Score=-35.5; E_value=0.094; Accession=PF02902.10; Description=Ulp1 protease family, C-terminal catalytic domain
MVTYEAEKDVSSPLKTVEEEKAAEVIDPLGELVKNLFDIYQRPVEVSWDGAKFGINNVKDGFFITHADVSEIILGDKCLNISILQLWLMFIHDWSASIGYGPLYGFLEPQCIHNASSRRQECENYIGRWLKEAGKQIYIAPYLNQAHWQLVVLCPGDNVVVWFCSLKKKPDAAIKGAVNRGKSHLSMGLSGLKQKSHVQIGNYECGYYVMQWIWCIVSGGLKDDWIHWFSDRSPLTEETMTTLRHKWAAYFIQMKKCEPRKNLIT

SEQ ID NO: 136853 - protein, 163 aa, Glycine max
  Coding DNA Sequence Number=SeqID_45168
  Gene Ontology: Mol. function=endonuclease activity; Biological process=DNA modification
  Homolog annotation: Hit_ID=A4N103; Match level="QueryCoverage=79%, HitCoverage=33%, E-value=4e-43, Identity=64%"; Hit description =Putative uncharacterized protein
MVVSGLSVTSESVVTSESPDEGETQNRPDPLAPIVDPENSKIVTTFAERCLFDNVAMILGTEAELVAKDTESYYSILFQGKTTRWILRYFDNKQRPTILLPLEIDDARQAEITRAGLELAAGGHIIIDRPENILRLTGLIVDSYQYCINDENFRQKRKDKQES

SEQ ID NO: 136854 - protein, 135 aa, Glycine max
  Coding DNA Sequence Number=SeqID_45169
MGRSGFVKPAETPATRGGRRMRSSSILAVMEDCCWVRRRRASSSLSEGFEEFDINESTNLLEGKNKDADFEGSNLQLKGKKRITKGKCVSNSAPATRNPLGVEEKSPEFQEPRDLRSNPFQGGGNDAILPRKGIG

SEQ ID NO: 136855 - protein, 82 aa, Glycine max
  Coding DNA Sequence Number=SeqID_45170
MMQSYPARALDRRLQVDWARDPREGPRVLMSLRSLCRNLPFGERVTRDSRVRVPRKEYGRSRHQRLFEENVGKTGKDVIYEL

SEQ ID NO: 136856 - protein, 136 aa, Glycine max
  Coding DNA Sequence Number=SeqID_45171
NGTHKDTQWTRRSPTGPWGFQFWLRASVVLQGARSPRQGHVIIGIAPARHPVDPKKSNRVLELSSSNYGSPVSSTEYLLPPARASGPLLIELLSRSTASAGRRKGETPQQPEDGRQRGNRRTAITSRVHLSSSTKR

SEQ ID NO: 136857 - protein, 87 aa, Glycine max
  Coding DNA Sequence Number=SeqID_45172
MAYSLVDGTSLSPLLLCLPLHLHGGKSPLKDLIESQRSSLHRSSTSKLPSSGIRAQELQVEFEPIKLAIEVRFDFLWFKFLVLVLEP

SEQ ID NO: 136858 - protein, 154 aa, Glycine max
  Coding DNA Sequence Number=SeqID_45173
MRGVPTEESMSPLLVRDLGAQNFKAIQRIHKAWETPLSKDQELRGIRNGIIAPEEDEEVQALKSELGKAKLAKEKFKLAATHIRKECAGLQEENAITARALEQETKRARKEEYGRNKFRGALWGSNSELKLRREERDQSRAHSMVLKEELVACS

SEQ ID NO: 136859 - protein, 82 aa, Glycine max
  Coding DNA Sequence Number=SeqID_45174
MLVRMIHTCLFAVAWVKPCPGMHNSCTIASLWLCSHSWPSFEIKGTLNSLKVWIWSPMKVRTRSPQKARESATLRRRGRVAL

SEQ ID NO: 136860 - protein, 83 aa, Glycine max
  Coding DNA Sequence Number=SeqID_45175
  Homolog annotation: Hit_ID=A7QFF8; Match level="QueryCoverage=33%, HitCoverage=31%, E-value=6e-08, Identity=96%"; Hit description =Chromosome chr8 scaffold_88, whole genome shotgun sequence
MGAGHARSRYLNRKEGDAEGRASDWSEVVTRSEQVDRSYFFHPHPCRHTGATWDGGEKRKERDGVSLAFGIAGPGGRPATTGY

SEQ ID NO: 136861 - protein, 145 aa, Glycine max
  Coding DNA Sequence Number=SeqID_45176
METILQNPQLNSAEFYVITDLIPQPQPSSPQPSCPQLQLSPPKQLPYNNIDLNNPVSSYNNLESQDPFDIYTSYTQILSENDSFFHGQLSQRALRGRARARLTGALSKGGKMRGVATNVYLWKTSGKPKETGQNENSKFGSCIYA

SEQ ID NO: 136862 - protein, 98 aa, Glycine max
  Coding DNA Sequence Number=SeqID_45177
MYGRGKMSLGLARFSCDKVAGLFIRETSLLPFGYLRFKLADERLPNIPAFRGGPYWNSKVRKRKFQLATIKVASCFPAPVQRFTQAPKLAFSIVNLES

SEQ ID NO: 136863 - protein, 40 aa, Glycine max
  Coding DNA Sequence Number=SeqID_45178
MATLCKSRRRKSRHFQKDCLKCKSWFEKNGELNAHRFLTI

SEQ ID NO: 136864 - protein, 163 aa, Glycine max
  Coding DNA Sequence Number=SeqID_45179
MTRTRGLGRVIGRLVGGDRHDDHDVADVPERRMPIVSARRQRVHQMTADTRDLAEDVADMADDVPDLAKEAPEMRADIDGADGAEGSDADDAEGFPGGPRDPWCHMGRKVTLIGRPVPEIKDLVDATGIKSTDRFFSCYWRSWTDIRICGEVTRSRLAPSTFR

SEQ ID NO: 136865 - protein, 303 aa, Glycine max
  Coding DNA Sequence Number=SeqID_45180
  Homolog annotation: Hit_ID=Q6WAY4; Match level="QueryCoverage=73%, HitCoverage=41%, E-value=4e-14, Identity=28%"; Hit description =Putative uncharacterized protein
SHLFRQEGRHACPLESLRSCTEKGRADWDQLLASIEGAYVNWFLRWKEGRTGVLISCGGFPNVPLMGTRGCISYNLILAIRQLGVTMVIAPLEEEIVPVISRGFNKTNVETLQKVRMAWEVLQKKDKELRGSNNGPIGGYREWLKAHVQGLDWLPSLRTTKREEDEAPEEDEEVQALRTELKQAQTVKERFKSAALKIRKENAELRDVNMATTKALEQETKRARREEHGRNKFRGALWSSNNELKLRKEERDQSRVDGLILNDELKACSRSKRSLSQRLCKTETNMLAIIAKYQEELSLSHNP

SEQ ID NO: 136866 - protein, 141 aa, Glycine max
  Coding DNA Sequence Number=SeqID_45181
MNLIIVIKKKGHALWRPYRTRARARVMGEAEEVQEKMKADMEAMKEQMATMMEAMMSMKKIMEANAVIVAATSAVAKVNPMLPSGLKQMNHPTSNMVGKDLGSTDPPMMCKIKMSTPSHHMACLPTIHHPMWHTLSNEKSQ

SEQ ID NO: 136867 - protein, 117 aa, Glycine max
  Coding DNA Sequence Number=SeqID_45182
  Subcellular localization annotation: CTP_CleavageSite=40; ConfidenceScore=5.25e-01
MAQAAVKLPRYPPICTTSPELFGSRRGLFRLNACPTKGARAPTERGPSDFGSNPASPGQQCPPWRRLQHGEELFAKAGSRFHPDPNDVWGLLAISHRQQIGCGDSGKDLLVSVLEVV

SEQ ID NO: 136868 - protein, 59 aa, Glycine max
  Coding DNA Sequence Number=SeqID_45183
MIDLIQRKLLQPRYAHCYINMKAARVLYQCLVSHLDVTLTSSVGPECVELISIVQRAIS

SEQ ID NO: 136869 - protein, 121 aa, Glycine max
  Coding DNA Sequence Number=SeqID_45184
VQQDFGFVQKNACVWLAVERVVQNEFWMFAKFSAFCPVFLAVLGRIDGDPVLRETRIWATWEYVSSVGGGQQRMGETSCFYSLTTEWYLEICRGGQETLGTSGGVLLPKTKLDQSRPNPGI

SEQ ID NO: 136870 - protein, 26 aa, Glycine max
  Coding DNA Sequence Number=SeqID_45185
MNKKVKWWLHRNIEMAITEATGLQMR

SEQ ID NO: 136871 - protein, 99 aa, Glycine max
  Coding DNA Sequence Number=SeqID_45186
MKKDCHHQKGGDCGSNDFQDYFDDAKESRAKQVSNNQESKSFKNQVSKNQDSRIIKFQDSRFKKNQVSRINIQEQSRSRFKTQNSRIKISTKKAFQNIE

SEQ ID NO: 136872 - protein, 113 aa, Glycine max
  Coding DNA Sequence Number=SeqID_45187
  Homolog annotation: Hit_ID=Q84VI1; Match level="QueryCoverage=53%, HitCoverage=8%, E-value=7e-27, Identity=95%"; Hit description =Envelope-like protein
MVDIDVSEDQIAKEITAKRVQHWPKKGKLSAGKLSVKYAILHRIGAANWVPTNHTSTVATGDTCPRHCLDIRESCCFRCCVQGCLDCRTQGHMQGAGSNHQSQHREEDGSWNG

SEQ ID NO: 136873 - protein, 99 aa, Glycine max
  Coding DNA Sequence Number=SeqID_45188
MYFTSLEESSWAMHCPILCASLQMWHPPICMAEDSIGACRPRIFFINGFLCFLEDEWQRNGERKRERRRHFKEKMSLEEAHHHRRPWIRAWRKKEMNKG

SEQ ID NO: 136874 - protein, 54 aa, Glycine max
  Coding DNA Sequence Number=SeqID_45189
MSPMESPTVISYPLAGGRREGSRVRLPWEENARSRHQRLFEENIKKLKRVVYEL

SEQ ID NO: 136875 - protein, 191 aa, Glycine max
  Coding DNA Sequence Number=SeqID_45190
MGDQEETQEQMKADMSALKEQMASMMEAMLGMRQLMEKNVATAAAVSSAAEADPTLLATVHHPPSNAVGREMSTLGHNSNRHLGYNRVAYPYGLPPNYTLPVMHDDAGHVSSPILEGEPPRQPGEVHEDHREYAQGDVDFYPPIPVEGPAPNTFPQPNLTAQPIFLSTEGPPPAAPRTKETRSPRGEIESY

SEQ ID NO: 136876 - protein, 51 aa, Glycine max
  Coding DNA Sequence Number=SeqID_45191
MDPKRIKVIPEWPTPPSVEQRINEFQEPRDLSSNPFQGGGNDAILPHKGIG

SEQ ID NO: 136877 - protein, 46 aa, Glycine max
  Coding DNA Sequence Number=SeqID_45192
MKGNQQRVPSGVANCRNLPFGGRATRDSRDACSTKGIRAESPPTFI

SEQ ID NO: 136878 - protein, 100 aa, Glycine max
  Coding DNA Sequence Number=SeqID_45193
MMAHQRPRTRLVVSFKNKERETRLKRAIKGINSREREESKEFSDCVILNSLTRDKGDTKEFRWLVLCSFGKGRRETQKEFRRLVLGEFFLAKGEGNEKDE

SEQ ID NO: 136879 - protein, 87 aa, Glycine max
  Coding DNA Sequence Number=SeqID_45194
MLRNLMDYVIIPFLPSGTLRNFTDWALTLPFNFRHVTELHGLCYNTFLLASGMSRNFTNCLMMGAKYLKVIKRGSHPNNGWSPDVIR

SEQ ID NO: 136880 - protein, 59 aa, Glycine max
  Coding DNA Sequence Number=SeqID_45195
MAKEGFHQLQCFKDSLTFQILKARLARVSDFWLSELGVLSARRDKQLVGRAGGTLGACI

SEQ ID NO: 136881 - protein, 58 aa, Glycine max
  Coding DNA Sequence Number=SeqID_45196
MSGKAIREILVRLLDDLAEQQGGGEAKAKENETRDVAEDQGGGEKAVRRRKVFGLDNI

SEQ ID NO: 136882 - protein, 137 aa, Glycine max
  Coding DNA Sequence Number=SeqID_45197
MLGKLGRIDRGPGVERNEDMGYVGVRELSWRWAIGDGGFMLALWMWKTCCAPSPDRHLVPHVMEWYLEICRGGQETLGTSGGVLLPKTKLDQSRPNPGIVRLENEVKKLRELLVIDYQGCNRLPGLKRELGDGGGLW

SEQ ID NO: 136883 - protein, 257 aa, Glycine max
  Coding DNA Sequence Number=SeqID_45198
  Homolog annotation: Hit_ID=Q2HW90; Match level="QueryCoverage=92%, HitCoverage=50%, E-value=1e-21, Identity=29%"; Hit description =Putative uncharacterized protein
MVEVSTKAIASLAQYYDQPLRCFTFGDFQLSPMVEEFEEILGCPLGGRKSYLFSGFYPSLARISKIVQISAQELDHRKQVKNWMVGIPRNIWRQSKILAGVLFPNVDGLVDLATIDAFLAYDNHKESPVVTMLADLYDTFDRRCEKSSTRIVCCTPALYVWLVSHLFRQEVRHACPLESHRSCTEKGGPNWDQLLASKKGVSVNWFPRWKEGRTGVLISCGGFPNVPLMGTRGRPQLQSRSCYKTTWLPYERGATRG

SEQ ID NO: 136884 - protein, 76 aa, Glycine max
  Coding DNA Sequence Number=SeqID_45199
MEIYVVFRADYICQALTREVRGQADIPQVVIRINIILLSHAKTNVVFCTISQPEASEPIDTWRFTSSSVQTTFVKH

SEQ ID NO: 136885 - protein, 158 aa, Glycine max
  Coding DNA Sequence Number=SeqID_45200
  Homolog annotation: Hit_ID=UPI00006A2D9E; Match level="QueryCoverage =89%, HitCoverage=85%, E-value=3e-11, Identity=14%"; Hit description =UPI00006A2D9E related cluster
GLHVLAFRGLHALAFRGLHDLAFKGLHALPFRGLHVLAFKGLHVLAFKGLHALTFRGLHVLIFRGLHGRTFKGILALAFRGLHVLAFRGVHVLPYRGLQVLAIRWLHILTFRGLHVLTFRGLHALAFRGLHVLPFRGLHVLALRTTRPRLQRTTHPQL

SEQ ID NO: 136886 - protein, 251 aa, Glycine max
  Coding DNA Sequence Number=SeqID_45201
  Gene Ontology: Mol. function=chloramphenicol O-acetyltransferase activity; Biological process=response to antibiotic
  Homolog annotation: Hit_ID=P62577; Match level="QueryCoverage=86%, HitCoverage=99%, E-value=1e-130, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGRNFFKAVIVPRIFYLINKMIFLRSFWSARNLLL

SEQ ID NO: 136887 - protein, 117 aa, Glycine max
  Coding DNA Sequence Number=SeqID_45202
MAIQGDDSEVGKKMEERKQQLAPKPTLEPVSDLVELEEINKETEDDKEEKTPIKVEEKERIKEEKKKKKKNMLTKKNQYIHSDRIVVEGNCSVVIQRILPPKHKDPGVVTIPLVRLL

SEQ ID NO: 136888 - protein, 93 aa, Glycine max
  Coding DNA Sequence Number=SeqID_45203
MTTLTQIWMTLLLSNIPPDDHNADLPPAEVLVGIAPTRHPVDPKKSNRALGFPALVTDLCHSYRVPIPPTRDRAHKTPSGPEEVQQGPGVSSS

SEQ ID NO: 136889 - protein, 147 aa, Glycine max
  Coding DNA Sequence Number=SeqID_45204
MHRSPTGNLVPLDLEIEATLRRNRVERRMKLLQDRTVASILEEETHFSDLLSPDSPSSRESATQLPEAITMAIKHDQRIALEDYSSSSVPQFFTSIARPEVQANNINYPHSLIHLIQGNLFQGLPNEDTYAHLATFIEICNTVKIAS

SEQ ID NO: 136890 - protein, 62 aa, Glycine max
  Coding DNA Sequence Number=SeqID_45205
GLVRARALSARMDRLAHVSDFWLNALLSLSGWVEAVRLMTWSSALNEPDNSSSSGFFLALSH

SEQ ID NO: 136891 - protein, 268 aa, Glycine max
  Coding DNA Sequence Number=SeqID_45206
  Homolog annotation: Hit_ID=Q6WAY6; Match level="QueryCoverage=56%, HitCoverage=31%, E-value=3e-20, Identity=34%"; Hit description =Putative uncharacterized protein
KIAAVVGDLARELDHMKQTRNGVVGLPRKYLEGKARDMASQEKWVPFADILALLIFEVVLFPNVDGLVDLAAIDAFLAYHHSKESPVVAILADLFDTFDRRVDWDQHLAGIGGSTINWFPRWKEGKEGVLFSCGDYPNIPLMGTRGCINYNPALAIRQLGYPMRGAPTEESLSCLSLVHTRGLDWLSKLKVIDEENFEALEEDEEVQALKLELGKARLAKEKFRSAATNIRKECAELREENAANARVLEQETKRARKEEHGRDKFRGA

SEQ ID NO: 136892 - protein, 167 aa, Glycine max
  Coding DNA Sequence Number=SeqID_45207
MGEVEEVQEQIKTDMEAMKEQMATMMEAMMSIKKILEVNAAAIAATSTIVEVDLTPPYGLNQINHPTPYMVGLEGKELGGTGDPHLVRKTSMPSRHMACLPIIHHPMWRTLPMRMSITPLRYSLRANNLNLIMHMSLNPWGRHMKFPATIYPTSSLASDMPLKGKQL

SEQ ID NO: 136893 - protein, 267 aa, Glycine max
  Coding DNA Sequence Number=SeqID_45208
  Gene Ontology: Mol. function=transcription factor activity; Cellular component=nucleus; Biological process=regulation of transcription, DNA-dependent
  Homolog annotation: Hit_ID=A1FVA8; Match level="QueryCoverage=37%, HitCoverage=83%, E-value=5e-51, Identity=98%"; Hit description =Transcriptional regulator, MerR family
  Pfam annotation: Domain name=Bac_DNA_binding; Domain location=3-69; Score=9.4; E_value=1.3e-05; Accession=PF00216.12; Description =Bacterial DNA-binding protein
  Pfam annotation: Domain name=MerR; Domain location=60-97; Score=38.4; E_value=2.5e-08; Accession=PF00376.14; Description=MerR family regulatory protein
  Pfam module annotation: Pfam domain module=Bac_DNA_binding::MerR; Domain location=3-69::60-97
MALTKAEMAEKLFDEVGLNKREAKEFVDAFFDVLREALEQGRQVKLNRELPPIPAKRYFTIGEVSELCDVKPHVLRYWETEFPSLEPAKRRGNRRYYQRHDVLMVRQIRSLLYEQGYTIGGARLRLDGPDAREESALSNQIIKQLAATAPCDRVSQQCGTNAVAAAFARHHQHLDEGLAEEVVMHDQVADDPAVLLGDIHAAVCQPVANLHDPLWINGCHAVERDQGIRVLGAAVTQARRTPTSGSSRAEPPAATDRHPIQNRRAGR

SEQ ID NO: 136894 - protein, 54 aa, Glycine max
  Coding DNA Sequence Number=SeqID_45209
MVEMAVGSYLECHRLLGCRGPTPSRGRRLVSWSGHLCIKLLHAYNVLDKWPQIS

SEQ ID NO: 136895 - protein, 39 aa, Glycine max
  Coding DNA Sequence Number=SeqID_45210
MENCRTTLGNDIRGAPDSKAIMKYSSKLEGGGHMNSARQ

SEQ ID NO: 136896 - protein, 104 aa, Glycine max
  Coding DNA Sequence Number=SeqID_45211
LGRIDGDPVLREMRIWATWEYVSSVGDEEVLKGELPAFIVDYRVVPGDMSRGSGDLGDVRRAPGSQQIKGKQDHKARRLVVADQLLENEVRKLGKPLVIDYQGV

SEQ ID NO: 136897 - protein, 135 aa, Glycine max
  Coding DNA Sequence Number=SeqID_45212
  Homolog annotation: Hit_ID=A5C7Z4; Match level="QueryCoverage=85%, HitCoverage=41%, E-value=3e-09, Identity=31%"; Hit description =Putative uncharacterized protein
MYNSIITYIGLHCGAHWQMVVILPKENIVIWFCSLHNRPDNYLKGIINSALKRLDDTPQSKSKASARWIVVKSNRQKGNTECGYYMMHWKSTIILGSFRNNWKTYFNDVRPLEVERLKALRIQWAKYYLKVKNET

SEQ ID NO: 136898 - protein, 42 aa, Glycine max
  Coding DNA Sequence Number=SeqID_45213
MLMRCMISMHLRTREPEKSSLLTCAFGGVATYPFADERGEAH

SEQ ID NO: 136899 - protein, 159 aa, Glycine max
  Coding DNA Sequence Number=SeqID_45214
RNWHKKIANLVEGSIDVALVREFYANVYDPKDKSPKQVKEGESLPAYARFVLLRPNQQELEKMDMNHGSFISSQITLIAQHDSSRLGFPALIIALCKAQHYDSLTHERLSPTINLAYIKKNCWNLDDPTVTFRGPRKARGKRSEAPSTTPSEAPALWRP

SEQ ID NO: 136900 - protein, 66 aa, Glycine max
  Coding DNA Sequence Number=SeqID_45215
MAFGFNRERTLSINPSQTLPPKNYPHLKGDCRQTLWNSDQQDPPPPPPCEIVLALRDESEQPHVQA

SEQ ID NO: 136901 - protein, 92 aa, Glycine max
  Coding DNA Sequence Number=SeqID_45216
MKREKHASYNNHNSYKSLSEELPDYYKGRHRSHLRPHSHRRENERKPQEANINLPYFHEKDNKDQGLGILGAAPSKPKDDKGKTIEKQPPKA

SEQ ID NO: 136902 - protein, 152 aa, Glycine max
  Coding DNA Sequence Number=SeqID_45217
  Homolog annotation: Hit_ID=Q6WAY4; Match level="QueryCoverage=55%, HitCoverage=15%, E-value=1e-07, Identity=32%"; Hit description =Putative uncharacterized protein
MEPIASLAQYYDQPLRCFIFGDFQLSPMVEEFEEILGCPLGGRKPYLFSGFYPSLARISKKVQISAQELDRQRQVENGVVGIPRKYLEPTYMTPSTEDVKKAMQGLFAVLQLSMGGWFHTFFSKKVGPSIRYKVTARASKKERRIGTNSWLA

SEQ ID NO: 136903 - protein, 60 aa, Glycine max
  Coding DNA Sequence Number=SeqID_45218
MVSVKVEPGAGVVIVEARLHALIMQIATRCCRGAYTPTQHNHALTKADSSQLSVPSSVRS

SEQ ID NO: 136904 - protein, 154 aa, Glycine max
  Coding DNA Sequence Number=SeqID_45219
  Gene Ontology: Mol. function=nucleotide binding; Cellular component =myosin complex; Biological process=protein amino acid phosphorylation
  Homolog annotation: Hit_ID=A5ANC9; Match level="QueryCoverage=26%, HitCoverage=3%, E-value=5e-10, Identity=75%"; Hit description =Putative uncharacterized protein
MNRILSRNRNSEVDAGATCHVSKDCSKVGLVELREEKKINIREDCPKQQHKDIRGVAVDGVEGEPVNLTEPVAEAIGAAFAAWFRLFLICSKMINEEESQSILVSGESGVGKTESTEMLMHCLAFLGGRAATEESFAPDDLNINYGSKQDDDGP

SEQ ID NO: 136905 - protein, 35 aa, Glycine max
  Coding DNA Sequence Number=SeqID_45220
MGGSGSGGMRPEREKENFTNAGYLNFTASVVDDIF

SEQ ID NO: 136906 - protein, 833 aa, Glycine max
  Coding DNA Sequence Number=SeqID_45221
  Gene Ontology: Mol. function=glucose-1-phosphate adenylyltransferase activity; Cellular component=chloroplast; Biological process =glycogen biosynthetic process
  Homolog annotation: Hit_ID=Q84UT2; Match level="QueryCoverage=66%, HitCoverage=99%, E-value=0.0, Identity=83%"; Hit description=Glucose- 1-phosphate adenylyltransferase
  Pfam annotation: Domain name=CBS; Domain location=623-743; Score =46.1; E_value=1.2e-10; Accession=PF00571.19; Description=CBS domain
  Pfam annotation: Domain name=Hexapep; Domain location=443-460; Score =3.3; E_value=58; Accession=PF00132.15; Description=Bacterial transferase hexapeptide (three rep
  Pfam annotation: Domain name=Hexapep; Domain location=496-513; Score =16.8; E_value=0.081; Accession=PF00132.15; Description=Bacterial transferase hexapeptide (three rep
  Pfam annotation: Domain name=NTP_transferase; Domain location=88-366; Score=440.6; E_value=2.2e-129; Accession=PF00483.14; Description =Nucleotidyl transferase
  Pfam module annotation: Pfam domain module=CBS::Hexapep::Hexapep::NTP_ transferase; Domain location=623-743::443-460::496-513::88-366
  Subcellular localization annotation: CTP_CleavageSite=58; ConfidenceScore=5.04e-01
MASACVTLKSNTHLANSEKGFLGERIKGGFNNSALVMNQLAIRSRSHKRVKHGVGVVSAVLTSNNAKESLTLQVPSFLRRRADPKNVISIILGGGPGTQLFPLTKRAATPAVPVGGCYRLIDIPMSNCLNSGINKIFVLTQFNSASLNRHIARTYFGNGINFGDGIVEVLAATQTPGEAGKNWFQGTADAVRQFTWVFEDAKNTNVENVLILAGDHLYRMDYMDLVQSHVDRNADITVSCAAVGDSRASDYGLVKVDDRGRIIQFSEKPNGDDLKAMQADTSLLGLSPQDALKSPYIASMGVYVFKTDVLLNLLKWRYPTSNDFGSEIIPAAVRDHDVQSYFFEDYWEDIGTIKSFYDANLALTEEKAARMLKIVNVISQLIETNTYLLYGTLLQSHKFEFYDPKIPIYTSPGFLPPTKIDKCQIVDAIISHGCFLRECTVQHSIVGERSRLDYGVELLDTVMMGADYYQTESEIASLLAEGKVPIGIGRNTKIRNCIIDKNAKIGKDVIIANKDVSNDPGVQEADRPEDGFYIRSGITIIMEKATIEDGTITGQSPKLAVRGTGGECEAYGKVSEGGLEDKKQKNRSSSLHKDDNQNQHVQIDSGFALQQFLDHIPIISIAGIKNSPVLELKAGDSIMDAIHMLYENDIFSAAIVDMSDIRFSDRYIGLIDFTSMVLWCLEVSESAKSFLYEPFFPVSMDDTVLHALLLLSKHRVHVLPVIQEPEAGFIGFATQNAVVEHLLQSSELEWFDNIADKNLSDFRILTVEEFIHIETDKVETERAIEHDHGVFLTAGSLQLKNSFIPRMDLPVANKENETLKQTMEHTTETVSAF

SEQ ID NO: 136907 - protein, 110 aa, Glycine max
  Coding DNA Sequence Number=SeqID_45222
  Homolog annotation: Hit_ID=A7P8L1; Match level="QueryCoverage=84%, HitCoverage=30%, E-value=2e-13, Identity=44%"; Hit description =Chromosome chr3 scaffold_8, whole genome shotgun sequence
MALVETNMKSSLHNRSNSMPTAPRPTVSQVEEHLHRLKDTEATTSSLSSSISHRLNDLQDLQESTDELLQLRISQQALAQECSSKQIDELLDGKRDAEMGSTIEGGKYLA

SEQ ID NO: 136908 - protein, 516 aa, Glycine max
  Coding DNA Sequence Number=SeqID_45223
  Gene Ontology: Mol. function=dihydrofolate reductase activity; Cellular component=nucleus; Biological process=one-carbon compound metabolic process
  Homolog annotation: Hit_ID=P51820; Match level="QueryCoverage=100%, HitCoverage=100%, E-value=0.0, Identity=82%"; Hit description =Bifunctional dihydrofolate reductase-thymidylate synthase (DHFR-TS) [Includes: ...
  Homolog annotation: Hit description=Dihydrofolate reductase (EC 1.5.1.3); Thymidylate synthase (EC 2.1.1.45)]
  Pfam annotation: Domain name=DHFR_1; Domain location=26-203; Score =286.2; E_value=6.5e-83; Accession=PF00186.10; Description =Dihydrofolate reductase
  Pfam annotation: Domain name=Thymidylat_synt; Domain location=245 -516; Score=578.3; E_value=7.8e-171; Accession=PF00303.10; Description=Thymidylate synthase
  Pfam module annotation: Pfam domain module=DHFR_1::Thymidylat_synt; Domain location=26-203::245-516
MAGDSSVMSNGYSKGSVNPLTNLRRTYQVLVAATQDWGIGKDGKLPWRLPTDLKFFKDITVKTSDPGKKNAIVMGRKTWESIPLEYRPLSGRLNVVLTRSGSFDIATAENVVICGSMSSALELLAASPYSLSIEKVFVIGGGQIFREALNAPGCEAIHLTEIQSSIECDTFMPPVDFTMFRPWYSSFPKVENNIRYCFTTYVRVRSSAPESPGQNIDQLLDNNSESMKFEVKEFSFLPKMISERHEEYLYLKLVQDIIAEGTTKDDRTGTGTLSKFGCQRVFWRGVVEELLWFISGSTNAKILLYELHSENKFVIGFTFFYCSVGLTEREEGDLGPVYGFQWRHFGARYTDMHHDYSGQGFDQLLDVINKIKHNPDDRRIILSAWNPSDLKLMALPPCHMFAQFYVAHGELSCQMYQRSADMGLGVPFNIASYALLTCMIAHVCDLIPGDFIHVIGDAHVYCNHVRPLQEQLHNQPKPFPTLEINPKKKDIDSFVAADFKLIGYDPHQKIDMKLAV

SEQ ID NO: 136909 - protein, 350 aa, Glycine max
  Coding DNA Sequence Number=SeqID_45224
  Homolog annotation: Hit_ID=A7P8L1; Match level="QueryCoverage=84%, HitCoverage=100%, E-value=1e-57, Identity=45%"; Hit description =Chromosome chr3 scaffold_8, whole genome shotgun sequence
  Pfam annotation: Domain name=DUF241; Domain location=50-293; Score =204.1; E_value=3.5e-58; Accession=PF03087.5; Description=Arabidopsis protein of unknown function
  Subcellular localization annotation: CTP_CleavageSite=44; ConfidenceScore=5.03e-01
MAASSLNHKFHNHARSNSLPSKPHPLILQCNERLSRLGAYDTISSSLLRQNLTNLLDLHGCIEKLVQLPLTQQALVQECQEKWVDDLLDGSLRLLDACTATKDALLHTKECTRELQSTIRRRRGGEVELTLEVKKFLTSRKVVRKAIFKALENLKGNANKGNLAITNYKDYQTMALVNLLKEAEVITFSTFESLLNFFSGSTQAKRISSWALVSKLMHNKRVGYAQGADENEFAKVDAAFQLFAFNMSTKSNDDISDLLKKLENLGTCIPDLEEGLESLFRRLIKIRVALLNILNHYQGNAVLRECSNHAKEEKVQAADDSLSEVDPLSERHLLSKTSSSLSGLGNPRKG

SEQ ID NO: 136910 - protein, 727 aa, Glycine max
  Coding DNA Sequence Number=SeqID_45225
  Gene Ontology: Mol. function=sequence-specific DNA binding; Cellular component=nucleus; Biological process=regulation of transcription, DNA-dependent
  Homolog annotation: Hit_ID=A5AV94; Match level="QueryCoverage=87%, HitCoverage=98%, E-value=1e-174, Identity=52%"; Hit description =Putative uncharacterized protein
  Pfam annotation: Domain name=Homeobox; Domain location=380-438; Score= 5.2; E_value=0.0034; Accession=PF00046.20; Description=Homeobox domain
  Pfam annotation: Domain name=POX; Domain location=196-330; Score =148.2; E_value=2.3e-41; Accession=PF07526.2; Description=Associated with HOX
  Pfam module annotation: Pfam domain module=Homeobox::POX; Domain location=380-438::196-330
MATYYTSSSNERNAVPMLCLREPLPNSYPETPVLPSNMTFYMNSGSYSEALSGNSQQQNNCFVIPSPSVGASHSTPEQQEIFANISGFQTGFHDFSAWREGRSEMLVRQPMDGQNLQGHGLSLSLGTHIPSGIHSSSFDSFLGTNPSISGNEAYQNDSSRDEGMRHSENLPPGLPEANQDLAKADFSFHGMSGVGKTVPSSKYLKTVQLLLDEVVDIRKAIKRPAMKSHSTHEKSKKDSKEDDEQLENDRPSANGVPNSQASTGKTSCELSHAEKQDLHHKLTKLLSMLDETVVSSFDVIAGCGAAKPYTALALQTISCHFRCLRDAITGQISATQKNLGEQDASGSNNGVGMARLKYVDQQIRQQRVIQQFGMMQHAWRPQRGLPESSVSILRAWLFEHFLHPYPKDSDKIMLARQTGLTRSQVSNWFINARVRLWKPMIEEMYKQDNCIAGMDSNSSSENVSKVTKSYVKTSNDVGDDSQHCQSPIVADTNHSGGQAKDLRHDQALDTEMMASIGLASLINGGYGAETEHRRNLDDCGLFSNDTVVQSDGATNKRFVSVGPTCQMPESERFKSGSGVSLTLGLQHCEGGNFLPGKTHLSLVSMREDDISKATAASTVGVETTELECIGAGNQQQRALAFSCTTSFCGGGRVSKKAFRMVPIAVAKLAEGINGADLRNVFTEAGLFAIRAQRDYVIDGDFVKELIQDSEYMVFNLNARKWYGNTCP

SEQ ID NO: 136911 - protein, 80 aa, Glycine max
  Coding DNA Sequence Number=SeqID_45226
MTPWIGGFGDVFSVQGFPNESFFKVFGCIMFKKGEKGMMAMVVGKRENEQRKATTKDVVGGEGGKVVGVAIVVGVIDATK

SEQ ID NO: 136912 - protein, 1089 aa, Glycine max
  Coding DNA Sequence Number=SeqID_45227
  Gene Ontology: Mol. function=microtubule motor activity; Cellular component=microtubule associated complex; Biological process =microtubule-based movement
  Homolog annotation: Hit_ID=A5AWC9; Match level="QueryCoverage=92%, HitCoverage=90%, E-value=0.0, Identity=67%"; Hit description =Putative uncharacterized protein
  Pfam annotation: Domain name=Filament; Domain location=741-979; Score= -186.9; E_value=0.035; Accession=PF00038.12; Description=Intermediate filament protein
  Pfam annotation: Domain name=Kinesin; Domain location=106-431; Score =503.6; E_value=2.3e-148; Accession=PF00225.14; Description=Kinesin motor domain
  Pfam module annotation: Pfam domain module=Filament::Kinesin; Domain location=741-979::106-431
  Subcellular localization annotation: CTP_CleavageSite=92; ConfidenceScore=6.00e-01
MASSSRARSSSPFSYRKPSTPYSSTSSSSSFTNGRLMPRSSSSSTSSFFNSGGRSMTPSRGRSESAYHGSRGYAARSPVAFGAEELIAEPVVDSSRTGDSISVTIRFRPLSEREYQRGDEIAWYADGEKIVRNEYNPATAYAFDRVFGPHTNSDEVYEVAAKPVVKAAMEGVNGTVFAYGVTSSGKTHTMHIFFSSSVGYLSNKGDQNSPGLIPLAIKDVFSMIQDTPGREFLLRVSYLEIYNEVINDLLDPTGQNLRVREDAQGTYVEGIKEEVVLSPGHALSFIAAGEEHRHVGSNNFNLFSSRSHTIFTLMIESSAHGDDYDGVIFSQLNLIDLAGSESSKTETTGLRRKEGSYINKSLLTLGTVIGKLSEGKASHVPYRDSKLTRLLQSSLGGHGHVSLICTVTPASSNMEETHNTLKFASRAKRVEIYASRNKIIDEKSLIKKYQKEISFLKLELDQLRKGMLVGVNHEEILTLKQKLEEGQVKMQSRLEEEEEAKAALMSRIQRLTKLILVSSKNAIPGYLTDVSNHQRSHSVGEDDIENESQKDSSAVSSDLFHDVRHKRSSSRWNEEFSPASSTVTESTQAGELISRTKLTVDYRACTLQSKLEHPRAGIYGGMTTSDQKDLLIEQVKMLAGDIAFSTSTLKRLMEQSVHDPECSKIQIENLEREIQEKRKQMRVLEQRLIETEESPVANSSLVEMQQTVTKLMTQCNEKAFELELKSADNRVLQEQLNDKSSENRELQEKVRQLEQQLAAVNSGTSSVSSEQCASGEHIDDMKKKIQSQEIENEKLKLGQVHLSEENSGLRVQNQKLSEEASYAKELASAAAVELKNLAGEVTKLSLQNAKLEKELMAARDLVNSRSAVMQTVNGVNRKYNDPRAGRKGRISSRASEISGAGVDDFESWSLVADDLKMELQARKQREAALEAALAEKEFVEEQYRKKAEEAKKREEALENDLANMWVLVAKLKKEGGAVPESNIDKKNDGAEHINNPKINDVESNIVPKEQLLDAPKPDDEMPKDEPLVVRLKGRTRVGITWIACCPLVGENFCLLFAICLTGINEYLGYFKLNKRKTFFSKRTFNIKQN

SEQ ID NO: 136913 - protein, 1224 aa, Glycine max
  Coding DNA Sequence Number=SeqID_45228
  Gene Ontology: Mol. function=nucleic acid binding; Cellular component= nucleus
  Homolog annotation: Hit_ID=A7P7X7; Match level="QueryCoverage=54%, HitCoverage=74%, E-value=0.0, Identity=56%"; Hit description =Chromosome chr3 scaffold_8, whole genome shotgun sequence
  Pfam annotation: Domain name=GYF; Domain location=678-733; Score =47.1; E_value=6.1e-11; Accession=PF02213.7; Description=GYF domain
  Pfam annotation: Domain name=Plus-3; Domain location=334-441; Score =172.3; E_value=1.3e-48; Accession=PF03126.9; Description=Plus-3 domain
  Pfam annotation: Domain name=SWIB; Domain location=195-270; Score =79.9; E_value=8.3e-21; Accession=PF02201.9; Description=SWIBMDM2 domain
  Pfam annotation: Domain name=zf-CCCH; Domain location=1200-1224; Score=9.1; E_value=0.087; Accession=PF00642.15; Description=Zinc finger C-x8-C-x5-C-x3-H type (and similar)
  Pfam module annotation: Pfam domain module=GYF::Plus-3::SWIB::zf -CCCH; Domain location=678-733::334-441::195-270::1200-1224
EEEEERQGEEEDGDGGMAMAEDTEEKSAAVSGGKRRRGAGKNAKATGRVASRKKMEEDVCFICFDGGDAPRLTILPALIVTRPSFELRGSGIVGQIDFDDRNSWEYLFKDYYIDIKKKLSLTFDELTQAKNPWKGSDMLLSKEESLDETFDATNDRGSDSDSSYENADLSRSKRKKAKKRGKSRSKEGDDSSEWASKELLEFVMHMRNGDKSVLSQFDVHTLLLEYIKRNKLRDPRRKSQIICDARLQNLFGKPKVGHFETLKLLESHFLLKDDSQAEDLQGSVVDTEMSHWEGDGNPNSYTKAGKDKRRKNRKKGDERGLQTNVDDYAAIDNHNINLIYLRRNLVEDLLEDTEKFHDKVVGSFVRIRISGSGQKQDLYRLVQVVGTCKAAEPYKVGKRMTDILLEILNLNKTEIVSIDIISNQEFTEDECKRLRQSIKCGLINRLTVGDIQDKALVLQEARVKDDNVLLLPTTCLCFVLILHSSLTLRECVEKLQLLKTPEERQRRLEEIPEIHVDPNMDPSYESEEDENEVDDKRQENYMRPRGSTAFGRRGRDIVSPRSGSISNDSWSGTRNYSNVNQELSRNLSNKGFSIKGDNASNANEALNDAQLHRGRDRESQLSNSWERQKQSSTLESGAKNTQPLVASESFSAAVSEASAAPSSAGITPPAVKINETEKMWHYQDPSGKVQGPFSIVQLRKWSNTGYFPADLRIWRTTEKQDDSILLTDALTGNFSKEPSMVDKAQSVHDLHYPSSYSRKSPQQGIEGQVGERLSLDQNGGSWNSHSTLGSPGQTTGGSWRSKDNMNSLANRTSPLAVEVPKNPANGWGSDAGVRNDATNLPSPTPQTTPGGTMGLAFENKWSPTPVQLPGSLLGNSFPGSHGGLQASVAVHPEHAVQNAEKGSSSQPGISSASTDNTKLHPQATAVVPVVASGVDIKMAGANMQNQVVSSQNSHAEAQGWGSAGVPKPEPLAWGGASSQRIEPNNPATMPSQPASHGPWGDASSVPTTVSFNTGNPTASLPTPGFLGMTAPEPWRPPASSSQSNIAAPAPPNMPWGMGMSGNQNMNWGGVVPANMNVNWMPTQVPAPGNSNPGWAAPSQGLPPVNAGGWVGPGQGRSHVNANAGWVGPGQGLAPGNANPGWTAPVGNPGMWGSEQSHNGDRFPNHGDRGAQGRDSGYGGKSWNRQSSFGRGGSSRPPFGGQRVVCKYYESGRCRKGTSCDFLHT

SEQ ID NO: 136914 - protein, 566 aa, Glycine max
  Coding DNA Sequence Number=SeqID_45229
  Gene Ontology: Mol. function=metal ion binding; Cellular component =intracellular; Biological process=biological_process
  Homolog annotation: Hit_ID=A7QPC5; Match level="QueryCoverage=81%, HitCoverage=69%, E-value=1e-115, Identity=51%"; Hit description =Chromosome chr18 scaffold_137, whole genome shotgun sequence
  Pfam annotation: Domain name=Bromodomain; Domain location=46-128; Score=93.8; E_value=5.6e-25; Accession=PF00439.16; Description =Bromodomain
DVKVPKATDSKQHGSQGESGPTTPLPDKKLLLFILDRLQNWLFDVLYCSQPSCRKDTHGVFSEPVDPEELPDYLDIIKHPMDFGTVRKKLDGGLYTDLEHFEKDVFLICSNAMQYNSSDTIYHRQARAMQEIARKDFENLRQDSDDDSEPQPKIVQRGRPPGKHSRKSLGLGMPPPERVGPESSSDATLASGGDIASGSNGYNLRKVPSKFQPTDSSARAYNSTFNSGGYVGWSEWENEFPASVVKAVLRYGKKQFVVDETRRDTYKNPVTLGNERPVLSTVEDEFKQLLAVGVHMKHSYARSLAHFAADLGPVVWKIAASKISSVLPAGHDFGPGWVSEDDGSSQRRHFPVCDEGRTSDPPVPEDYRSRFSSPSGSLPLANRPFYQSGDMAIDNYQNELNPVINIPGGSESITPMRIQQESMVHSDDFGSCDRLGSNFPSQMKMVRLADLTGTSSAGVVPQMFDMDPISNRIVHTNVDSSFKGQHLSKLSQLDSGNLLSREPGFEPQSWPQGLAGKSSWQGLEVPTKQNSFALANDLNGRIGTTNSPSSNVEAGSQLQPNLALQL

SEQ ID NO: 136915 - protein, 139 aa, Glycine max
  Coding DNA Sequence Number=SeqID_45230
MGEVSESTMTKRKKKGRPSLLDLQKRSLKKEQQNHHQQRHNSTNVVPHDDDEDERKEKKHKLLVGLNSHLHHPTLLPNSQPFNSDPKRRKIIDPLQTGKILCGALTLMGGASSFFLVLILIFHYWLYARSSPSFMHGYA

SEQ ID NO: 136916 - protein, 73 aa, Glycine max
  Coding DNA Sequence Number=SeqID_45231
MDEFGLKRQPQVVDGENGIRRKLKMFLVFIKEWNGGNIIVVIAGMFGNEAGGNGGTNDGMVGMVGKGSSGTFP

SEQ ID NO: 136917 - protein, 476 aa, Glycine max
  Coding DNA Sequence Number=SeqID_45232
  Gene Ontology: Mol. function=glyceraldehyde-3-phosphate dehydrogenase (NADP+) (phosphorylating) activity; Cellular component=chloroplast; Biological process=reductive pentose-phosphate cycle
  Homolog annotation: Hit_ID=P12859; Match level="QueryCoverage=100%, HitCoverage=100%, E-value=0.0, Identity=79%"; Hit description =Glyceraldehyde-3-phosphate dehydrogenase B, chloroplast precursor
  Pfam annotation: Domain name=Gp_dh_C; Domain location=244-401; Score =348.7; E_value=1e-101; Accession=PF02800.11; Description =Glyceraldehyde 3-phosphate dehydrogen
  Pfam annotation: Domain name=Gp_dh_N; Domain location=86-239; Score =283.9; E_value=3.2e-82; Accession=PF00044.15; Description =Glyceraldehyde 3-phosphate dehydrogen
  Pfam module annotation: Pfam domain module=Gp_dh_C::Gp_dh_N; Domain location=244-401::86-239
  Subcellular localization annotation: CTP_CleavageSite=51; ConfidenceScore=5.61e-01
MATHAALASTRIPSNTRFPSKASHSFPTQCALKRLEVTEFSGLRSTSCVTYANSARESSFFDLVASQLTPKTNGSTPVRGETVAKLKVAINGFGRIGRNFLRCWHGRKDSPLEVVVVNDSGGVKNASHLLKYDSMLGTFKADVKILDNETITVDGKSIKVVSSRDPLKLPWAELGIDIVIEGTGVFVDGPGAGKHIQAGAKKVIITAPAKGADIPTYVVGVNEGDYTHEISNIISNASCTTNCLAPFVKILDAEFGIVKGTMTTTHSYTGDQRLLDASHRDLRRARAAALNIVPTSTGAAKAVSLVLPQLKGKLNGIALRVPTPNVSVVDLVVNVEKKGLTAEDVNAAFRKAAEGPLKGVLDVCDVPLVSIDFRCSDVSSTIDSSLTMVMGDDMVKVVAWYDNEWGYSIQLVELKLLVIMDHAIDGYCVGDCSQRVVDLAHLVASKWPGAPKAGSGDPLEDFCETNPADEECKVYE

SEQ ID NO: 136918 - protein, 262 aa, Glycine max
  Coding DNA Sequence Number=SeqID_45233
  Gene Ontology: Cellular component=chloroplast
  Homolog annotation: Hit_ID=A7QPG7; Match level="QueryCoverage=52%, HitCoverage=85%, E-value=1e-51, Identity=62%"; Hit description =Chromosome chr18 scaffold_137, whole genome shotgun sequence
  Subcellular localization annotation: CTP_CleavageSite=75; ConfidenceScore=5.73e-01
MASISRFCCVHMRASLCNFTAQKGPSPSLPSPLTHFSSTSNIPRRFCSGPSPPTTLDLEHHKTTPCLLSSIEEGRAVNRRQLILHTPVAVAAFAVPNALALNDVSEDVRVYTDDENKFKIEIPQEWQVGTGDGESSGFKSITAFYPTVASNSNVSVVITGLGPDFTRMESFGKVDEFAQTLVSGLDRSWRKPPGVAAKLIDCKSSDAIGMASNGWYNRLYTVTGQYVEEETDKYASKVQKKYVGHDDSRYLVYATTKRRSLK

SEQ ID NO: 136919 - protein, 251 aa, Glycine max
  Coding DNA Sequence Number=SeqID_45234
MTSIAQSNTSRLGFPALITALCRARGAVFDNLTFERLSPFINLAYIRKNCWNLEDLTVSIRGARRARARPAELPSTSAAPTPAFTSVAPSIPAQTDSQLFEAMHQSIHQGQIILLQSIQMVSPPRSIPSVEQFRKMVAWPGTQTSLHREDEGPTAQVPQHVEDESSEATFPEPFVIGEEVGETQVRQVATNTLERSLEATFRDSCISGGPTLTSAYSRPLHSYFRDTRGPDHTSPGYGHFSSSYSSTSSDR

SEQ ID NO: 136920 - protein, 179 aa, Glycine max
  Coding DNA Sequence Number=SeqID_45235
MRGYRMVIRTFCQPGAHEPVDALRLTSSSAPFVILTHETNALFCAFGHPEMASPMTCGGTAWLSAPFVNQGQTSPLTRANEAVDAQRLTSSSSSFVIQGQQVRWQVEIPYGHSHLSSTEANEFDGIKMMLGQLPYPNFIWGPLFGGMQPPLDRLESKRSIVAQSVKFRNIPEVKKGIVA

SEQ ID NO: 136921 - protein, 85 aa, Glycine max
  Coding DNA Sequence Number=SeqID_45236
MGSSQAPSLKNRFYQVKIKSVGVASLKKLRQLMGQLQRQAFRKAYGKIWDLIIVEVSTEAIASLAQYYDQPLRCFTFVDFQLTPT

SEQ ID NO: 136922 - protein, 157 aa, Glycine max
  Coding DNA Sequence Number=SeqID_45237
  Homolog annotation: Hit_ID=Q949K7; Match level="QueryCoverage=27%, HitCoverage=48%, E-value=1e-08, Identity=60%"; Hit description =Putative gag polyprotein
MQDDAGHISSPILEGEPPRQPDEVHEDHQECAQRDVEFYPPIPIEGPKPNTLPQPNLTAQPIILSTEGPPPVTEERRKLDLLEESLRVVEGFGDYPFADMTGSLLGTRCCYSPKIQRCRNFDKYKGTTCPKNHLKMYCRKMGVHSRDEKLLIHFFSR

SEQ ID NO: 136923 - protein, 220 aa, Glycine max
  Coding DNA Sequence Number=SeqID_45238
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=85%, HitCoverage=17%, E-value=9e-92, Identity=92%"; Hit description=DNA -directed RNA polymerase subunit beta
  Pfam annotation: Domain name=RNA_pol_Rpb2_6; Domain location=68-220; Score=-202.8; E_value=0.027; Accession=PF00562.19; Description=RNA polymerase Rpb2, domain 6
MVRGTICGAIRHKLIPTPQNLQQEILWHLIEIFREEQTVPARYRQEFLTIAWGTGSSSKYFFPSNIFSIGASLILFIEHNDANRALMSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERL

SEQ ID NO: 136924 - protein, 63 aa, Glycine max
  Coding DNA Sequence Number=SeqID_45239
LASHLKEVSLAIRELLKEVFSKKLLKEVFSSEILIPGDRCRTGCHDITLQNMQIICVRMNRLN

SEQ ID NO: 136925 - protein, 104 aa, Glycine max
  Coding DNA Sequence Number=SeqID_45240
  Gene Ontology: Mol. function=transporter activity; Biological process= transport
  Homolog annotation: Hit_ID=A9CH15; Match level="QueryCoverage=100%, HitCoverage=20%, E-value=5e-50, Identity=97%"; Hit description=ABC transporter, substrate binding protein
MKKIQTLTAALLASVFLASPALSSELRIGLNDDADVLDPAQSRTFVGRIVYTAMCDKLVDISQDMKIVPQLATEWAWSEGGKVLTMKIRDGVKFHDGETLDAAA

SEQ ID NO: 136926 - protein, 190 aa, Glycine max
  Coding DNA Sequence Number=SeqID_45241
  Homolog annotation: Hit_ID=UPI00016621D1; Match level="QueryCoverage =84%, HitCoverage=39%, E-value=1e-15, Identity=37%"; Hit description =UPI00016621D1 related cluster
MTDPLDESISCFLIRVNPWVLVTLTFRGLHVLAFRGPHALAFVGLHTLTFRGLHVLAFRGPHALAFRGLHVLTFRGLHVLTFRGPHALAFRGLHVLTFRGIHVLNFRGLHVLAVKGSCTFTFVGRHVLTFRGLHVLTFVGLHALAIRGLHVLTFRGLHALAIRGLHVLTFRGPHVLTFRGLHALAIRGLH

SEQ ID NO: 136927 - protein, 57 aa, Glycine max
  Coding DNA Sequence Number=SeqID_45242
MGYFISRLSFPENTETFSSLASYQELRRSEFLIGGYVGAKASLLSTTPLSVTMTQEL

SEQ ID NO: 136928 - protein, 124 aa, Glycine max
  Coding DNA Sequence Number=SeqID_45243
MVILCPLSFRSNKLSDKRAETNYGHSAPFVIQGRFRWQGDSLSEWCFARTKLVSYLYFPFISNKRQVKRGNCHTLISFGDHPLLGCDPHLTTLRYMAPIVRRFMKLRDMPEVKRKHCCTIRKVP

SEQ ID NO: 136929 - protein, 187 aa, Glycine max
  Coding DNA Sequence Number=SeqID_45244
VYEGSTTIHNIPLGNDQVRVDVEEVRDADARIPVSTQEVQLVGRTLNTFLAWATHLVQPFSEQRPEGSAKPIDRSEPNDDPLYQMTLTIPQLFLKSMQRFGQSQIESKDYIKKWMQNSQRDVYLGAYLNGALKGFNDIQGSKSKATAKWIPIKYFNDPRPMKPKRIKTIHIQWTRCCLRIKNETLGV

SEQ ID NO: 136930 - protein, 43 aa, Glycine max
  Coding DNA Sequence Number=SeqID_45245
VSLIKNKNKGNWKGGLVQYLEEFESRSKGPTTLRAIGLRSAAN

SEQ ID NO: 136931 - protein, 42 aa, Glycine max
  Coding DNA Sequence Number=SeqID_45246
MMTMIVNTLPVFYYEKMVGYTPSSFADLVFAGIYKFMPQLQR

SEQ ID NO: 136932 - protein, 86 aa, Glycine max
  Coding DNA Sequence Number=SeqID_45247
MGHLSDQGVPTDPKRIKVIPEWPTPPSVEGRNPEYEEPRDLRSNPLQGGGDDAILPPRVLDRRLQEDWARSTKEGPTVLMNLRVDF

SEQ ID NO: 136933 - protein, 74 aa, Glycine max
  Coding DNA Sequence Number=SeqID_45248
MWETSCRSLPFDARAHGCVLHGRKMRGVATNVYSRKTSEKLERCGLRTLSVKGSGFVFTHGEGISTPSVRHKGR

SEQ ID NO: 136934 - protein, 85 aa, Glycine max
  Coding DNA Sequence Number=SeqID_45249
MPEVYRLAKLEAEEDESSHITLLHQEEPWDWIGLLLTLNGSQELPRLLAKAKAVADTYSAPEEIHGLLSYCQHMIDLMDHMIRNR

SEQ ID NO: 136935 - protein, 100 aa, Glycine max
  Coding DNA Sequence Number=SeqID_45250
MMITRDDDKGDDKKLKGQSKNEFKIFKIESRTLQDSRGKLISRIKNQDSTDQDFKNQDSTDYDFKNQESRDQDSRLKIQKSREALLKISMKRFSQKLSNT

SEQ ID NO: 136936 - protein, 93 aa, Glycine max
  Coding DNA Sequence Number=SeqID_45251
MASMMEAMLGMRQLSSAAKADPTLLATAHHPPPNTLGRGRNTLGHKNNPHLGYNRAAYPYGLPPNYSPPVMQDDAGHISSPILEGEPPQQPEE

SEQ ID NO: 136937 - protein, 40 aa, Glycine max
  Coding DNA Sequence Number=SeqID_45252
MGTTTGACHPAHPGEQGCFLQKQQPSGGRIWKAQVGLIAI

SEQ ID NO: 136938 - protein, 136 aa, Glycine max
  Coding DNA Sequence Number=SeqID_45253
MRGTVHEPQVNIGADQKGTTLLANRGLHALTLRGLCVLTFRGLHVLTFRGLHALAIRGLRVLTFRGLHALAIRGLHVLTFRGLHALAIRGLHVLTFVGLHALTFRGLHVLANRGLHALTLRGLHVLANVGATRPHL

SEQ ID NO: 136939 - protein, 318 aa, Glycine max
  Coding DNA Sequence Number=SeqID_45254
  Gene Ontology: Mol. function=hydrolase activity, acting on ester bonds; Cellular component=intracellular; Biological process =nucleobase, nucleoside, nucleotide and nucleic acid metabolic process
  Homolog annotation: Hit_ID=A8GKT0; Match level="QueryCoverage=99%, HitCoverage=40%, E-value=1e-149, Identity=83%"; Hit description=RNA binding S1 domain protein
  Pfam annotation: Domain name=Tex_N; Domain location=1-133; Score =199.4; E_value=8.6e-57; Accession=PF09371.1; Description=Tex-like protein N-terminal domain
RQSILKSIDEQGKLTPELATAINSTLNKTELEDLYLPYKQKRRTRGQIAIEAGLEPLADTLWQDPSQDPEQLAASYVDADKGVADVRAALDGARYILMERFAEDATLLAKVREYLWKNAHVVSRVVEGKEEEGAKFRDYFDHHEALSGVPSHRALAMFRGRNEGVLQLSLNADPQFDEAPRESYGETLIAEHLKLRLNNAPADSWRKAVVSWTWRIKVLLHLETELMGTLRERAEDEAINVFARNLHDLLMAAPAGMRATMGLDPGLRTGVKVAVVDATGKLVATDTIYPHTGQAAKAATAVAALCAKHQVELVAIGT

SEQ ID NO: 136940 - protein, 83 aa, Glycine max
  Coding DNA Sequence Number=SeqID_45255
MRQANDVKEALPGRQPSFNFCYLCLSCIISYGTCFTVCTVDPFAKRKLRAKRIFSHALSRESQALSGQPLHLRLIWSAKQSQG

SEQ ID NO: 136941 - protein, 59 aa, Glycine max
  Coding DNA Sequence Number=SeqID_45256
MLTSPERAQTTTLASACQSYLGSLNDKVQITVRCLRGLPDSWVMVTKSGVVDKSEALAP

SEQ ID NO: 136942 - protein, 31 aa, Glycine max
  Coding DNA Sequence Number=SeqID_45257
MNEKRNSWVSYPNFVRGPLLDDVRPFFGPRE

SEQ ID NO: 136943 - protein, 90 aa, Glycine max
  Coding DNA Sequence Number=SeqID_45258
MVAITLAEVHQPPFLQEYDSNATCACHGEASGRSIEHCRALKRKVQGFSTFTRSGCKPLVCLLKRPVLLSLDFQDRSIRDYSSCILVGLP

SEQ ID NO: 136944 - protein, 51 aa, Glycine max
  Coding DNA Sequence Number=SeqID_45259
MPSKVILMMAKNQELSKFQRFKNQDSRFKIQESSFIQESSFKNQDSRIKNQ

SEQ ID NO: 136945 - protein, 78 aa, Glycine max
  Coding DNA Sequence Number=SeqID_45260
MAGTFFLLKQQNSLEIMSGTPQLVVSEQKLDSSEPVMVLLCECCVSLKLGSRFRGVTLSHTLCVFLPSCLEHGCVTDS

SEQ ID NO: 136946 - protein, 59 aa, Glycine max
  Coding DNA Sequence Number=SeqID_45261
MGTNQNGKRFYQVKVKSLDVTSLKELGRLMGPIQRQAFRKVYGKILDLTAAEELMKHWA

SEQ ID NO: 136947 - protein, 113 aa, Glycine max
  Coding DNA Sequence Number=SeqID_45262
  Subcellular localization annotation: CTP_CleavageSite=51; ConfidenceScore=5.48e-01
MSPQPLETSQSLKISSKALQDGFLVMLSSLSVSTQPKTLKKLNNLPKIEISALNRQSFFSLSVRVKGGALSELTLAQHLCIAHPSCRFFCVLNQRIVRLVDGSPSAWHGSASS

SEQ ID NO: 136948 - protein, 127 aa, Glycine max
  Coding DNA Sequence Number=SeqID_45263
MTRGNPYDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDEDVPYVLKTRLIHLLPKFHGLA

SEQ ID NO: 136949 - protein, 146 aa, Glycine max
  Coding DNA Sequence Number=SeqID_45264
  Pfam annotation: Domain name=G-patch; Domain location=1-42; Score =19.8; E_value=0.00077; Accession=PF01585.14; Description=G-patch domain
MVARVMLRNGFEPGRGLGKDCLGNADVVDIKGNPYKYGLGYEPGMPGKRNVPSRFRADREEVAAIEEEFPQDPPSFVQPCHPDSQEEEEDVLSPELERLVAQEEREMKPHQEETELVNLGTTVEKKEVKVGTGMTRAYPPRLDNPS

SEQ ID NO: 136950 - protein, 191 aa, Glycine max
  Coding DNA Sequence Number=SeqID_45265
MDPWVLVTLTVRGLHVLALRGLHVLTTRGLHALTSRGLYGYTPSPGLLVTLTVKGLHILALRGLHVLTTRGLHALTSRGLYVLSLRGLHALTLGTSYLHLQRTTRPRLQRVMYLQLQRTTRPRRQADAGRNTTATLGWPVAGNRHTATTSKVHLSSSIKRLECCLRHMADQQATKSKAKGKQSIRSVTDKS

SEQ ID NO: 136951 - protein, 72 aa, Glycine max
  Coding DNA Sequence Number=SeqID_45266
MAIMMEAMMSVKKILEANAVAIAATSVVAKVNPTSHPGINQMNHPTQIWAKVFLFGHLNFIPIPHLLSMHSG

SEQ ID NO: 136952 - protein, 108 aa, Glycine max
  Coding DNA Sequence Number=SeqID_45267
MRGPLKESTSCFLVRLKSFGTCTYWLAFRGLHLLTFRGVHALAIRGLHVLTFRGLHALAIRGLHVLTLHRATRPRLQRTSMSSPSEGYTSLTFRGPHVNFRGLDAPRL

SEQ ID NO: 136953 - protein, 169 aa, Glycine max
  Coding DNA Sequence Number=SeqID_45268
MATLAEVAETLQYMMSPQGRNTWTVDDLVPYVEKITILSEEQERIIEPVSHGPASERQFPAQEFHILQSSVETQGIGRRREVVEAEECSQQMAERGHGMHYTPQTFAQYPTQMYQYPFQGHHTDTSASQHSFGGVVETQPHFSWPTMTPSQQYHDPNPTPNAPLGSGIL

SEQ ID NO: 136954 - protein, 133 aa, Glycine max
  Coding DNA Sequence Number=SeqID_45269
MWAFLTGRQINWAHLVRYRMHKALRANAPLPYPQLVTLFLRHFQIPLDDEPFVQKDALPPQDECTPSPPPQRDDSALMTEVLSELRGLRSYVGEHFDSLDNRFAGMNIRLTQLEEDVGYIRQSFILPPPPPPS

SEQ ID NO: 136955 - protein, 27 aa, Glycine max
  Coding DNA Sequence Number=SeqID_45270
YKSTLDRLTYVNVEVGATSYEILGKNF

SEQ ID NO: 136956 - protein, 143 aa, Glycine max
  Coding DNA Sequence Number=SeqID_45271
MSANDHAILQDRTHQPTKKSMIELSSHDALLAQNKLLSKKLEILTETLGKVPTKLSMGQPTHSSILQVTGCTICGEAHRQGYTQGGFSGFQQGSYNQQGQWRTHPDNQFNKDQSGPSNKPIQQGPNIFQRTTKLEETLTQFMQ

SEQ ID NO: 136957 - protein, 327 aa, Glycine max
  Coding DNA Sequence Number=SeqID_45272
  Homolog annotation: Hit_ID=Q84VH5; Match level="QueryCoverage=99%, HitCoverage=52%, E-value=1e-133, Identity=72%"; Hit description =Envelope-like protein
MEMDKKIRSIVSRILKDASVPDADKDVPTSGTPNVSVPDADKDVPTSSAPNAEALSSPSEEESTEEEDQASEETPAPRAPKPAPGDLIDLEEVESDEEPIANRLAPGIAERLQSRKGKTPIKRSGRIKTMAQKKSTPITPTKSRRSKVAIPSKKRKEISSSDSDDDVELDVSTSKRTKKSGRKVPGNVPDAPLDNISFHSIGNVEKLAVERELGRDALDCKETMDLIKAAGLLKTVTKLGDCYEKSRKCVRFSPAVINKYLGRPTDGVVDITVSEHQIAKEITAKQIQHWPKKGKLSAGKLSVKYAILHRIGAANWVPTNHTSTVAT

SEQ ID NO: 136958 - protein, 110 aa, Glycine max
  Coding DNA Sequence Number=SeqID_45273
MRDDKRFLYVIGIRVNSGVGLGGKFLVALEPAPKWALPPGRVVVGAGAWRASLWMGAGALGYTGAELEESPARAEKLGCSDPPSIGTYEGDLIELPSLQTYFDSLPRQYQ

SEQ ID NO: 136959 - protein, 180 aa, Glycine max
  Coding DNA Sequence Number=SeqID_45274
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=28%, HitCoverage=50%, E-value=7e-24, Identity=100%"; Hit description=LacZ protein
MGVQIAIRTAWALQKIPPEGCCFWRKLPRSPGRAGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPPSVAEQEGQLIETEATGAPQKHHHTLNQ

SEQ ID NO: 136960 - protein, 177 aa, Glycine max
  Coding DNA Sequence Number=SeqID_45275
KTLLPKRKVEIYHIELDEFKDKLERRNLHKRLTNLVDSNIDLALVKEFYTNLYNFKGPSPKQVRVRGHVVKIDADSLKTFLETLVVLAEGETLLAYSRYCRLPTNIREIEVSLCIPSQGFVLNVEGHPGKILRKDLTTLAQVWSVLSYSNLAPTSHTSDLTVDRARLIFGLVSQMDT

SEQ ID NO: 136961 - protein, 203 aa, Glycine max
  Coding DNA Sequence Number=SeqID_45276
  Homolog annotation: Hit_ID=UPI00006A2D9E; Match level="QueryCoverage =67%, HitCoverage=76%, E-value=3e-07, Identity=16%"; Hit description =UPI00006A2D9E related cluster
  Subcellular localization annotation: CTP_CleavageSite=22; ConfidenceScore=5.09e-01
RVTRPSLHRAIRLHLQRTIRPRLQRATRPRFQRTIPPHLQRTTRSHLQRTTGLHVLAFRQLHALAFRGLHVLAFRGLHVLPLKCLHTIAFRGLYVLLFRGLHAPAFSGLHIHPVTGQLVLEIRRLHVLRVKELHALTFRGVHILTFIGLHVLSFRGLHALPLKGLHALASEDYMSSPLEDYRGSSRVDLQACKLGTGRRFTTS

SEQ ID NO: 136962 - protein, 148 aa, Glycine max
  Coding DNA Sequence Number=SeqID_45277
ALGFPALITGLYQSFGVPSHLAKVIRPPITQAFIEKYCTQRQAKGDAPQAADAQYLRHLVRQQAANHRAHVQTHDCLYQLSLSLQSQGFTSFPCPTPDQFRAEVAWPRDWPEARAGEAPVEAPDEADEAREDEEMTDLLDFLGGSGAT

SEQ ID NO: 136963 - protein, 118 aa, Glycine max
  Coding DNA Sequence Number=SeqID_45278
MGEVEEVQEQMKADMEAMKEQMATMMEAMMRMKKIMEANVVAVAATSAVAKQRSTRDVPSLVLFENPSGCTLPLELIHKKMYPSLVLSQTPSRCTLYLFHKGCALQCVKTKISGCLNL

SEQ ID NO: 136964 - protein, 43 aa, Glycine max
  Coding DNA Sequence Number=SeqID_45279
GVSSLSSFSIPLPFIFQEAKESIDEEDPRPTSSNGACIKFFQK

SEQ ID NO: 136965 - protein, 250 aa, Glycine max
  Coding DNA Sequence Number=SeqID_45280
  Homolog annotation: Hit_ID=A5C922; Match level="QueryCoverage=35%, HitCoverage=32%, E-value=3e-09, Identity=37%"; Hit description =Putative uncharacterized protein
  Pfam annotation: Domain name=Retrotrans_gag; Domain location=46-132; Score=-2.6; E_value=0.096; Accession=PF03732.8; Description =Retrotransposon gag protein
MAQPPPRERTLREMAAPDFTYESLCIQYPDEDVPYVLKTGLIHLLPKFHGLTEGVAKDWLYYLAPRSITSWDDLKRVFLEKNFPASRTTAIRKDISGVHEVATNPSTSSETKKLEGKLDALVNLVIQLALNQKSVPVARVCGLCSSADHHTDLCPSMQQPGAIEQPEAYAANIYNRPPQPQQQNQPQQSNYDLSSNRYNPRWRNHPNLRWSSPQQQQQQPAPSFQNAAGPSRPYIPPPIQQQQQPQKQPT

SEQ ID NO: 136966 - protein, 194 aa, Glycine max
  Coding DNA Sequence Number=SeqID_45281
MGDQEEVQEQMKADMSALKEQMASMMDVMLGMRQLMENNAATAVAVSLAAEADPSLPATTHHPIPNVVGRERSTLGHINNPDLGYNRVAYPYGLLPDYTPPVMHDDAGHVPPLILEGEPSRQMDEVHEDRREHAQGNIDSYSPFPAEGPAPNALPQPNLMGEPRNHPTQPIFLSAGGPTRQQKKRGNSISSRRH

SEQ ID NO: 136967 - protein, 167 aa, Glycine max
  Coding DNA Sequence Number=SeqID_45282
  Subcellular localization annotation: CTP_CleavageSite=45; ConfidenceScore=5.15e-01
SRKDAAAEGSSATPEFDSHHFPERRAPTALRGPSKDGRSTERGVSNSGRMSIRTCRRRWTRSIGRRWGQWIPFDADALNQFLGDPLDLEEGQQCEFSQRRNRADGFDEEPLPQLLCTLVQDFARTAAGRRVRIMRTSMTTLTQTWMTLLLSNVLPSDHNSDLPLPKC

SEQ ID NO: 136968 - protein, 81 aa, Glycine max
  Coding DNA Sequence Number=SeqID_45283
MRKMLLVEVLDTAFLTSMTRPSKVGMIPPPRVVADFAAEVEEIYCRCLQHKLQAVQLLQIVAQKGKGLCGGRQRSINHRVW

SEQ ID NO: 136969 - protein, 80 aa, Glycine max
  Coding DNA Sequence Number=SeqID_45284
MVIDYQRLISIYHPRYIAGQPPHKPPCFVDFVLLLVDCLELACLGHPSYVVLGGDQAMAQINSPIFHKSGTSIPSPVAYL

SEQ ID NO: 136970 - protein, 58 aa, Glycine max
  Coding DNA Sequence Number=SeqID_45285
  Gene Ontology: Mol. function=nucleic acid binding
  Homolog annotation: Hit_ID=A5C693; Match level="QueryCoverage=100%, HitCoverage=27%, E-value=1e-12, Identity=60%"; Hit description =Putative uncharacterized protein
MTGDASKFTHISPKKNRHVTYGDNNKGRILGVGKIGTNSSSSIENVLPVEGLKHSLLS

SEQ ID NO: 136971 - protein, 60 aa, Glycine max
  Coding DNA Sequence Number=SeqID_45286
MASKTVNRVDSVDDIEFMEDEEEARVEPKPNAKENKSDNDEKESKKVKEHIGVWFAETSW

SEQ ID NO: 136972 - protein, 108 aa, Glycine max
  Coding DNA Sequence Number=SeqID_45287
MATISLLSRYGRWCLASDVQQATFVVDLGVDFVHDWVFLASRVPCRNDSNNMGFSLLLDASSIGACRPRILSSMDSFASWKINGSGMEKEERKEMPLQGEDESRRGRE

SEQ ID NO: 136973 - protein, 156 aa, Glycine max
  Coding DNA Sequence Number=SeqID_45288
  Homolog annotation: Hit_ID=A7PS46; Match level="QueryCoverage=69%, HitCoverage=26%, E-value=8e-21, Identity=50%"; Hit description =Chromosome chr14 scaffold_27, whole genome shotgun sequence
MDMLCFECIGQHKIEIPQELPIHLLDQLRKTVLHDPYKKHQARIKLKKSYSHRLGDVSFSSSWFYAELRLPEMIVDETTAATFLNLVAYEMCPDFRNNYEICSFVDFMDSLIDHPGDVKELRSAKILLNALMSKEVAKIFNFVSTYLVSNMKGYSL

SEQ ID NO: 136974 - protein, 105 aa, Glycine max
  Coding DNA Sequence Number=SeqID_45289
MGNLVFEIVRPAPSPRSICFNKNHTGVDLIQSKPLELATYPFNDFGTGRSQTGMCIIDIGDLSIEKIHRPETKRKKGRSVWEVRSSLDISSSVKNCRCENTETKG

SEQ ID NO: 136975 - protein, 52 aa, Glycine max
  Coding DNA Sequence Number=SeqID_45290
MGAKYLEVVKRGSHPNNGWSPDEIRVDKRRALAPTYPPSKRKSDLRSSSKRQ

SEQ ID NO: 136976 - protein, 400 aa, Glycine max
  Coding DNA Sequence Number=SeqID_45291
  Homolog annotation: Hit_ID=Q6WAY6; Match level="QueryCoverage=73%, HitCoverage=61%, E-value=2e-33, Identity=30%"; Hit description =Putative uncharacterized protein
MGTNQTGKRFYQVKVKSPDTTSIKELGRLMEPLQMQAFRKTYGKILELTIAEVSIEAIASLTQYYDQPLRCFTFGDFQLVPTIEEFEEILGCPLGGRKPYLSSGWLPSLSRIATVVKDSARGLDRIKQTRNGIAGLPQKYLEDKARGMANQGEWVPFMDVLALLIFGVVLFPNVDGLVGLAAIDAFLAYHHSKESPVEVEQSVGSPRWKEGKGGVLFSCGRYPNIPLVGTRGCINYNPTLAIRQLGYPMRGAPTEESMSPFLVRDLGAQNSKTIQRIHKAWETPLRKDQELRGVRNGIIGGYHEWLKVRIRGLDWLAKLKVVSEENFEAPEEDEEVQALKSELGKAKLAKEKFKLVATHVRKECAGLREENAITARALEQETKRARKEEYGRNKFRGALW

SEQ ID NO: 136977 - protein, 27 aa, Glycine max
  Coding DNA Sequence Number=SeqID_45292
MGKSLKVGEDEWRKRERRNTKFCTSNE

SEQ ID NO: 136978 - protein, 81 aa, Glycine max
  Coding DNA Sequence Number=SeqID_45293
MSSIVCGDCARKTPSGPEEGQQGLGVASSKYGSLSVLGSACRPQQGHQAPLLIELSSRSTAPPGRPRAKHHSNIGMAGSRQ

SEQ ID NO: 136979 - protein, 197 aa, Glycine max
  Coding DNA Sequence Number=SeqID_45294
  Homolog annotation: Hit_ID=Q8S8M1; Match level="QueryCoverage=58%, HitCoverage=11%, E-value=1e-07, Identity=30%"; Hit description =Putative retroelement integrase
  Pfam annotation: Domain name=zf-CCHC; Domain location=133-150; Score =22.3; E_value=0.00063; Accession=PF00098.14; Description=Zinc knuckle
MSHHSSSVNGKGTSHKDPLSRILDELSSLKLWKEKLERKEKGKEMTSLHTRRKGKESLKEANINLPYFHGKDNVEANLDWEIRVEQQLKRKSTSKSYGSHSYPKKDQGQGIFGGKTIEKQPLKASMQEKTSSMKCFKCLGRGHITSQCPSKKTIIMRGQDIYSSQDEATTSPSSSKRKKQKGKNLVKRSPPKRKDIL

SEQ ID NO: 136980 - protein, 60 aa, Glycine max
  Coding DNA Sequence Number=SeqID_45295
MRILKLAKYSLKAQVEKDKAPEWRRMKAQVEKDEGPEAETLSRLLIVAEGPDEFEGPNTL

SEQ ID NO: 136981 - protein, 160 aa, Glycine max
  Coding DNA Sequence Number=SeqID_45296
MCPVVGFGPWLGLGKPLVEILPPGQLRGFCPLLAWLGSAVLGYGPVLSFGLVGPPPPPQKSLLPGFCQLWLAPRWLSLCLGGGSSCHNMARHKAQGGGGAWSSVRPGTHLVSTRQAKRERADERVCCDLEGRDESKRQGLNLSGSWQQGHSATYNTPSRI

SEQ ID NO: 136982 - protein, 118 aa, Glycine max
  Coding DNA Sequence Number=SeqID_45297
MENFTKQSLRIAPNSKVGDTWPKTQFMGLRKRLRMENCTKQSPTHGTKLEGGGHMNENAIHGAPKKVENGELHKAITTHGSKLEGGGRMNKNAIHGAPKSLRMENCTKQSLPMDPNLK

SEQ ID NO: 136983 - protein, 99 aa, Glycine max
  Coding DNA Sequence Number=SeqID_45298
MVMGDFISGLSFPGYVGARASLLSTTPPFDAITQELVARGDTLRLSAPRHSVTPSVIDEQRPMWSSGLFRRCQHFPMETFQVSQVIKNYVGLNSSLEDT

SEQ ID NO: 136984 - protein, 210 aa, Glycine max
  Coding DNA Sequence Number=SeqID_45299
  Gene Ontology: Mol. function=helicase activity; Biological process =viral genome replication
  Homolog annotation: Hit_ID=Q9LTU4; Match level="QueryCoverage=73%, HitCoverage=10%, E-value=6e-45, Identity=52%"; Hit description =Helicase-like protein
MLDENNVHAKSFRMARDRLSDTQVHSVGLKLIVGREKDGRTPNEGQTLLHSRKLFQQFVAEGYTMIESERLSYVRNNQKKLRVDNFCSLQQSSEAGNIEGLGQGKRIILPSTFVGSPRYMDQLYFDGIAICSHVGFPNLFITFTCNPNWPEIHRLLTPLNLTSIDKPEIISRIFKLKYEQMLSDLTKNHLLGKVVACKLMLIPICSATNR

SEQ ID NO: 136985 - protein, 101 aa, Glycine max
  Coding DNA Sequence Number=SeqID_45300
MDHFKCLKESMTMLTKLSCPVNGESNLRTNPSQEGQNDEDMTKSKGKDPLEGLGGPMTRARARKAKEALQQVLSILFEYKPKFQGEKSKVVSCIMAQMEED

SEQ ID NO: 136986 - protein, 188 aa, Glycine max
  Coding DNA Sequence Number=SeqID_45301
  Gene Ontology: Mol. function=DNA-directed RNA polymerase activity; Cellular component=flagellin-based flagellum; Biological process =regulation of transcription, DNA-dependent
  Homolog annotation: Hit_ID=O85807; Match level="QueryCoverage=100%, HitCoverage=96%, E-value=1e-105, Identity=100%"; Hit description =Flagellar transcriptional activator flhC
  Pfam annotation: Domain name=FlhC; Domain location=1-187; Score =513.1; E_value=3.2e-151; Accession=PF05280.2; Description=Flagellar transcriptional activator (FlhC)
MVEKSIVQEAKDIQLAMELISLGARLQMLESETQLSRGRLIKLYKELRGSPPPKGMLPFSTDWFMTWEQNIHSSMFYNAYLFLMKSGQCSGVEAVIKAYRLYLEQCPQQAGEAPLLALTRAWTLVRFVDSGMLQLSACSCCGGAFITHAHQPLNGFICSLCQPPSRAVKRRKLSPQLADIIPQLLDEQ

SEQ ID NO: 136987 - protein, 144 aa, Glycine max
  Coding DNA Sequence Number=SeqID_45302
  Subcellular localization annotation: CTP_CleavageSite=12; ConfidenceScore=5.09e-01
QLSGPCLAKPPMASRKRKSIGSRPTAQYDTRRFSSLDAWTRYTDNFLGRNILPERKVEIYHSELDEFKAELERRNFHKRLTNLVDGSIDLALIDAGNLNIFLETPVVLVEGETLPAYSRYCRLPTNYRETEATLFIPGRGFKMQ

SEQ ID NO: 136988 - protein, 64 aa, Glycine max
  Coding DNA Sequence Number=SeqID_45303
MEDCLEGPHLGNHESIAPNSKAIMKHSSKLKGGGHMNSARHNIHGAPKKGRMEDCLEGPALRQS

SEQ ID NO: 136989 - protein, 298 aa, Glycine max
  Coding DNA Sequence Number=SeqID_45304
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLGPGIPRTDHRTLPVVRSPPLHLSKVIRPPITQAFVEKYCTQRQAQGDAPQAAGGPPPPHQAGQAGAFDMEQYLRHLVLQQAANHRAHVQTHDCLYQMSLSMQSQGFASFSCPTPDQFRAEVAWPGDWPEAQAGEAPPEAPDDGKEAHEDEEMADLLDFLGGSGDT

SEQ ID NO: 136990 - protein, 177 aa, Glycine max
  Coding DNA Sequence Number=SeqID_45305
MIMRGQDIYSSQDEATTSPSSSESEEVKGEESSEEIYPQEERQPLMVKEECKEVSVSSKRLAKKESHFEIKTNIKETSPLGQPPHLLLCKKTLVSTVTPLGLEVIPHVKELLDEGLVRVKGRSPKYEEPQVLRSNPFQGGGDDAILPPRVLDRRLQEDWDRAAKEGPRVLMNLKVDF

SEQ ID NO: 136991 - protein, 31 aa, Glycine max
  Coding DNA Sequence Number=SeqID_45306
MTGDASKFTHISPKNNGHVIYGDKNKGELLI

SEQ ID NO: 136992 - protein, 280 aa, Glycine max
  Coding DNA Sequence Number=SeqID_45307
  Gene Ontology: Mol. function=secondary active sulfate transmembrane transporter activity; Cellular component=outer membrane-bounded periplasmic space; Biological process=sulfate transport
  Homolog annotation: Hit_ID=P0AG78; Match level="QueryCoverage=100%, HitCoverage=85%, E-value=1e-143, Identity=88%"; Hit description =Sulfate-binding protein precursor
  Pfam annotation: Domain name=SBP_bac_1; Domain location=1-223; Score =18.6; E_value=0.00038; Accession=PF01547.16; Description=Bacterial extracellular solute-binding protein
ETGDNVVIRQSHGGSGKQATSVINGIEADVVTLALAYDVDAIAERGRIDKNWLKRLPDNSAPYTSTIVFLVRKGNPKQIHDWNDLIKPGVSVITPNPKSSGGARWNYLAAWGYALHQNHGDQAKAQEFVKALYKNVEVLDSGARGSTNTFVERGIGDVLIAWENEALLATKELGKDKFEIVTPSESILAEPTVSVVDKVVDKKGTRQVAEAYLKYLYSPEGQEIAAKNFYRPRDPDVAKKYANEFPKLKLFTIDQEFGGWTKAQKEHFSNGGTFDQISQR

SEQ ID NO: 136993 - protein, 83 aa, Glycine max
  Coding DNA Sequence Number=SeqID_45308
MNTRIKIHETKCGPPRQNRGEACHPARPGEQGCFLQKQQPSGGIFWRAQLSKKLRKLTDCAKTPLFDFRHITEFHGSRKPASF

SEQ ID NO: 136994 - protein, 25 aa, Glycine max
  Coding DNA Sequence Number=SeqID_45309
MELPTITTYPSVLSPHAPITRDGSL

SEQ ID NO: 136995 - protein, 135 aa, Glycine max
  Coding DNA Sequence Number=SeqID_45310
MVLRASHVNLMIAFAMHKHKYASLQKLGKECALRCPYRTRARARVMSEIEKVQEWMKADMEAMKEQMATMMEAMKEKMPTMMEAMMSMKKVMEVNVAAVAATNVFVEVDPTPPSGFNQMNYPTSDMVGQGGNELG

SEQ ID NO: 136996 - protein, 163 aa, Glycine max
  Coding DNA Sequence Number=SeqID_45311
MPISPCRCIGWDRAHKTPSGPEEVQQGPGVSSSGYGPLNRTHKDTQWTRRSPTGPWGFQLWLRASVVLQDARSPWQGHIIIGIAPAKHPVDPKKSNRVLDCQALIRGLSRASGPLLIELSSRSTASPGRAQGETPQQPGDGRQRATDAPPSPLEFTSAHPQKG

SEQ ID NO: 136997 - protein, 146 aa, Glycine max
  Coding DNA Sequence Number=SeqID_45312
  Homolog annotation: Hit_ID=A5B3J2; Match level="QueryCoverage=97%, HitCoverage=25%, E-value=3e-08, Identity=29%"; Hit description =Putative uncharacterized protein
MHRSPTGNLVPLDLEIKATLRRNKAERRRKLLQVKTVASILEEETHFFNSLSPNSPSSKESATQLPEIASMADKQHHRITLKDYSSSSVPQFFTSTARPEVQAHNINYPYSLIHLIQENLFQGLPNEDPYAHLATFIEICNTVKIA

SEQ ID NO: 136998 - protein, 175 aa, Glycine max
  Coding DNA Sequence Number=SeqID_45313
  Subcellular localization annotation: CTP_CleavageSite=61; ConfidenceScore=5.37e-01
MTLLLTTFCPATTLPISPCKSISWSVSSRRGDRTHKDTQWTRKSKQGPGVSSSGYGPLLVLQGARTPPARSRHHRDRACKTPSGPEESPTGSWSCQALITGLCQFYGVPVTSSKGISPPTNRAFNQEVLRPQAGAGRSTIAALGWPVAGNRHTATTSKVHLSSSIKRLERCLRHM

SEQ ID NO: 136999 - protein, 50 aa, Glycine max
  Coding DNA Sequence Number=SeqID_45314
MGHLSDQGVPTDPKRIKVIPNWPTPPSIREIWGCHDLNFYKRCRGKEPRE

SEQ ID NO: 137000 - protein, 161 aa, Glycine max
  Coding DNA Sequence Number=SeqID_45315
MKENHFAKKGDIKRALLLKQSFYLLLSRETSLSTAIPLELEVIPQVKELLDEALVRKSLNPCALLVPKIGIIRHQIPMIGGMMNVLSGATLFRKITRAPNIFMIYVHRDSLGNNQHGNKEKGMFYSISFHNFLNNDQGLPMEPKRIKVLREKAQSFKNLGI

SEQ ID NO: 137001 - protein, 122 aa, Glycine max
  Coding DNA Sequence Number=SeqID_45316
MASRKRKSIGSRPTVQYYTRRFSSLDAWTRYTDNVLGINILPERKVEIYHIELDEFKVELERRNFHKRLTNLADGSIDLALVKEFYANLYSSEDHSPKQSRVKGHLVKIDADSLNTFLETHV

SEQ ID NO: 137002 - protein, 55 aa, Glycine max
  Coding DNA Sequence Number=SeqID_45317
AFQLAIVPEIAISPSSSLELVLGPKGNGVVDSFSTPAVADVESERWDSRLIGCFR

SEQ ID NO: 137003 - protein, 16 aa, Glycine max
  Coding DNA Sequence Number=SeqID_45318
MQNCTKQSLRMAPNSK

SEQ ID NO: 137004 - protein, 52 aa, Glycine max
  Coding DNA Sequence Number=SeqID_45319
MLLIPHDVAPCGACRPWIFLINEVLCFLNPLIQDQVQDSPLSVLRCHEACKA

SEQ ID NO: 137005 - protein, 182 aa, Glycine max
  Coding DNA Sequence Number=SeqID_45320
MTSRLLAGSLTFDNRIMHYIIVRILLPQSSNLAQASEEDLILMFTGPQIDWAHLVRYQMHKALRANAPLPYPQLVTLFLRHFQIPLDDEPFVQVKRFFAIGTGVVTSFGYRKDRNGQWLKKDALPSQDERTPSPPPQRDDSALMTEVLSELRGLRTYVGEHFDSLDNRFAGMDIRLTQLEED

SEQ ID NO: 137006 - protein, 85 aa, Glycine max
  Coding DNA Sequence Number=SeqID_45321
  Gene Ontology: Biological process=transposition, DNA-mediated
  Homolog annotation: Hit_ID=Q1J7G7; Match level="QueryCoverage=38%, HitCoverage=47%, E-value=7e-12, Identity=100%"; Hit description =Transposase
MVKVGTSYVPINVSVSPKVGPGLPGINRDTRIYLFCEVLQWLLFLSAVPPVQLLTGWCVTAKAPPDISAGKCSGHAARNHHTRRA

SEQ ID NO: 137007 - protein, 93 aa, Glycine max
  Coding DNA Sequence Number=SeqID_45322
NEDKGYVGVCELSWRWATGDGGLYVICGCGESFCTIARPPPSTTCNGVIPGDMSRGSGDLGDVRIWPLVIDYQGLRNGTGRLWRPLVIDYQSV

SEQ ID NO: 137008 - protein, 82 aa, Glycine max
  Coding DNA Sequence Number=SeqID_45323
DRELRGSSNGIIGDYHKWLRVRTQGLDWLPNLKTVRDDEVKASEESDEGLYRAAIVSSSSEEVKGIITGQRHDLEGRAKGLP

SEQ ID NO: 137009 - protein, 120 aa, Glycine max
  Coding DNA Sequence Number=SeqID_45324
  Gene Ontology: Mol. function=DNA binding; Biological process =regulation of transcription, DNA-dependent
  Homolog annotation: Hit_ID=A8GHU8; Match level="QueryCoverage=100%, HitCoverage=96%, E-value=8e-55, Identity=85%"; Hit description =Transcriptional regulator, HxlR family
  Pfam annotation: Domain name=DUF24; Domain location=20-109; Score =84.6; E_value=3.2e-22; Accession=PF01638.8; Description =Transcriptional regulator
  Pfam annotation: Domain name=MarR; Domain location=25-90; Score=-2.9; E_value=0.069; Accession=PF01047.13; Description=MarR family
  Pfam module annotation: Pfam domain module=DUF24::MarR; Domain location=20-109::25-90
MDKTDVVYRADCPSRIVLDQIADKWSMMVLEVLREPQRFNAIKRRLDGVTQRVLTQTLRKLERNGMVHRKVLDGRVLGVEYSLTPLGKSLQGPFSILFDWTLGNIEAIQECQRKYDEQDE

SEQ ID NO: 137010 - protein, 138 aa, Glycine max
  Coding DNA Sequence Number=SeqID_45325
MDRSRLVYGLVTDMDMNIGALISGQISFIAQSNSSRLRFLALFTALYRARGVTSDSLTYESLSPAINLAYIKKNCGNLGDLIVNFKGARKVRARPADVPSSSTPPAPSTYVTPTPALPGPSTQISQHLESMLQSLFQG

SEQ ID NO: 137011 - protein, 146 aa, Glycine max
  Coding DNA Sequence Number=SeqID_45326
  Pfam annotation: Domain name=Transposase_23; Domain location=45-115; Score=-9.3; E_value=0.012; Accession=PF03017.5; Description =TNP1ENSPM transposase
MQSRFQSQMQSQGLAQPPELEVGPSAARVNTKETCVDPSGNDPDTGDSDKCGLYIEENPPRLVALGRVYEGSTTIHNIPLLHDQVKVGVEEVRDANAPILVPIEEVKLVGQALNTFLAWSTHLVKHLSEQVMWDATVFGVFNEDFP

SEQ ID NO: 137012 - protein, 102 aa, Glycine max
  Coding DNA Sequence Number=SeqID_45327
MGEVEEVQEQMKANIEALKEQMATMIKAMMSIKEIIKVNATAIATTSTIVELGGMGGPHYVQIQNKHAFPPYGLPPNYTPPNVAYTPIEDVNNSTPILIESQ

SEQ ID NO: 137013 - protein, 233 aa, Glycine max
  Coding DNA Sequence Number=SeqID_45328
  Gene Ontology: Biological process=transposition, DNA-mediated
  Homolog annotation: Hit_ID=Q1J7G7; Match level="QueryCoverage=17%, HitCoverage=71%, E-value=6e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIGLHNIGGARYQLLFPLVRVNFELGVIMVIAVSFGKPVVPAALMNRPTRGERRFAYWALAECILAYYVGTDEGVSEVLHVAGEKRLH

SEQ ID NO: 137014 - protein, 76 aa, Glycine max
  Coding DNA Sequence Number=SeqID_45329
MVEEQNDKTTLTSNEDIPVKGLPEKRDGCDKKEVSLEEASEFLRIIQQSEFKVIEQLNKTPARVSLLELLMSSEPH

SEQ ID NO: 137015 - protein, 140 aa, Glycine max
  Coding DNA Sequence Number=SeqID_45330
  Gene Ontology: Mol. function=transcription elongation regulator activity; Biological process=regulation of transcription, DNA -dependent
  Homolog annotation: Hit_ID=P64274; Match level="QueryCoverage=100%, HitCoverage=88%, E-value=4e-71, Identity=92%"; Hit description =Transcription elongation factor greB
  Pfam annotation: Domain name=GreA_GreB; Domain location=63-138; Score= 151.7; E_value=2e-42; Accession=PF01272.10; Description=Prokaryotic transcription elongation factor, GreAGreB, C-terminal domain
  Pfam annotation: Domain name=GreA_GreB_N; Domain location=1-57; Score= 101.6; E_value=2.4e-27; Accession=PF03449.6; Description=Prokaryotic transcription elongation factor, GreAGreB, N-terminal domain
  Pfam module annotation: Pfam domain module=GreA_GreB::GreA_GreB_N; Domain location=63-138::1-57
MDFLWREERPEVTKKVTWAASLGDRSENADYQYNKKRLREIDRRVRYLTKCLENLKIVDYSPQQEGKVFFGAWVEIENDDGDTLRFRIVGYDEIFGRKDYISIDSPMARALLKKEVGELAVVQTPAGEASWYVNEIVYVK

SEQ ID NO: 137016 - protein, 99 aa, Glycine max
  Coding DNA Sequence Number=SeqID_45331
MINALEKGYYANGTTTKVKKIIEDVAASECGRDCNRTSPKDVPKEVIENESVKQQTQVKAMMESVTQSIVKQLQSLIPPKQPILSSEECGDNFHTSWRK

SEQ ID NO: 137017 - protein, 81 aa, Glycine max
  Coding DNA Sequence Number=SeqID_45332
MHSNKHHRHNSVVSGINVDIVATCPFAGERGRGSRVRFPKEERCAESPPTFICEKRRKNRRKPVIEAVPESNKHENAVTRK

SEQ ID NO: 137018 - protein, 63 aa, Glycine max
  Coding DNA Sequence Number=SeqID_45333
  Subcellular localization annotation: CTP_CleavageSite=38; ConfidenceScore=5.11e-01
MKKVGTSYVPINVSSSPQVGPGPPAVPPVQLLTGWCVTAKAPPDISAGKCSGHAARNHHTRRA

SEQ ID NO: 137019 - protein, 254 aa, Glycine max
  Coding DNA Sequence Number=SeqID_45334
  Homolog annotation: Hit_ID=A5ATL8; Match level="QueryCoverage=22%, HitCoverage=45%, E-value=8e-19, Identity=82%"; Hit description =Putative uncharacterized protein
RTPFEYEAPGYKLCLGMEENSESALSTNKEAISNATRNLMESSILAQDERWRHALHMLVGREVAEEQKEESARGGGSPTLGLRHGPDSYGRQQWGIFRNGRKPDGAMPREGRRPTVRRQIPGLNPGQAVETTKLEYETKARGANGIRYPSSPSRKRWILGAVRIDPCNAVANALSIPPGEYRRTLPGLDMPRILLKERGAFGNADTGGAWLSSARATAGDKPEEGEDDVKSSCPLCPGRHTCYNGRDKGSRSRE

SEQ ID NO: 137020 - protein, 86 aa, Glycine max
  Coding DNA Sequence Number=SeqID_45335
MMTRSKRFVEAEDKDSVVQKKKTADKKGTDCKKNEVRESKNEFKIESRTLQSSKGNLNSRIKNQVSRFKFQESRSRFKNQEKTQSR

SEQ ID NO: 137021 - protein, 116 aa, Glycine max
  Coding DNA Sequence Number=SeqID_45336
  Gene Ontology: Mol. function=aspartic-type endopeptidase activity; Cellular component=chromatin; Biological process=chromatin assembly or disassembly
  Homolog annotation: Hit_ID=Q55HB8; Match level="QueryCoverage=64%, HitCoverage=5%, E-value=2e-10, Identity=41%"; Hit description =Putative uncharacterized protein
MYYSITFLNFLNSDQGLPMNPKRIKVIPEWPTPPSIRGIWGFNILTNFYKKFVPYFSILVAPLIELVFEERIHEFQEPLDLRSNPFQGGGNDAILPPQGHCIEDSKKIGPKMQEKA

SEQ ID NO: 137022 - protein, 46 aa, Glycine max
  Coding DNA Sequence Number=SeqID_45337
MKGNQQRVPSGVANCRNLPFGGRATRDSRDACSTKGVRAESPPTFI

SEQ ID NO: 137023 - protein, 133 aa, Glycine max
  Coding DNA Sequence Number=SeqID_45338
TDKRKRSIALKASSSIQQEEEDEEDFSLFVKKFHGLVKKRRIEWRQNFNHGKRFQEDSTTLRCYKRNQLGLIKANCPSNKQWPEKNEKKSHEERRFKKAYIAWDDNDSSDGSEKEINLLYKDYESNKNISQED

SEQ ID NO: 137024 - protein, 602 aa, Glycine max
  Coding DNA Sequence Number=SeqID_45339
  Gene Ontology: Mol. function=glucose-1-phosphate adenylyltransferase activity; Cellular component=chloroplast; Biological process =glycogen biosynthetic process
  Homolog annotation: Hit_ID=A6E6K9; Match level="QueryCoverage=63%, HitCoverage=90%, E-value=1e-109, Identity=52%"; Hit description =Glucose-1-phosphate adenylyltransferase
  Pfam annotation: Domain name=Glycos_transf_1; Domain location=74-249; Score=32.3; E_value=1.8e-06; Accession=PF00534.11; Description =Glycosyl transferases group 1
  Pfam annotation: Domain name=Hexapep; Domain location=498-515; Score =11.2; E_value=3.8; Accession=PF00132.15; Description=Bacterial transferase hexapeptide (three rep
  Pfam annotation: Domain name=Hexapep; Domain location=557-574; Score =15.2; E_value=0.26; Accession=PF00132.15; Description=Bacterial transferase hexapeptide (three rep
  Pfam annotation: Domain name=NTP_transferase; Domain location=208 -451; Score=91.6; E_value=2.5e-24; Accession=PF00483.14; Description =Nucleotidyl transferase
  Pfam module annotation: Pfam domain module=Glycos_transf _1::Hexapep::Hexapep::NTP_transferase; Domain location=74-249::498 -515::557-574::208-451
MIKCAHAFTTVSEGYLEELFISFRGLESLVREEFGKAYGIINGIDTEVWNPETDPMLDYNFSIEDAVEQKKKSKAKLCKEYGLKPELPLFAFIGRFATEKGADLLPDVVWRSIRQSYGALNVIILGSGNRYIEDKLKEYEHLYSNFALDLGYKEYLSHKIYASADFLLMPSRVEPCGLNQMYSMRYGTVPIVRYTGGLKDTVQDISTGGAGLNFSYPGVDDVIHAMNRGMHIYYQKGVMEDLITANMQFDFAWEKSAENKGFVDILAAEQNVENESWYQGTADAVRQSMKHLEKYDYDYILILSGDQLYQMDFREMLDYHIKKGGDVTIATIPVNAKDATGFGILKSDDEGNITSFVEKPGMDILGDWKSEVSDHNKHEGKEFLASMGIYIFTKSILKKMFDEGAGDDFGKDIIPNSIGKYATLSYQYEGYWTDIGTIESFYEANIDLCQDFPQFNLFSSSPIYTRARMLPPSKINGSYVSKAVFGDGCIIMADKIENSVIGNRTRIDKGSTIVNSYVMGSDFYQNTTEIVMNDRNGRPNMGIGKYCYIEKAILDKNCYIGDNVRIIGGKHLQDGDFGTHSVQDGIVVVKKGAILPPGTHIG

SEQ ID NO: 137025 - protein, 294 aa, Glycine max
  Coding DNA Sequence Number=SeqID_45340
  Gene Ontology: Mol. function=catalytic activity; Cellular component =intracellular; Biological process=protein metabolic process
  Homolog annotation: Hit_ID=Q01ZL3; Match level="QueryCoverage=64%, HitCoverage=54%, E-value=1e-52, Identity=50%"; Hit description=ATP -dependent carboxylate-amine ligase domain protein, ATP-grasp
  Pfam annotation: Domain name=Peptidase_M17; Domain location=3-110; Score=-197.4; E_value=0.0025; Accession=PF00883.12; Description =Cytosol aminopeptidase family, catalytic domain
MFGDTCGALFSNNEEVKNLLLQTGDRTNQRLWNLPLWDVWKEDIQSDVADLKNISLKPIGDCIVAAKFLEQFIENHPKWAHLDIAGVAFGSVGYAKEKAATGFGGYDFMDEMKMLGNKIILITSENIREKNWPWHAIDETRKIDAVVALDDYDVEKAALIRETFRIPGMGQTTHRYFRDKLAMRQKAKDSGINVPEFTAVFNNDEVNTFIENVPAPWVLKPRSEASASGIKKITSKEQLWEALNELGEERHLFLLESFKPGDVFHVDSLTFDKEVVFTSASQYLAPPMQVSHEG

SEQ ID NO: 137026 - protein, 176 aa, Glycine max
  Coding DNA Sequence Number=SeqID_45341
  Homolog annotation: Hit_ID=A5B939; Match level="QueryCoverage=36%, HitCoverage=52%, E-value=7e-20, Identity=63%"; Hit description =Putative uncharacterized protein
LPTLETAQPEVGSSGWKSTARRVVSGAPPAALENPEDRVPPTPGRTHNRIRSPRAGHGGPSPEPVGCRWTARAASAARAGRRVPVGGRIGNGPFGASSPGVEQSTQNCALNVKVKKFNPSAGKRRDETTAKGTGLAESAGKEDPVELDSSPTFGALPLFLDPRSASAGRSGRKTLS

SEQ ID NO: 137027 - protein, 107 aa, Glycine max
  Coding DNA Sequence Number=SeqID_45342
  Subcellular localization annotation: CTP_CleavageSite=71; ConfidenceScore=5.24e-01
MAPTRHPLDPDKSNRALGFPALITGLCQLFGVPVAPSKLSLSLQSQGFTSFSCPTPDQFRVEVAWPGDWPEAQAGGAPAEAPDEADEAREDEEITDLLDFLGGGGAT

SEQ ID NO: 137028 - protein, 305 aa, Glycine max
  Coding DNA Sequence Number=SeqID_45343
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPEVNIWYPKTQRWDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137029 - protein, 281 aa, Glycine max
  Coding DNA Sequence Number=SeqID_45344
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMTKSNASSDGMGSGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137030 - protein, 152 aa, Glycine max
  Coding DNA Sequence Number=SeqID_45345
DKEPKQVRVRGHLIKFDADSLNTFLKTPVVLEQGESLPSYSRFYRLRPDPQELAAWLCIPGRGCVLNVEGLPWKLLRKDLTTLAQTWSVLSYFNLAPTSHTSDLNLDRARLVYGLVMKMDMNIGALISRQISLIAQSNSSRLGFPGLITALC

SEQ ID NO: 137031 - protein, 97 aa, Glycine max
  Coding DNA Sequence Number=SeqID_45346
  Gene Ontology: Biological process=transposition, DNA-mediated
  Homolog annotation: Hit_ID=Q1J7G7; Match level="QueryCoverage=39%, HitCoverage=54%, E-value=9e-14, Identity=92%"; Hit description =Transposase
MVKVGTSYVPINVSFLPKVGPGLPGINRDTRIYLFCEVIFRHSQLTDLVYDGVFEVLQWLLFLSAVPPVQLLTGWCVTAKAPPESSLSIPSTSRGGP

SEQ ID NO: 137032 - protein, 62 aa, Glycine max
  Coding DNA Sequence Number=SeqID_45347
MRPDNYLKGIINSALKELEDTPQPKFKAGARWIVVKYFNDVRPLEAERLKALRIQWTTTLKE

SEQ ID NO: 137033 - protein, 48 aa, Glycine max
  Coding DNA Sequence Number=SeqID_45348
MAGENGRTARKPHYKRNLKESWASSLKGNNTRKSSLPWNSNRKMQNET

SEQ ID NO: 137034 - protein, 78 aa, Glycine max
  Coding DNA Sequence Number=SeqID_45349
PYQVTWDATVFGVFNPDFPLYIKHEDLSEIEHRGQCLSISVLQLPDNYLKGIINSALKGLDDAPQPKSKAPARWIVVK

SEQ ID NO: 137035 - protein, 284 aa, Glycine max
  Coding DNA Sequence Number=SeqID_45350
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSITCGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137036 - protein, 80 aa, Glycine max
  Coding DNA Sequence Number=SeqID_45351
  Homolog annotation: Hit_ID=A7P023; Match level="QueryCoverage=41%, HitCoverage=14%, E-value=3e-08, Identity=66%"; Hit description =Chromosome chr6 scaffold_3, whole genome shotgun sequence
MWALERCTTLAPKRTPPIIENKPLGHSMAWCAVVPLICFHVVEGHQPDRVLRQFGMQQPIPRVSFATTECPWANIERQTR

SEQ ID NO: 137037 - protein, 54 aa, Glycine max
  Coding DNA Sequence Number=SeqID_45352
  Subcellular localization annotation: CTP_CleavageSite=14; ConfidenceScore=5.18e-01
MAESSKKRKGSSASASASRDHRSETNSASTAPIPPSLSSSTLFSSEEQQKWIAL

SEQ ID NO: 137038 - protein, 44 aa, Glycine max
  Coding DNA Sequence Number=SeqID_45353
MPTTQNIAAGKVPPVAIIISHQNLGGDLFSFISIYPMNIGSTSL

SEQ ID NO: 137039 - protein, 52 aa, Glycine max
  Coding DNA Sequence Number=SeqID_45354
MHIHGEDHNGKGDGNDEDFHIDETKTSVDLPREWRTSRYHPLDNIIGDISKG

SEQ ID NO: 137040 - protein, 110 aa, Glycine max
  Coding DNA Sequence Number=SeqID_45355
MAEELRRVALEDYSSSTYQQQRQWQNHPGNQFNRDQGGSSTRPQQQVPSLYDKTTKLEETLAQFMQVSMSNQKSTESAIKNLEVQVGQLAKQLAERSSNIFTTNTVGCDD

SEQ ID NO: 137041 - protein, 163 aa, Glycine max
  Coding DNA Sequence Number=SeqID_45356
MGDQEEVQEQMKVDMLALKEKMASIMDAMPGMRQLMENNAATATVVSSAAEADPTLLAIAHHPIPNVVGRERSALGYISNPHPGYNRVAYPYGLPPNYTPPVIRDDTGHVLNPILEGEPPRQSDEVHEDRQEHAQGDIESYSPFPVEGPAPNTLPQPNLTGEP

SEQ ID NO: 137042 - protein, 31 aa, Glycine max
  Coding DNA Sequence Number=SeqID_45357
SPIGNLVPLDFEIEVMLRRNRAERRRKLLQD

SEQ ID NO: 137043 - protein, 266 aa, Glycine max
  Coding DNA Sequence Number=SeqID_45358
  Gene Ontology: Mol. function=iron ion transmembrane transporter activity; Cellular component=periplasmic space; Biological process =high-affinity iron ion transport
  Homolog annotation: Hit_ID=A4W7X5; Match level="QueryCoverage=100%, HitCoverage=83%, E-value=1e-132, Identity=90%"; Hit description =Periplasmic binding protein precursor
  Pfam annotation: Domain name=Peripla_BP_2; Domain location=35-266; Score=126.0; E_value=1.1e-34; Accession=PF01497.9; Description =Periplasmic binding protein
  Subcellular localization annotation: CTP_CleavageSite=48; ConfidenceScore=5.07e-01
LTSAIAADWPRQVTDSRGVHTLESKPTRIVSTSVTLTGSLLAIDAPVVASGATAPNNRVADAQGFLRQWGDIAKQRKVARLYIGEPSAEAVAAQMPDLILISATGGDSALALYDQLSAIAPTLVINYDDKSWQELLTQLGTITGQEKQAAARIAAFDKQLAQVKQQMTLPPQPVNAIVYTAAAHSANLWTAESAQGKLLHQLGFTLADLPAGLHTSKSQGKRHDIIQLGGESLATGLNGEGLFVFAGDEKDVEAIYANPLLAHLPA

SEQ ID NO: 137044 - protein, 83 aa, Glycine max
  Coding DNA Sequence Number=SeqID_45359
AEAYAANIYNRPPQPQQQNQPQQNNYDLFSNRYNPGWRNHPNLRWSNPSQQQQQQQQQQTHFQNVAGPNRPYAPPPIQQQQQQ

SEQ ID NO: 137045 - protein, 338 aa, Glycine max
  Coding DNA Sequence Number=SeqID_45360
  Homolog annotation: Hit_ID=Q6WAY6; Match level="QueryCoverage=96%, HitCoverage=54%, E-value=6e-41, Identity=33%"; Hit description =Putative uncharacterized protein
MGSSQMPSLKKRFYQVKVKSLGITSLRELGQLMGQLQRQAFHKAYSKIWDLAMVEVSTEAIASLAQYYDQPLRCFTFGDFQLSRMVEEFEEILGCPPRGRKPYLISGFYPSLARISKIVQISAQELDHRKQVENWVFGIPRKCLEAKARILASNGKWALFIDILTLLIFGGVLFPNVDGLVDLAAIDAFLAYHDHKEILVVAMLADLYETFDRRCEKSSTRIVCCTPALYVWLVSHLFRQEVRHACPLESHRSCTEKGRANWDQLLTNREGASVNWFPRWKEGRTGVLISCGGFPNVPLIGTRGCINYNPVLAIRQLGYPMRGAPLEEELAPVISRGF

SEQ ID NO: 137046 - protein, 81 aa, Glycine max
  Coding DNA Sequence Number=SeqID_45361
  Homolog annotation: Hit_ID=Q00M75; Match level="QueryCoverage=74%, HitCoverage=5%, E-value=2e-09, Identity=90%"; Hit description=PPR -repeat containing protein
ASPGAAVKLCLGDLLVMGSNPETASLHMQGASPGAAVKLCLGDLLVMGSNPEIASLHMQGQGCVQYPSPIPSHSEEPRGNG

SEQ ID NO: 137047 - protein, 113 aa, Glycine max
  Coding DNA Sequence Number=SeqID_45362
MDKVDIFVPHPLTNACLLIQLSPECGCKPLVCLLKQPALLSVDFQDRSIRDYSSCTLVGGQPFPCVQESPTTRDPRSLNPFSEIRRREEEVSLKRDGLYNEDQSKLFIEYASG

SEQ ID NO: 137048 - protein, 76 aa, Glycine max
  Coding DNA Sequence Number=SeqID_45363
MCSTSREEYPSTIWFKISPVPIYSVRTCAPQRHLSGPGEVQQGPGDFQLGYGPLDRVCRTPSGPEEVQQGLGVVKL

SEQ ID NO: 137049 - protein, 258 aa, Glycine max
  Coding DNA Sequence Number=SeqID_45364
  Gene Ontology: Mol. function=chloramphenicol O-acetyltransferase activity; Biological process=response to antibiotic
  Homolog annotation: Hit_ID=P62577; Match level="QueryCoverage=84%, HitCoverage=100%, E-value=1e-131, Identity=100%"; Hit description =Chloramphenicol acetyltransferase
  Pfam annotation: Domain name=CAT; Domain location=11-214; Score =528.7; E_value=6.6e-156; Accession=PF00302.9; Description =Chloramphenicol acetyltransferase
AKEAKMEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGAVGLKTIVTRIRRSGRTERGVRAYSPAWSELPTRN

SEQ ID NO: 137050 - protein, 213 aa, Glycine max
  Coding DNA Sequence Number=SeqID_45365
MAHEQKLVEDFAQVYAEKEARGRVIDALHQEATMWMDRFALTMNGSQDLPRLLAKAKAMAEVCTAPEEIHGLINYWRVGTDEGRSIGLKRSNGFHLGGHVKTPKTIEDKATATASSTVREAEPVLQPALNPGLDRNTAVFSRRYSLQAYPYGLPPDFTPRATPEDLSQAPTFEGQLPPYEDYPGQDDGEGDTHLGPLLHLKDLSPHELPQPNI

SEQ ID NO: 137051 - protein, 70 aa, Glycine max
  Coding DNA Sequence Number=SeqID_45366
  Gene Ontology: Mol. function=signal transducer activity; Biological process=G-protein coupled receptor protein signaling pathway
  Homolog annotation: Hit_ID=P49084; Match level="QueryCoverage=85%, HitCoverage=15%, E-value=1e-13, Identity=68%"; Hit description =Guanine nucleotide-binding protein alpha-1 subunit
MGLVCSRSRRFREADAEENAQDAEIERRIKLETKAEKNIQKLLLLGAGESGKSTIFKQARNCIFSTACEL

SEQ ID NO: 137052 - protein, 242 aa, Glycine max
  Coding DNA Sequence Number=SeqID_45367
  Pfam annotation: Domain name=Transposase_23; Domain location=51-114; Score=-7.2; E_value=0.0072; Accession=PF03017.5; Description =TNP1ENSPM transposase
  Subcellular localization annotation: CTP_CleavageSite=22; ConfidenceScore=5.02e-01
MSQRGSLIPTHIQPDIHGLGARVSTKGSNAKSVRNPCLPNDVALVKPPMGLYVQRQDSIELVALGKTYDGGSTIHNVAYADNVVRVSVEQVIDGDAEVPFPTSEIKCVRQALHTFIAWPTPLVKKIFIEHEGSSPTKDTEAVEAVNDVVVDDPLRELIKSLVDIYEKPVELVWDVTKFGIPNATASLFITCADVNEIISGVQCLNIAILQLWTMYMDQLSQSYGLGSVYGFLEPQGYTECKR

SEQ ID NO: 137053 - protein, 149 aa, Glycine max
  Coding DNA Sequence Number=SeqID_45368
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=71%, E-value=3e-24, Identity=68%"; Hit description=LacZ protein
MTCCDPKPILVSVWFVRYFIRYLDSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137054 - protein, 123 aa, Glycine max
  Coding DNA Sequence Number=SeqID_45369
METQLIHDRVVMECLEGVWETLEGNERCRFRGTIRLTATSLVHPEEPARTLQQPVEWILPTPTPYRLVEPLQVIEVSSSEEDPEEDPEELPPEPAVDDLDLPEDDEDPLPDVDSLEDVMSASE

SEQ ID NO: 137055 - protein, 187 aa, Glycine max
  Coding DNA Sequence Number=SeqID_45370
  Subcellular localization annotation: CTP_CleavageSite=56; ConfidenceScore=5.11e-01
MEANAVAVVATSAVAKVNSMPPSGLNQMNHPTSDMHAFPPYGLPPNYTPPNVAYTPSENVNNSTPILIESRQPQTDNAHVSQTMGETHEIPHHNLADFEPCLGYATEGQAVGGIPLQNTLEGPRYHPQPHPLHSTVGKNPHAMVEMGKLDHLEERLRAIEGGEDYAFALLRCRILTITRGLLAPRTI

SEQ ID NO: 137056 - protein, 294 aa, Glycine max
  Coding DNA Sequence Number=SeqID_45371
  Gene Ontology: Mol. function=metalloendopeptidase activity; Cellular component=plasma membrane; Biological process=cell wall catabolic process
  Homolog annotation: Hit_ID=P40827; Match level="QueryCoverage=100%, HitCoverage=76%, E-value=1e-108, Identity=69%"; Hit description =Lipoprotein nlpD precursor
  Pfam annotation: Domain name=LysM; Domain location=33-76; Score=46.2; E_value=1.1e-10; Accession=PF01476.11; Description=LysM domain
  Pfam annotation: Domain name=Peptidase_M23; Domain location=192-287; Score=170.8; E_value=3.6e-48; Accession=PF01551.13; Description =Peptidase family M23
  Pfam module annotation: Pfam domain module=LysM::Peptidase_M23; Domain location=33-76::192-287
MAQQPVQTVNGKIVYNRKYGDIPKGSYTGGSTYTVKRGDTLFYIAWVTGNDFRDLAERNNVPAPYALNVGQVLQVGNSAGQPITGENPVSQASAQASGGATATTTSAQKSTAVVASQPTITYSESSGEQSATKMLPNNKPATTTTAVAPVTAPSTVSTTQPTASSTSTSSPISSWRWPTDGKVIENFSGAEGGNKGIDIAGSKGQAIVATADGRVVYAGNALRGYGNLIIIKHNDDYLSAYAHNDTMLVREQQEVKAGQKIATMGSTGTSSTRLHFEIRYKGKSVNPLQYLPQR

SEQ ID NO: 137057 - protein, 155 aa, Glycine max
  Coding DNA Sequence Number=SeqID_45372
MGIAPTKTPSGPKEVQQALGFPALVTGLCQPYRAPVPPSKDCARKTPSGPEEGQQGLGIASSKYGSLSVIGSVCRPQQGHQAPYQSSFHQEVLRPQASAGRNTTAALGWPVAGNRHTATTSKVHLSSSIKWLERCLRHMADQQATKSKAKDKQKY

SEQ ID NO: 137058 - protein, 148 aa, Glycine max
  Coding DNA Sequence Number=SeqID_45373
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMAAFVSFHALTLSS

SEQ ID NO: 137059 - protein, 130 aa, Glycine max
  Coding DNA Sequence Number=SeqID_45374
MGDQEETQEQMKADMSALKEQMASILVAMLGMRQLMEKNVATAAVVSSAAEEDPTLPATTHHSLPNAVGRERSTLGHTSNPHLGYNRVAYPYGLPPNYMPPVMRDDAGHVPSPILEGEPPRLADEVHEDH

SEQ ID NO: 137060 - protein, 207 aa, Glycine max
  Coding DNA Sequence Number=SeqID_45375
LHSPVHLRPVGGGVMMLDFEILAHFLHHFVIQIGAIVSNDFPREFVSTNQFPLYESDHHTPRDIGIGSRFDPFGEIIYRHENEAITVRSLGFDGPYDIYPPHGKRPRGGHDIQRMWQNIDIVCERLTFMAFPYMGVAIAFHSEPVITCSKDLPGHSMPIGMCPKRTLMDFLNHVVRLFGIYASQEGHVMVSFVQDGTTHKETSSQSP

SEQ ID NO: 137061 - protein, 143 aa, Glycine max
  Coding DNA Sequence Number=SeqID_45376
MAAQLIRELVEMECLEGVWETLEGNTRCRFWGIIRFTATSLVHPDEPVRTLQRTMEWILPTPTPYCLVEPVQVIEVTSSEEDPEEDPEELPPEPAVDALDFLEGDEDPLPEVDSPEEVMSASEADSTEDSGLREMATSGGSSS

SEQ ID NO: 137062 - protein, 59 aa, Glycine max
  Coding DNA Sequence Number=SeqID_45377
  Gene Ontology: Biological process=auxin mediated signaling pathway
  Homolog annotation: Hit_ID=P33080; Match level="QueryCoverage=64%, HitCoverage=41%, E-value=4e-15, Identity=97%"; Hit description=Auxin- induced protein X10A
  Pfam annotation: Domain name=Auxin_inducible; Domain location=1-36; Score=-5.5; E_value=0.00016; Accession=PF02519.5; Description=Auxin responsive protein
DLLNQAEKEFGYDHPMGGLTIPCKEDEFLTVTSHLNDLDFYFLQKLKPVSRMRINAAQD

SEQ ID NO: 137063 - protein, 145 aa, Glycine max
  Coding DNA Sequence Number=SeqID_45378
MGGVEEVQEQMEADIEPMKEQMATMMEVMMSMKKIMEANVVAVTATNAVAKVNLTSPSGINQMNHPTSDMIGKDLGSTMMCKFKTNMHSRHMACLSTIRHPMWRTLPMRMSITPLLYPLRANNPKLIMHMSLKPWGRHMKFPTTI

SEQ ID NO: 137064 - protein, 80 aa, Glycine max
  Coding DNA Sequence Number=SeqID_45379
MASSNSLFPEGNSIHRPPIFNGEGYHYWKTRMQIFIEAIKIGPYIPTDENHETDQIQAKVPSGEGQRPKWRRTKPPSRER

SEQ ID NO: 137065 - protein, 213 aa, Glycine max
  Coding DNA Sequence Number=SeqID_45380
  Gene Ontology: Mol. function=nucleic acid binding
  Homolog annotation: Hit_ID=Q2AA09; Match level="QueryCoverage=73%, HitCoverage=50%, E-value=9e-09, Identity=28%"; Hit description =Retrotransposon gag protein
METSMIDAANGGALGDMTPAEARNLIEKMTSNSQQFSAKNDAIVIRGVHEVATNSSGETKKLEGKLDVLVNLVTQLAMNQKSALVARLCGLCSSADHHTNLCPSVQQSEAIEQPDAYAANIYNRPPQPQQQNQPQQNNYDLSSNKYNPGWRNHPNLRWSNPSQQQQQQQPYFQNAVGPSKPYVPPPIQQQQQQQQPQKQQTVKAPPQPSLEEL

SEQ ID NO: 137066 - protein, 118 aa, Glycine max
  Coding DNA Sequence Number=SeqID_45381
VPPVQLLTGWCVTAKAPPDISAGKCSGHAARRVPFAIQAAQLLGRAIGAGLFAITPAGERGMCCKAIKLGNASVFPSHDVVKRRPVNCNTTHYRANWSSTAVAAALELVDPPGCRNSI

SEQ ID NO: 137067 - protein, 131 aa, Glycine max
  Coding DNA Sequence Number=SeqID_45382
  Gene Ontology: Cellular component=integral to membrane
  Homolog annotation: Hit_ID=A6ZKI8; Match level="QueryCoverage=82%, HitCoverage=80%, E-value=8e-10, Identity=28%"; Hit description =Conserved protein
  Subcellular localization annotation: CTP_CleavageSite=26; ConfidenceScore=5.18e-01
TYQGNPCGVYPDLSSFTGSGVYPDLSSFTGSGVYPDLSSFTGSGVYPDLSSFTGSGVYPDLSSFTGSGVYPDLSSFTGSGVYPDLSSFTGSGVYPDLSSFTGSGVIQTSVACIKRSTPTQVYINFFVDLDL

SEQ ID NO: 137068 - protein, 131 aa, Glycine max
  Coding DNA Sequence Number=SeqID_45383
  Subcellular localization annotation: CTP_CleavageSite=49; ConfidenceScore=5.30e-01
MQQRGSQMGQDQREQTKRQQRIGGSTSPSPIVTGNPPVTASPSLPAVAPASVNRAPDGSNVPPFAASPAPTRAWRAHHSNAAARYARPPATRSPRRVVYVSPASSEWAAEISATIATPINSMVSTASAINQ

SEQ ID NO: 137069 - protein, 101 aa, Glycine max
  Coding DNA Sequence Number=SeqID_45384
  Subcellular localization annotation: CTP_CleavageSite=73; ConfidenceScore=5.66e-01
MSSISVGRVKSCPGMHSSCVIASLSGCARTVGRPPVSGGGPGTVKRKLLVRMWSTLKMRTRSPLKVRACNPLKARMYSPLKVRACSPLKGEGVQSSVVEYV

SEQ ID NO: 137070 - protein, 104 aa, Glycine max
  Coding DNA Sequence Number=SeqID_45385
LGRIDGDPVVERNEDMGYVGVRELSWRWATGDDKRNKDHKARRLVWWLASCESCVIYGLWPLVIDYQGLENEVRKLGELLASGNRLPVSVIDYTEEWVIGNRLP

SEQ ID NO: 137071 - protein, 103 aa, Glycine max
  Coding DNA Sequence Number=SeqID_45386
MTKNERRTVKNDEEFPHNRLQKRLGSVTEAPRFGFSSRKHIFSPKTAEMHSLGVWNILKQPPSPIYREKGRCLPPREALWKPQKPQKQFFNNVEELAAQLLPP

SEQ ID NO: 137072 - protein, 91 aa, Glycine max
  Coding DNA Sequence Number=SeqID_45387
  Homolog annotation: Hit_ID=A5AWG3; Match level="QueryCoverage=96%, HitCoverage=17%, E-value=3e-08, Identity=38%"; Hit description =Putative uncharacterized protein
MNIEESIHVTFDESNAILSRKNMLDDIADSLEHMNIDEQDSKGMIKETMKILKEEVKSNNELPREWKVSRDHPLDNIIGDISKGVTTRHFS

SEQ ID NO: 137073 - protein, 95 aa, Glycine max
  Coding DNA Sequence Number=SeqID_45388
  Homolog annotation: Hit_ID=A0PAV3; Match level="QueryCoverage=29%, HitCoverage=14%, E-value=6e-07, Identity=89%"; Hit description =Restriction endonuclease
MEKDGTSYVPINVSFSPKVGPGLPGINRDTRIYLFCEVIFRHSCPSSSGTDGVDVQLLGRAIGAGIFAITPAGERGMCCKAIKLGNARVLPVTTL

SEQ ID NO: 137074 - protein, 162 aa, Glycine max
  Coding DNA Sequence Number=SeqID_45389
MWAFHIGRQLDWAHLVRYRMHKALRLNAPLPYPHLVTLFLRHFQIPLHSEPYVPIKRSFLIGAAVIASFGYHKEHDGSWVKKGAQPADDEGNLPVEDNSSLLRRLLDKFDGLRTFVGGKFDAMELQVDMRFDAMDSRITKVEEDVSFIRTCFDPPPPPPSSS

SEQ ID NO: 137075 - protein, 230 aa, Glycine max
  Coding DNA Sequence Number=SeqID_45390
  Gene Ontology: Cellular component=viral envelope
  Homolog annotation: Hit_ID=Q84VI1; Match level="QueryCoverage=82%, HitCoverage=27%, E-value=7e-91, Identity=90%"; Hit description =Envelope-like protein
EITAKRVQHWPKKGKLSAGKLSVKYAILHRIGAANWVPTNHTSTVATGLGKFLYAVRTKSKFNFGNYIFDQTVKHSESFAIKLPIAFPTVLCGIMLSQHPNMLNYTDSVMKRESPLSLHYKLFEGTHVPDIVSTSVSTSGKAAASGAVSKDALIAELKDTCKVLEATIKATTEKKMELELLIKRLSESGIDDEEAAEEEGEAAEEEEEAAAEEEDAAEETESDDDSEATP

SEQ ID NO: 137076 - protein, 51 aa, Glycine max
  Coding DNA Sequence Number=SeqID_45391
MVSKVWSFNGGFNGEEEEEKSNVRSIVYKIPGRNFQDVTSRMKKILNQDKY

SEQ ID NO: 137077 - protein, 77 aa, Glycine max
  Coding DNA Sequence Number=SeqID_45392
MGLECRSLARDKDFPSESAGVQFGCVLSNDLFPFLSVVACTHPVTDESVVGISVSATREFAAFVPKIPTLNWVGFQR

SEQ ID NO: 137078 - protein, 128 aa, Glycine max
  Coding DNA Sequence Number=SeqID_45393
PSAPSDLSNFEWRLLSLAKIAYSGWSFSSLTLLRKVKEEPQLLVVFVVTAAVLVEEHMACLDQQHSEKEGQTIVVVFVVEDLSISDLDDSSNLDCIYCLKGHNYSTVVGFAAEEVYYKCLQHKLQVAH

SEQ ID NO: 137079 - protein, 82 aa, Glycine max
  Coding DNA Sequence Number=SeqID_45394
  Gene Ontology: Mol. function=transcription factor activity; Cellular component=intracellular; Biological process=regulation of transcription, DNA-dependent
  Homolog annotation: Hit_ID=A6T8U9; Match level="QueryCoverage=100%, HitCoverage=35%, E-value=1e-38, Identity=98%"; Hit description =Putative transcriptional repressor
  Pfam annotation: Domain name=GntR; Domain location=13-75; Score=72.3; E_value=1.7e-18; Accession=PF00392.12; Description=Bacterial regulatory proteins, gntR fam
MAAESQLNPTQPVNQQIYRILRRDIVHCLIPPGTPLSEKEVSVRFDVSRQPVREAFIKLAENGLIQIRPQRGSYVNKISLSQ

SEQ ID NO: 137080 - protein, 130 aa, Glycine max
  Coding DNA Sequence Number=SeqID_45395
MEELINKTQLSPKIIPTSSRQPGGSTKESHFSYSTAVILLPRTKVRDHHSMMHAPDLNSQMQCGTIPKEKPNRVHTTLSLRKTRQQLPPPHGDQPESQWSSKPSDMPPSTSIPPHVHTQHNIITMHFQRF

SEQ ID NO: 137081 - protein, 134 aa, Glycine max
  Coding DNA Sequence Number=SeqID_45396
METCLAVEELLQRMIDQGRLEVGDEGSHAVPWRYTPPSERKEEATDISSLSAKVTNITGLSGMTHSGRVFAPPDLPTQPANVKGKAKVVDEKNDKTTLTLNEDIPEKRDGRDKREVSLEEASKFLRIIQQSEFK

SEQ ID NO: 137082 - protein, 75 aa, Glycine max
  Coding DNA Sequence Number=SeqID_45397
MDALEIYYNEIKGQLDINVKIIRYDRGDEYYGRYDETGQHPGPFAKLVQKRAFCEITISKRVPKSRPKFQENHFS

SEQ ID NO: 137083 - protein, 85 aa, Glycine max
  Coding DNA Sequence Number=SeqID_45398
MQSQGFASFSCPTPDQFRAEVAWPGDWPEAQAGEPPAEAPDDGEEAHEDEEMADLLDFLGGSGDTVNAVKFSRTPEMDLDECTNG

SEQ ID NO: 137084 - protein, 143 aa, Glycine max
  Coding DNA Sequence Number=SeqID_45399
  Homolog annotation: Hit_ID=UPI00006A17C9; Match level="QueryCoverage =76%, HitCoverage=58%, E-value=6e-08, Identity=32%"; Hit description =UPI00006A17C9 related cluster
MLLSSNVIYICVRVVMLVRMIRTRLFAVARVKSCPGMHSSCVIASLSGCARTVGPPPISGGGPGTMWSTLKMRTRSPLKVRACSPLKARMCSPLEVRACSPLLARTCSPLKVRACSPLLARTCSPLKVRACSPLLARTCSPLK

SEQ ID NO: 137085 - protein, 103 aa, Glycine max
  Coding DNA Sequence Number=SeqID_45400
  Homolog annotation: Hit_ID=A5AV98; Match level="QueryCoverage=95%, HitCoverage=10%, E-value=5e-12, Identity=40%"; Hit description =Putative uncharacterized protein
  Pfam annotation: Domain name=zf-CCHC; Domain location=72-89; Score =22.8; E_value=0.00053; Accession=PF00098.14; Description=Zinc knuckle
MKDKWNVHELHIMLVQEETRLKNQGSHSVHYVSHQGNQGAGKKFMKKHDKGKGSLKINDNSLQIQKKVLKSNNCQFCRKSGHFQKDCPKCKSSFEKRGELNAH

SEQ ID NO: 137086 - protein, 198 aa, Glycine max
  Coding DNA Sequence Number=SeqID_45401
MRNALRLDSMKKPFDNITAPRKLSTKRSRRDAAAEGTSAAPEFDNHHFRSAEHQQRFEAIKGWSFHRERRVQLRDDKYTDFQEEIARRRWTLLVTPMAKFDPDIVLEFYANAWPTEEGVRDMWSWVRGQWIPFDANALSQFLGDPLVLEEGQECEFSQRRNRADGFDEEAIAQLLCISVSAGVCHPDTDERPCGSVDR

SEQ ID NO: 137087 - protein, 111 aa, Glycine max
  Coding DNA Sequence Number=SeqID_45402
  Homolog annotation: Hit_ID=A0ST23; Match level="QueryCoverage=22%, HitCoverage=51%, E-value=3e-07, Identity=100%"; Hit description =Putative reverse transcriptase
MAKFSPEEVTALQAGGNENGILCAILTPNPGGARYQLLFPLVRVNFELGVIMVIAVSFGKPVVPAALMNRPTRGERRFAYWALAECILAYYVGTDEGVSEVLHVAGEKRLH

SEQ ID NO: 137088 - protein, 125 aa, Glycine max
  Coding DNA Sequence Number=SeqID_45403
MDKFDIFVPHPLVITSLLPLECECKPLVCLLKRPVLLSFLTSKTVQSEITRPACWWGCRKTTSKFLPCYKVMTKDKVDTSKPYTGAMRGIVHEPQANLGADQKFSPVDVFKQKRGGGTNPGISMD

SEQ ID NO: 137089 - protein, 100 aa, Glycine max
  Coding DNA Sequence Number=SeqID_45404
  Homolog annotation: Hit_ID=Q6WAY6; Match level="QueryCoverage=52%, HitCoverage=9%, E-value=4e-13, Identity=61%"; Hit description =Putative uncharacterized protein
MHRERRGKLGPTLRKTKKRAFVNWFPRWTEGRTGVLISCGGFPNVPLIGTRGCISYNPVLAIRQLGYLMRGAPLEEELVPVISRGFNKTNGETLQKVPKA

SEQ ID NO: 137090 - protein, 96 aa, Glycine max
  Coding DNA Sequence Number=SeqID_45405
  Subcellular localization annotation: CTP_CleavageSite=47; ConfidenceScore=5.32e-01
MVQMATQLNQAQSQNSDKLPSQTVQNPKNVSVITLRSGKQIEVPPPIAAPAPEPIKLHSTPEKEDELAAQKRKLPNHEGANKNFHAGGPSSSSFDL

SEQ ID NO: 137091 - protein, 67 aa, Glycine max
  Coding DNA Sequence Number=SeqID_45406
SDDESLKGTNTRNPAINFEQEAGRMESEEDKDVGLPPELERIIAQEDQEMRPHQEETELVDLGTGSG

SEQ ID NO: 137092 - protein, 21 aa, Glycine max
  Coding DNA Sequence Number=SeqID_45407
MGAKYLEVVFLADRMMGNEKS

SEQ ID NO: 137093 - protein, 39 aa, Glycine max
  Coding DNA Sequence Number=SeqID_45408
MDVKYLEVVKRGLHPNNGWSPDEIRVLSFLSHNLLVLNL

SEQ ID NO: 137094 - protein, 172 aa, Glycine max
  Coding DNA Sequence Number=SeqID_45409
MAASDHAILRDRAHIPTKRSLLELSSQDALLAQNKLLSKQLEAMTETLSCAICGGAHESGCCISTKDTTHEGKWRTHPGNQFNKDQGGPSNRPQQQGPSLYDRTTKLEETLAQFMQVSMSNQKSTESTIKNLEVQVGQLAKQLADLPSRSFGANTEKNPKEECKAVMTRSKM

SEQ ID NO: 137095 - protein, 142 aa, Glycine max
  Coding DNA Sequence Number=SeqID_45410
MELIENMAASDHTILHDRAYAPKKRSLLELTAQDAMLAQNKLLARQIEALTETLNKLPQQLQAWSTRARVMHSPRGFFQGDELHGSLESPRIPRLQPRRTIGIQPREEFHTRLKLEESSGEPVQQGAKKSTCPEFQPRGRSL

SEQ ID NO: 137096 - protein, 267 aa, Glycine max
  Coding DNA Sequence Number=SeqID_45411
  Homolog annotation: Hit_ID=Q2HW90; Match level="QueryCoverage=51%, HitCoverage=33%, E-value=5e-15, Identity=32%"; Hit description =Putative uncharacterized protein
MGQLQRQAFRKAYGKIWDLARVEVSMEPIASLSQYYDQPLRCFTFEDFQLVPTVKEFEEILGCPLGGRKPYLFSGFYPSTTRVARPWQIKVNGLSFIDILALLIFGVVLFPNMEGLVDLAAIDAFLAFHHGKESPVVAILAMYDTFDWGCEKSGARIEGRIRILSSCEGCPMRGVPSDESITPFIARGFSDHNARDRELRGSSNGIIGGYHKWLRVRTQGLDWLPNLKTVRDDEVKASEESDEVQALKAELERAWVVEEKFKSIAIK

SEQ ID NO: 137097 - protein, 338 aa, Glycine max
  Coding DNA Sequence Number=SeqID_45412
MAPRKLASKRSRKDKAAEGTSSAPEYDSHRFRSAVHQQRFEAIKGWSFLRERRVQLRDDEYTDFQEEIGRRRWVPLVTPMAKFDPEIVLEFYANAWPTEEGVHDMRSWVRGQWIPFDADAIGQLLGYPLVLEEGQECEYGQRRNRFDGFDEEAIAQLLCMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 137098 - protein, 188 aa, Glycine max
  Coding DNA Sequence Number=SeqID_45413
MIMRGQDIYSSQEETTSCPSSSGSEDEVRGEESSEEVYPHEEGDLLMVAKDQLTMKDKRDEEEKLEKQKKKKDSKALPSKAKGKEKEEKDSSKKIVKKENHFATKGDIKIVLLLKQSFYLLLSRETSLSTTIPLELEVIPQVKELLDEGLVRKSLNPCALLVLTIGIIRHQIPMIGGMMNVLSGATLF

SEQ ID NO: 137099 - protein, 229 aa, Glycine max
  Coding DNA Sequence Number=SeqID_45414
MFLCIPGRGFILNSEGHPGKILRKDMTTLAQVWSVLSYSNLAPTSHTSELTVDRARLIFGLVSCLDMNIGALISSQMTSIAQSNTSRLGFPALIIALCRATGVVSDNLTFERLSLVVAPPGSIPSVEQFREMVVWPGTQPSLHREDEGPTAQVPQHVEDESSEATIPEPFVIGEEAKETHMRQVAAATLERSLEATLEPSAQGEDIPSPQPAADPSTPILEMPEDLGIL

SEQ ID NO: 137100 - protein, 208 aa, Glycine max
  Coding DNA Sequence Number=SeqID_45415
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=25%, HitCoverage=50%, E-value=1e-23, Identity=100%"; Hit description=LacZ protein
MKHFTDTLISANIGTKAGTGPPLEVDGIDKLDAPQRFSLGGRCTGWPGPGACSLCASPGLPQQAHHHRGGLPTGRQHGPDGPHGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137101 - protein, 180 aa, Glycine max
  Coding DNA Sequence Number=SeqID_45416
MLNIFLKTPVVVEEGETLCAYSRFALLRPNPQELAAKLYILGRGFELNADGQPLKILRKNMTTLAQTWSVLSFSNLIPTSHTSDVTLDRARLIYGIIMKMDMNVGVATCPFAGERGRGSRVRFPKEERCAESPPMFICGKRRENRRKPVKMKILSSGVVFTFEEGISNSHVCLKGQQPIF

SEQ ID NO: 137102 - protein, 278 aa, Glycine max
  Coding DNA Sequence Number=SeqID_45417
  Gene Ontology: Mol. function=tRNA-pseudouridine synthase activity; Biological process=tRNA pseudouridine synthesis
  Homolog annotation: Hit_ID=Q1H0L9; Match level="QueryCoverage=66%, HitCoverage=84%, E-value=7e-54, Identity=50%"; Hit description=tRNA pseudouridine synthase A
  Pfam annotation: Domain name=PseudoU_synth_1; Domain location=79-181; Score=96.0; E_value=1.1e-25; Accession=PF01416.11; Description=tRNA pseudouridine synthase
CPERAIAQVGGESVRLHAAGRTDSVLWASEVADDFHARFSARARSYQYVLFNHAVAPASQHGRVGWYHRPLNIDLMQQAIQILVGEHDFSAFRASECQASSPIRTMQRAEIVQHDRYFIFSFKANAFLQHQIRNMVGALVYVGQGKLSVTGFAELLEHKDRRLSPPTFMPDGLYFTGVDYDASWQLPLSIDAGADALGFVFYAPSPRAVTATAAQAITAVLPPFVSKVGLFVNAEASEVREAIANARLDCLQFHGDESADYCTQFNLPYYKAIRVKPG

SEQ ID NO: 137103 - protein, 130 aa, Glycine max
  Coding DNA Sequence Number=SeqID_45418
MQSSDRSPSKPKPLVIHFTRDITTHIPRGFQPSIAKTPTPFPYTSDKAVPWKYGVQGLGGRKDTSVIRVGNGMPATKITNISGTISMTHSGRIFTPSELPARSKDKGKTKADIGERERTGLTANDEALVG

SEQ ID NO: 137104 - protein, 133 aa, Glycine max
  Coding DNA Sequence Number=SeqID_45419
  Subcellular localization annotation: CTP_CleavageSite=43; ConfidenceScore=5.38e-01
MVKVGTSYVPINVSFSPKVGPGRFRINGHRFTVCLCVSVDLSSCSATDGECVIRNGKSTSRTSARKCKAWGLRRDARDHVRCATALGIGHAIGCFPVNVLLWQEKKATASEYVRIRLTDSGRIGAATAEWRPL

SEQ ID NO: 137105 - protein, 37 aa, Glycine max
  Coding DNA Sequence Number=SeqID_45420
MVWHLLSTPLLLHSAAIDIQEAKDSFDEEDPRPTSFT

SEQ ID NO: 137106 - protein, 170 aa, Glycine max
  Coding DNA Sequence Number=SeqID_45421
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=74%, E-value=3e-08, Identity=28%"; Hit description =UPI00006A17C9 related cluster
MLVRMIHTRLFAVARVKPCPGMHSSCAIAFLWLCSHSWPSFEIKGWPGKKNGRREITGQRTLNPLKVWIWSPLKVRTRSPQKTRESAALRRGTCSPLKARACSPLKVRACSPLKVRVCSPLKARTGSPLKVRACNPLKARTCSPLKVRTCSPLKVRVCNPLMARKCSPLK

SEQ ID NO: 137107 - protein, 79 aa, Glycine max
  Coding DNA Sequence Number=SeqID_45422
MSGLVWLKDKRDAPHYFHDTNAKMMIWKFYAKLATHAPMWTLKCQIFWKLLGKIFEEIYPSVYHPQMRGILLKPKCASQ

SEQ ID NO: 137108 - protein, 128 aa, Glycine max
  Coding DNA Sequence Number=SeqID_45423
YCTPRQAQGDAPQAIDAPPPPHQADPAGSLGMEHYLQHLVRQQAANHRGQVQIHECIYQLSLSQQGKGFAPFACPTLEQFRAEVAWPGDWPEAQVGEAPAGAPGDVEEARMGEEMTDLLGFLGGSGAT

SEQ ID NO: 137109 - protein, 84 aa, Glycine max
  Coding DNA Sequence Number=SeqID_45424
  Subcellular localization annotation: CTP_CleavageSite=44; ConfidenceScore=5.13e-01
MTIMLVSTTMVITIIMLVMITMVTTTTIMVMLVATMMVITTIIMVMVVGTCTWMRVLLNNTTLMHLLSFNKQCLVVGLGDQWLD

SEQ ID NO: 137110 - protein, 230 aa, Glycine max
  Coding DNA Sequence Number=SeqID_45425
  Homolog annotation: Hit_ID=A7QGD5; Match level="QueryCoverage=90%, HitCoverage=98%, E-value=2e-18, Identity=32%"; Hit description =Chromosome undetermined scaffold_91, whole genome shotgun sequence
METSLPLATDSFSYSWLPNYKPLANDLKEPLREPTYNFCDGTINYPFMEDWQNFNFDISITQSPAVFSHADELFSNGLIKPLFVGPSKVEFCNTTTDSTQSKPVSSRNVSPRTVQIHHGFLTKWKTSTCRTLRSLSRYVNQLCQKVGSSRKSTKVDDFDKEEWLVNNSWSSSQQPSPKSNTVNHIGALLDYENSIYEAVLHCKRSIAFTSVRATTKNTVVANKEYQMTLS

SEQ ID NO: 137111 - protein, 197 aa, Glycine max
  Coding DNA Sequence Number=SeqID_45426
  Gene Ontology: Mol. function=hydrolase activity, hydrolyzing O -glycosyl compounds; Cellular component=vacuole; Biological process =carbohydrate metabolic process
  Homolog annotation: Hit_ID=Q6XD74; Match level="QueryCoverage=88%, HitCoverage=61%, E-value=3e-70, Identity=71%"; Hit description=Class III chitinase
  Pfam annotation: Domain name=Glyco_hydro_18; Domain location=8-196; Score=44.5; E_value=1.9e-10; Accession=PF00704.19; Description =Glycosyl hydrolases family 18
MVLMLQNCNLLGPEWQLGTLDEACATGNYDYVIIAFLPTLGDGQTPMINLAGHCDPYSKGCTGLSSDIESCQAKGIKVLLSLGGGAGSYSIASTQDASQLSSRPLGPAILDDIDFDIEDGSNQHWGDLAKFLKGYGMAKQGKQAFITAAPQCPFPDAWIGNALTTGLFDIVCVQFYNNPPCQYNSGAISPLKMHGSR

SEQ ID NO: 137112 - protein, 76 aa, Glycine max
  Coding DNA Sequence Number=SeqID_45427
  Subcellular localization annotation: CTP_CleavageSite=38; ConfidenceScore=5.56e-01
MDGLASKPGITARVGLSPASATATATATANGLSPGGAPSSAPRNAASALITFSGPIPVGWAKLTALPKRMVEEVLA

SEQ ID NO: 137113 - protein, 211 aa, Glycine max
  Coding DNA Sequence Number=SeqID_45428
  Gene Ontology: Mol. function=peptidase activity
  Homolog annotation: Hit_ID=A7QEE4; Match level="QueryCoverage=65%, HitCoverage=42%, E-value=9e-44, Identity=61%"; Hit description =Chromosome chr1 scaffold_84, whole genome shotgun sequence
MTECVRLFDHPIIKVHILVLSGVDICVSWIIRPIKYPNIFQYEIKALLGAQLFDYPNILQESGWPILRRWEVPWQWQTVSLTSLACGLGFVLTGLTEAIALPYLGIKPDVLSLDDKAEILLFDQSITTAVVLGIIYSVANTFQPLPEDFFKYDLREPFNLQKGWLLWAGIGLAGAILAISLTGVAVSFFNGETPQREVHVLFLKFYRKMQM

SEQ ID NO: 137114 - protein, 35 aa, Glycine max
  Coding DNA Sequence Number=SeqID_45429
MVKMKICFSVETIEDSIFSECEVVKVSFAKGEGER

SEQ ID NO: 137115 - protein, 1231 aa, Glycine max
  Coding DNA Sequence Number=SeqID_45430
  Gene Ontology: Mol. function=transmembrane receptor activity; Cellular component=intrinsic to membrane; Biological process=innate immune response
  Homolog annotation: Hit_ID=Q8W2C0; Match level="QueryCoverage=87%, HitCoverage=96%, E-value=0.0, Identity=45%"; Hit description =Functional candidate resistance protein KR1
  Pfam annotation: Domain name=LRR_1; Domain location=561-586; Score =7.8; E_value=11; Accession=PF00560.24; Description=Leucine Rich Repeat
  Pfam annotation: Domain name=LRR_1; Domain location=604-629; Score =1.9; E_value=1.3e+02; Accession=PF00560.24; Description=Leucine Rich Repeat
  Pfam annotation: Domain name=LRR_1; Domain location=651-673; Score =9.5; E_value=5.4; Accession=PF00560.24; Description=Leucine Rich Repeat
  Pfam annotation: Domain name=LRR_1; Domain location=675-697; Score =1.1; E_value=1.9e+02; Accession=PF00560.24; Description=Leucine Rich Repeat
  Pfam annotation: Domain name=LRR_1; Domain location=698-720; Score =7.2; E_value=14; Accession=PF00560.24; Description=Leucine Rich Repeat
  Pfam annotation: Domain name=LRR_1; Domain location=722-743; Score =11.0; E_value=2.8; Accession=PF00560.24; Description=Leucine Rich Repeat
  Pfam annotation: Domain name=LRR_1; Domain location=745-767; Score =5.9; E_value=25; Accession=PF00560.24; Description=Leucine Rich Repeat
  Pfam annotation: Domain name=LRR_1; Domain location=800-824; Score =4.7; E_value=41; Accession=PF00560.24; Description=Leucine Rich Repeat
  Pfam annotation: Domain name=LRR_1; Domain location=841-866; Score =5.4; E_value=31; Accession=PF00560.24; Description=Leucine Rich Repeat
  Pfam annotation: Domain name=NACHT; Domain location=216-368; Score= -14.1; E_value=0.00075; Accession=PF05729.3; Description=NACHT domain
  Pfam annotation: Domain name=NB-ARC; Domain location=177-472; Score =101.8; E_value=2e-27; Accession=PF00931.13; Description=NB-ARC domain
  Pfam annotation: Domain name=TIR; Domain location=18-151; Score =149.8; E_value=7.4e-42; Accession=PF01582.11; Description=TIR domain
  Pfam module annotation: Pfam domain module=LRR_1::LRR_1::LRR_1::LRR _1::LRR_1::LRR_1::LRR_1::LRR_1::LRR_1::NACHT::NB-ARC::TIR; Domain location=561-586::604-629::651-673::675-697::698-720::722-743::745 -767::800-824::...
  Pfam module annotation: Domain location=841-866::216-368::177-472::18- 151
MTQQSCSSSSTCEWTYDVFLSFRGDDTRSGFTGSLYKSLCDQGIHTFMDDEGLRRGEEIRHALFKAIQQSRIAIVVFSENYASSTYCLEELVMILECIMKKGRLVWPVFYGVTPSYVRHQKGSYGKALDKLGERFKNDKEKLQKWKLALQEAANLSGSHFKLKHGYEHEVIQKIVEEVSRKINRSPLHVANYPIGLESRVQEVNSLLDVGSNQGVSMVGIYGIGGIGKTAIACAVYNLIADQFEGQCFLGDIREKSKHGLVELQETILSEMVGEKSIKLGSTNRGKAVLKSKLQRKKVLLILDDVDRLEQLKALAGDPSWFGHGSRIIVTTTDKHLLRVHGVERRYEAKGLDDKEALELFSWHAFKSNEVSPSYMDISKRAVLYSNGLPLALEIIGSNLNGKTMPEWQAALDTIERNPDEDIQEKLKVGYDGLKRNEKEVFLDIACFFRGSDLKDVTSLLFQGRGFSPEYVIRVLIDKSLIKIDKYGFVRMHNLVENMGREIVKQESPSEPGKRSRLWLYEDIVDVLENDKGTDTIEVIMLHSPKNKEVQWNGSELKKMTNLKLLSIENAHFSRGPVHLPNSLRVLKWWGYPSPSLPPEFDSRRLVMLDLSNSCNIMGKQLKFMKFESLSEMVLRGCRFIKQTPDMSGAQNLKKLCLDNCKNLVEVHDSIGLLDKITWFTAVGCTNLRILPRSFKLTSLEHLSFKKCSNLQCLPNILEEMKHVKKLDLCGTAIEELPFSFRKLTGLKYLVLDKCKMLNQIPISILMLPKLEKLTAIKCGRYANLILGKSEGQVRLSSSESLRDVRLNYNDLAPASFPNVEFLVLTGSAFKVLPQCISQCRFLKNLVLDNCKELQEIRGVPPKIKYLSAINCTSLSHESQSMLLNQRLHEGGGTDFSLPGTRIPEWFDHCTTGPLLSFWFRNKFPRMALAVVGVLDKQGSFPMSRFHLLINGIQKLHCLFTAQSKLTTYHIFLSDVQLKSYNGELQSVYGEDGWNHVEISYVRPSAFPHSCRAKRGTIKLMGVHVYKQKTSMEGVRFTNPWSPKRSYSEVSKPSLKENFQSLAKRSRGSQGMEICEAPRMKQHEVNSGYHSVSQRLWLEICSIVAPADVKVLMWSICQNALPTFEYLFRRKLVNSPLCPICGTEPETVEHAFLFCPWTRPLWFGSDFQWCIDAKTVQSFQLWLWQKLVEIQRVYQENANQVSAQVGSICWAIWKGRNEFILEGKPVNPLILR

SEQ ID NO: 137116 - protein, 134 aa, Glycine max
  Coding DNA Sequence Number=SeqID_45431
MKNKKVAEVGVSLSEPYALSEQHLLSEGGGSADKVMEVTKSGVRRRTGVGNKGFGLEVVAETVEEGDEFDDSGGVPSEPWDLADSCVKLGGEGREVGIRGGRGEESTFETNGQCPIGASKTKIAGIYKIGGPKL

SEQ ID NO: 137117 - protein, 307 aa, Glycine max
  Coding DNA Sequence Number=SeqID_45432
  Pfam annotation: Domain name=Transposase_23; Domain location=245-304; Score=-17.2; E_value=0.09; Accession=PF03017.5; Description=TNP1ENSPM transposase
DLHRTEASIVERCVAKETIEFCLEYIEKAKPIRIPESRHDKRKGDPCEERWLVVLHEKTIGVNVEDDDSTVDTYVSPSSTQMPPNINGEEEVDDHIATPPISPLLPPESLTPSPSTSKKTRKVTRLRSLATRPVGAERSVVYVNPATGKIDGPHKNKLRTYLRIVARDKIGFDILKAFNHKMKKKILQTVRNQYRQFKLDLTFKWALTDDKEGENDKVCEKYDGLALSPELEVGFSGTLARTKGSCVNPSRQDPDTVYEGLTTTHNVPLGNDQVKIGVEKARDADSRVLVPTQEVQLMRQTLNTFLA

SEQ ID NO: 137118 - protein, 539 aa, Glycine max
  Coding DNA Sequence Number=SeqID_45433
  Gene Ontology: Mol. function=sequence-specific DNA binding; Cellular component=nucleus; Biological process=regulation of transcription, DNA-dependent
  Homolog annotation: Hit_ID=A7PQZ6; Match level="QueryCoverage=82%, HitCoverage=90%, E-value=1e-105, Identity=48%"; Hit description =Chromosome chr6 scaffold_25, whole genome shotgun sequence
  Pfam annotation: Domain name=Homeobox; Domain location=4-60; Score =73.1; E_value=9.3e-19; Accession=PF00046.20; Description=Homeobox domain
MEKNKKRRLKTPAQLKALEDFYNDNKYPTEEMKSELADELELTEKQISGWFCHRRLKDKKMLNDEVCANGRQDRSSGVIQDRGSGLVQDSCGSTKHVHYRYLDPKEVESHGLYNHGFSAADITYGHKNHRYAENDSATDNTSSESSSSLQDRLLCQGQDPYDMEPSSHVTPNGSLLPPNTKGANNMGHKPSGYLKVKGEIEHAAITAVKKQLGKHYREDGPLLSVEFDTIPPEAFEFIRFFQGSLGLQMLWVEGILLVTSEAYYAANPALPNSPEVSAVKKQSSLSSRYDSYFTKISSQDSQMVRGDFGSLHDSDFQYKKSHHDINQRRNFQSFTNPLPHKNSCLDFNADSTGEASAYNNTKNCRKGTKHGFDGTRYDSGSNPSDHYEENNLVVNQTDSLLHGYENSNLKNVQRGEYVKSKPSNSVHKSQVYLDTGERRGLNKRMAKEEKFDGDRKIKKQYRDPDEVRVLTNEMTVAKWAKVDPLEQYDVKQSSVAELEPRKSQRRNNQLFYKSAFRSAAEMPSSFSEDETAETSSSAD

SEQ ID NO: 137119 - protein, 92 aa, Glycine max
  Coding DNA Sequence Number=SeqID_45434
  Gene Ontology: Mol. function=transcription regulator activity; Biological process=regulation of transcription
  Homolog annotation: Hit_ID=Q10E12; Match level="QueryCoverage=76%, HitCoverage=61%, E-value=1e-10, Identity=42%"; Hit description =Transcription factor S-II family protein, expressed
  Pfam annotation: Domain name=TFIIS_C; Domain location=52-90; Score =10.9; E_value=0.0073; Accession=PF01096.9; Description=Transcription factor S-II (TFIIS)
MAIAAVIGLSGGKRLLSSSYHYFDIIEKDIRRELGMEIIEEHMVMEYSKVNKKCEKCGHGEATYYTRLMRSADKGQTTFYTCIGYGHPSQEN

SEQ ID NO: 137120 - protein, 215 aa, Glycine max
  Coding DNA Sequence Number=SeqID_45435
  Subcellular localization annotation: CTP_CleavageSite=13; ConfidenceScore=5.05e-01
MQLPHQSNIITTRSDHARQCKPVKPQTKLSNFLKEPQRGPTLTPISISSYKGVVRDNVWLGNFIEHPAGNVDKGVFGIGIDEGVVGEDIGVLGEVEGSLGIVEGATFGVEEGEVVGEVGGGWDEGLEVKGMEDFASYEIPLGYAGFEKVAEGLKLKWNPCIDLTGIAFVGESGRENPRWRRSAWKLEATSVRTTHLSEKPNPNPTVSSLFFVVLV

SEQ ID NO: 137121 - protein, 237 aa, Glycine max
  Coding DNA Sequence Number=SeqID_45436
  Gene Ontology: Mol. function=protein dimerization activity; Cellular component=nucleus; Biological process=regulation of transcription, DNA-dependent
  Homolog annotation: Hit_ID=Q39895; Match level="QueryCoverage=92%, HitCoverage=59%, E-value=2e-83, Identity=71%"; Hit description=TGACG- motif binding factor
  Pfam annotation: Domain name=PHD; Domain location=65-114; Score=0.5; E_value=0.012; Accession=PF00628.20; Description=PHD-finger
  Pfam annotation: Domain name=zf-C3HC4; Domain location=66-111; Score =6.8; E_value=0.015; Accession=PF00097.16; Description=Zinc finger, C3HC4 type (RING finger)
  Pfam module annotation: Pfam domain module=PHD::zf-C3HC4; Domain location=65-114::66-111
MERSGGMVTGSHERNELVRVRHGSDSRVRIEKCVIEIVRLSLWKRPLALGRIVISKPLKNLNGQSCQICGDTIGLTATGDVFVACHECGFPLCHSCYEYELKHMSQSCPQCKTAFTSHQEGAEVEGDDDDEDDADDLDNEINYGQGNSSKAGMLWEEDADLSSSSGHDSQIPNPHLANGQPMSGEFPCATSDAQSMQTTSIGQSEKVHSLSYADPKQPVPVRVLDLSKNLKFLLQFL

SEQ ID NO: 137122 - protein, 959 aa, Glycine max
  Coding DNA Sequence Number=SeqID_45437
  Gene Ontology: Mol. function=metal ion binding; Cellular component =intrinsic to membrane; Biological process=innate immune response
  Homolog annotation: Hit_ID=A7PQZ5; Match level="QueryCoverage=94%, HitCoverage=81%, E-value=0.0, Identity=75%"; Hit description =Chromosome chr6 scaffold_25, whole genome shotgun sequence
  Pfam annotation: Domain name=FYVE; Domain location=656-724; Score =51.9; E_value=2.3e-12; Accession=PF01363.12; Description=FYVE zinc finger
  Pfam annotation: Domain name=RCC1; Domain location=268-326; Score =3.9; E_value=0.28; Accession=PF00415.9; Description=Regulator of chromosome condensation (RCC1)
  Pfam annotation: Domain name=RCC1; Domain location=329-378; Score =22.2; E_value=0.0019; Accession=PF00415.9; Description=Regulator of chromosome condensation (RCC1)
  Pfam annotation: Domain name=RCC1; Domain location=381-433; Score =32.1; E_value=2e-06; Accession=PF00415.9; Description=Regulator of chromosome condensation (RCC1)
  Pfam annotation: Domain name=RCC1; Domain location=436-485; Score =27.5; E_value=4.9e-05; Accession=PF00415.9; Description=Regulator of chromosome condensation (RCC1)
  Pfam annotation: Domain name=RCC1; Domain location=500-549; Score =42.6; E_value=1.4e-09; Accession=PF00415.9; Description=Regulator of chromosome condensation (RCC1)
  Pfam annotation: Domain name=RCC1; Domain location=553-601; Score =13.3; E_value=0.027; Accession=PF00415.9; Description=Regulator of chromosome condensation (RCC1)
  Pfam annotation: Domain name=RCC1; Domain location=606-653; Score =22.8; E_value=0.0013; Accession=PF00415.9; Description=Regulator of chromosome condensation (RCC1)
  Pfam module annotation: Pfam domain module=FYVE::RCC1::RCC1::RCC1::RCC 1::RCC1::RCC1::RCC1; Domain location=656-724::268-326::329-378::381 -433::436-485::500-549::553-601::606-653
MTSILDTLLLNKKLNFSTGYVGPVHYPCFEPEGLLRGVDESVLIWFSGKEEKRLKLTNVSRIISGQRTPIFQRYPRPEKEYQSFSLIYNDRSLDLICKDKDEAEVWFSGLKALISRGHHWKWRPESRTDGIPSEANSPRTYTRRSSPLNSPFGSNESLQKLKMFIKRIFIFHVQDSGDHLRLHSPYESPPKNGLDKAFSDVVYYPIPPMGFFPPDSASGSVHSVSSGGSDSMHGQMKTMPMDAFRVSLSSAVSSSSQGSGHDDGDALGDVFIWGEGTGDGVLGGGAHHVGSNFGVKMDSLLPKALESAVVLDVQNIACGGEHAAMVTKQGEVFSWGGESGGRLGHGVDSDVPHPKLIESLSNTNIELVACGEYHTCAVTLSGDLYTWGDGTYNYGLLGHGNQVSHWVPKRVNGPLEGIHVSSISCGPWHTAVVTSSGQLFTFGDGTFGVLGHGDRKSVSLPREIESLKGLRTVQAACGVWHTAAVVEVMVGNSSSSNCSSGKLFTWGDGDKGRLGHGDKESKLVPTRVVTLDEPNFCQVACGHSMTVALSRLGHVYTMGSCVYGHLGNTQADGKLPTPVEGKLSKSFVEEIACGAYHVAVLTSRTEVFTWGKGANGCLGHGDTNDRNTPTLVEALKDKQVKSIACGTNFTAAICLHKWVSGVDQSMCSGCRVPFNFKRKRHNCYNCGLAFCHSCSNKKSVKASMAPNPNKPYRVCDNCFNKIRKTTETDSSSQASMSRRGSVNQGSLEFNGKDDKLDSRSHNQLARFSSMESLKQVDSRSSKKNKKLEFNSSRVSPAPNGGSQWGAMNISKSFNPVFGSSKKFFSASVPGSRIVSRATSPISRRPSPPRSTTPTPTLGGLSSPKIVVDDAKRINDNLSQEVVKLRSQVENLTRKAQLQEVELERTTKQLKEAIAIASEETAKCKAAKEVIKSLTAQVETLTPLAIFRNYIPMTAKSSHS

SEQ ID NO: 137123 - protein, 523 aa, Glycine max
  Coding DNA Sequence Number=SeqID_45438
  Gene Ontology: Mol. function=catalytic activity; Cellular component =nucleus; Biological process=metabolic process
  Homolog annotation: Hit_ID=A7R678; Match level="QueryCoverage=99%, HitCoverage=97%, E-value=0.0, Identity=47%"; Hit description =Chromosome undetermined scaffold_1179, whole genome shotgun sequence
  Pfam annotation: Domain name=PPR; Domain location=10-44; Score=43.0; E_value=1e-09; Accession=PF01535.11; Description=PPR repeat
  Pfam annotation: Domain name=PPR; Domain location=112-147; Score =13.3; E_value=0.21; Accession=PF01535.11; Description=PPR repeat
  Pfam annotation: Domain name=PPR; Domain location=215-249; Score =36.5; E_value=9.8e-08; Accession=PF01535.11; Description=PPR repeat
  Pfam annotation: Domain name=PPR; Domain location=250-284; Score =19.4; E_value=0.013; Accession=PF01535.11; Description=PPR repeat
  Pfam annotation: Domain name=PPR; Domain location=286-320; Score =16.4; E_value=0.09; Accession=PF01535.11; Description=PPR repeat
  Pfam annotation: Domain name=PPR; Domain location=352-386; Score=8.1; E_value=0.86; Accession=PF01535.11; Description=PPR repeat
  Pfam annotation: Domain name=PPR; Domain location=45-79; Score=6.1; E_ value=1.5; Accession=PF01535.11; Description=PPR repeat
  Pfam module annotation: Pfam domain module=PPR::PPR::PPR::PPR::PPR::PP R::PPR; Domain location=10-44::112-147::215-249::250-284::286 -320::352-386::45-79
MGEGGGRDEVSWNAMIVACGQHREGMEAVGLFREMVRRGLKVDMFTMASVLTAFTCVKDLVGGRQFHGMMIKSGFHGNSHVGSGLIDLYSKCAGSMVECRKVFEEITAPDLVLWNTMISGFSLYEDLSEDGLWCFREMQRNGFRPDDCSFVCVTSACSNLSSPSLGKQVHALAIKSDVPYNRVSVNNALVAMYSKCGNVHDARRVFDTMPEHNTVSLNSMIAGYAQHGVEVESLRLFELMLEKDIAPNSITFIAVLSACVHTGKVEEGQKYFNMMKERFCIEPEAEHYSCMIDLLGRAGKLKEAERIIETMPFNPGSIEWATLLGACRKHGNVELAVKAANEFLRLEPYNAAPYVMLSNMYASAARWEEAATVKRLMRERGVKKKPGCSWIEIDKKVHVFVAEDTSHPMIKEIHVYMGKMLKKMKQAGYVPDIRWALVKDEEVEPDERERRLLYHSEKLAVAFGLISTEEGVPILVVKNLRICGDCHNAVKLISALTGREITVRDTHRFHCFKEGHCSCRDYW

SEQ ID NO: 137124 - protein, 398 aa, Glycine max
  Coding DNA Sequence Number=SeqID_45439
  Gene Ontology: Mol. function=hydrolase activity, acting on glycosyl bonds; Cellular component=extracellular region; Biological process =cell wall organization and biogenesis
  Homolog annotation: Hit_ID=Q9SUP5; Match level="QueryCoverage=91%, HitCoverage=91%, E-value=1e-131, Identity=60%"; Hit description =Putative polygalacturonase
  Pfam annotation: Domain name=Glyco_hydro_28; Domain location=75-385; Score=-55.8; E_value=2.3e-06; Accession=PF00295.8; Description =Glycosyl hydrolases family 28
  Subcellular localization annotation: CTP_CleavageSite=28; ConfidenceScore=5.17e-01
MLLPPFLTLTFLLLFFNASVAAIYSTTTCSNIVSLRYRSDRISVTDFGGVGDGRTLNTKAFRAAVYRIQHLRRRGGTVLYVPPGVYLTESFNLTSHMTLYLAAGAVIKATQELGNWPLIAPLPSYGRGRELPGGSNVVVRYVTILAPRDSPNTDGIDPENCISSFIGAKLFKGSIEITIADSTSAIMLYSSSNVCIEDSYISTGDDLVAVKSGWDEYGIAYGRPSYGITIRRLTGSSPFAGIAIGSETSGGVENVLAEHINLFNMGVGIHIKTNSGRGGLIKNITVAHVYVENARQGIKIAGDVGGHPDEKFNPNALPVVKGITIKNVWGVRVNQAGLIHGLRNSPFTDVCLSNINFHGMRGPRSPSWKCSDVFGFAHQVSPWPCSQLSSQEPGSCAI

SEQ ID NO: 137125 - protein, 612 aa, Glycine max
  Coding DNA Sequence Number=SeqID_45440
  Gene Ontology: Mol. function=ATP binding; Cellular component =intrinsic to membrane; Biological process=apoptosis
  Homolog annotation: Hit_ID=A7QT35; Match level="QueryCoverage=52%, HitCoverage=79%, E-value=2e-49, Identity=39%"; Hit description =Chromosome undetermined scaffold_165, whole genome shotgun sequence
  Pfam annotation: Domain name=LRR_1; Domain location=355-377; Score =7.8; E_value=11; Accession=PF00560.24; Description=Leucine Rich Repeat
  Pfam annotation: Domain name=LRR_1; Domain location=379-401; Score =10.0; E_value=4.2; Accession=PF00560.24; Description=Leucine Rich Repeat
  Pfam annotation: Domain name=LRR_1; Domain location=509-529; Score =3.0; E_value=86; Accession=PF00560.24; Description=Leucine Rich Repeat
  Pfam module annotation: Pfam domain module=LRR_1::LRR_1::LRR_1; Domain location=355-377::379-401::509-529
SVPEAKKKMSIRTNRFKAVDRVLKDLERVEKEGKLNDLKSELNKIKEVFLKVKENEEELLDTLAVVDGYIRNKNIAKLREEEGHFCQKIWNSTLKLLPAAASSGQSSHHAQAAASSHHHVTPLPSSTPQLHQEEDLQRIKDCYNSLGPEFKRIFSSLLQFPENAVFKRREIALWFSQYGDYRWNSVWVDSILKSKVIVPHGNGKSPIASKFKINPLLRHKSLSPLFQNEEVPICGYYSQIKTSSSSRASDIGYQRLVLDQRKIKISDGFGFKSFRAVYNFGASYLNFGPGWMAKMKDLWVLQLGRFMQDSPKHHIEVDSEEFLKELSGHEDLLCLSLRGISRIFELPPSIVKIESLGILDLKACHNLETLPSDISSLQSLWYLNLSECYLLDRMPKGIQNLTRLKVLKGFVLGSSSKTPCRISDIAANLKRLVRLSIRIGSGAVIQEGEFESLKKLSELEHLKISWGVFDTRYIDIQISVPSSLKKLHLEGFPGQNIPEWLKPSKLSCSLRELHITGGKLKSLDHGENNDWGVEMVYLKYLKDLDVDLEHLRKLFPSLRLLDLSQKNNDLGLIHRWIVVKFKNQQSEEKLEESQEIARDVTITTGTYMSPLR

SEQ ID NO: 137126 - protein, 517 aa, Glycine max
  Coding DNA Sequence Number=SeqID_45441
  Gene Ontology: Mol. function=oxidoreductase activity; Cellular component=nucleus; Biological process=electron transport
  Homolog annotation: Hit_ID=A7PJR2; Match level="QueryCoverage=100%, HitCoverage=97%, E-value=0.0, Identity=70%"; Hit description =Chromosome chr12 scaffold_18, whole genome shotgun sequence
  Pfam annotation: Domain name=Amino_oxidase; Domain location=27-485; Score=298.6; E_value=1.2e-86; Accession=PF01593.15; Description =Flavin containing amine oxidoreductase
  Pfam annotation: Domain name=DAO; Domain location=19-405; Score= -56.7; E_value=0.056; Accession=PF01266.15; Description=FAD dependent oxidoreductase
  Pfam annotation: Domain name=Pyr_redox; Domain location=219-303; Score=-10.5; E_value=0.043; Accession=PF00070.18; Description =Pyridine nucleotide-disulphide oxidor
  Pfam module annotation: Pfam domain module=Amino_oxidase::DAO::Pyr _redox; Domain location=27-485::19-405::219-303
MKRALCYANDGNQQGRSPSVIVIGGGMAGIAAARSLHDASLQGSVLGDASQFRIQLVVLLESRERIGGRIHTDYSFGFPVDMGASWLHGVSNENPLASVIGRLGLPLYRTSGDNSILYDHDLESYGLFDMDGKQVPQELVAKVGEIFEAILQETDKIRQESSEDMSVLRGLSIVFDRKPELRLEGIAYKVLQWYLCRLEGWFAADTDAISLKGWDQVDVVGCIGILSSEYTIILHDCEKEVLLPGGHGLMVRGYLPVVNSLAKGLDIRLGHRVTKVVRRYNGVKVTVENGKTFFADAAVIAVPLGVLKAKKILFEPKLPDWKEAAIADLGIGLENKIILHFENVFWPNVEFLGVVADTPYECSYFLNLHKATGRAVLVYMPSGQLAKDVEKMPDEAAVNFAFMQLKKIFPDASSPIQYLVSRWGSDINSLGSYSYDAVGKPHELYERLRVPVDNLFFAGEATSMSYPGSVHGAYSTGTMAAEDCRMRVLERYGEVDLFQPVMGEEGSMSIPLQISRL

SEQ ID NO: 137127 - protein, 177 aa, Glycine max
  Coding DNA Sequence Number=SeqID_45442
  Gene Ontology: Mol. function=metalloendopeptidase activity; Cellular component=membrane; Biological process=proteolysis
  Homolog annotation: Hit_ID=Q9FLI5; Match level="QueryCoverage=46%, HitCoverage=14%, E-value=1e-10, Identity=48%"; Hit description =Similarity to peptidase
MEDASPSHYLSPLVRSLPFVPCHVSSLDFLADPFSDEVFAKMEVKADYIGLLLIASASYDPRVVPKVYEELGKFAGAAVVVSLSEDHVLSEYHPLSETLARLVSKVNLEENLSRKHMLNVSPARLESHLFLMALSTPGSLSQSSLTCTKRENGAKRAFEDRKPFLKLEVKEKRELGG

SEQ ID NO: 137128 - protein, 524 aa, Glycine max
  Coding DNA Sequence Number=SeqID_45443
  Gene Ontology: Mol. function=transcription regulator activity; Cellular component=nucleus; Biological process=regulation of transcription, DNA-dependent
  Homolog annotation: Hit_ID=A7PJR3; Match level="QueryCoverage=88%, HitCoverage=98%, E-value=1e-97, Identity=45%"; Hit description =Chromosome chr12 scaffold_18, whole genome shotgun sequence
  Pfam annotation: Domain name=HLH; Domain location=314-363; Score =65.5; E_value=1.7e-16; Accession=PF00010.17; Description=Helix-loop -helix DNA-binding domain
MNNSVPDWNFGSDSCVTSTNQKKPMMGVDQELVELLWQNGQVVHSQTHRKPVVNSSNLIQDDETVSWIQYPLEDPLEQEFCSNLLSELAPCEVESYKQIKPFEEGKFTKLDASSAPHVTDFSGIPIPAPRFHVSDSPQKNNNHLGGSCKVQNFSHFSAPLNVSSASANVHFGDKITGNMSRNEIRECSLMTVGSSYCGSNHIPQDPDASRASSNGVWTTTLSVEPEAVRDDVPKTIPQKEKGKSEMLEPAVTSSSGGSGSSLGKTCSLSTRNQGQKRKGIDVEESEEQSEDTELKSALGNKSSQRTGSARRNRAAEVHNLSERRRRDRINEKMKALQQLIPHSSKTDKASMLEEAIEYLKSLQLQLQLMWMGSGMAPIMFPGIQHYMSQMGMGMARPPFPPPIHNPMQLPRVPLDKSVSASQTPNQTLMCQNPILGAFNYQNQMQNPALSEQYVRYMGYHLMQNASQPMNVFRYGPQGVQHSQTMITPSSNSSGNMSGAANIDEAVSGKMDGDKQTLTCHHVNS

SEQ ID NO: 137129 - protein, 195 aa, Glycine max
  Coding DNA Sequence Number=SeqID_45444
  Gene Ontology: Cellular component=endoplasmic reticulum
  Homolog annotation: Hit_ID=A7PJR5; Match level="QueryCoverage=86%, HitCoverage=68%, E-value=5e-53, Identity=59%"; Hit description =Chromosome chr12 scaffold_18, whole genome shotgun sequence
  Pfam annotation: Domain name=Reticulon; Domain location=59-195; Score= 58.7; E_value=2e-14; Accession=PF02453.8; Description=Reticulon
MSEKTTAENLIENLVDTFVDKKKSVSFFEDDKSDSVSSQINRLFGRQKPVHHVLGGGKSADVLLWRNKKISASVLACATIAWVLFEWLNYNFLTILCFGLVLVMLAQFLWSNASSMFNSSPSNVPRLVLPEELFLNIATVVGGKVNMGLRFLQDAACGGNLKQFLIALYWSNVDNTYEMLCDSIIALYSIDSHHI

SEQ ID NO: 137130 - protein, 134 aa, Glycine max
  Coding DNA Sequence Number=SeqID_45445
MWRSRLHKSKHVRKLGYFEQNSELSEEYDPVISVIESNEFGHGEGHHRGGRGRDHYANFQCQVCFKFGHTTTEIDEVSLQGSLGPDGLYIFPHLAPKDYASTTCLLSNSSVDYVITSSSSCSKTNLLFHCKSSS

SEQ ID NO: 137131 - protein, 553 aa, Glycine max
  Coding DNA Sequence Number=SeqID_45446
  Gene Ontology: Mol. function=binding; Cellular component=nucleus; Biological process=metabolic process
  Homolog annotation: Hit_ID=A7PQZ4; Match level="QueryCoverage=58%, HitCoverage=84%, E-value=1e-126, Identity=42%"; Hit description =Chromosome chr6 scaffold_25, whole genome shotgun sequence
  Pfam annotation: Domain name=PPR; Domain location=149-183; Score =43.5; E_value=7.5e-10; Accession=PF01535.11; Description=PPR repeat
  Pfam annotation: Domain name=PPR; Domain location=184-218; Score =13.7; E_value=0.19; Accession=PF01535.11; Description=PPR repeat
  Pfam annotation: Domain name=PPR; Domain location=220-254; Score=6.7; E_value=1.2; Accession=PF01535.11; Description=PPR repeat
  Pfam annotation: Domain name=PPR; Domain location=287-321; Score =16.2; E_value=0.094; Accession=PF01535.11; Description=PPR repeat
  Pfam annotation: Domain name=PPR; Domain location=48-82; Score=49.6; E_value=1.1e-11; Accession=PF01535.11; Description=PPR repeat
  Pfam annotation: Domain name=PPR; Domain location=83-117; Score=7.3; E_value=1.1; Accession=PF01535.11; Description=PPR repeat
  Pfam module annotation: Pfam domain module=PPR::PPR::PPR::PPR::PPR::PP R; Domain location=149-183::184-218::220-254::287-321::48-82::83-117
MEIHEELINSGFLLDSFISSALVDMYGKCGHLEMAIEVFEQMPKKTVVAWNSMISGYGLKGKLFEALGLFSEMRKSYVEPDAITFTSVLTACSQLAALEKGEEIHNLIIEKKLDNNEVVMGALLDMYAKCGAVDEAFSVFKCLPKRDLVSWTSMITAYGSHGQAYVALELFAEMLQSNMKPDRVTFLAILSACGHAGLVDEGCYYFNQMVNVYGIIPRVEHYSCLIDLLGRAGRLHEAYEILQQNPEIRDDVELLSTLFSACRLHRNIDLGAEIARTLIDKDPDDSSTYILLSNMYASAHKWDEVRVVRSKMKELGLKKNPGRGIRKKSSVHKTKKEVDTTRMLGSLPHVTFPEESNQVLGGLLIRYLSGDEVLWGEMIGAYSDPTDRTKQKAWLNSHSVNSKLSPQKTFDCSLVVYDENEITINDCSMWIRNCTVVGLLPLFLLSKEIAVALAKDCTEGHESISSDNLVRVTHSTDVLPHILLSAVDALACILSRHGLSGIPQTSDCANTLTSINATNPKEFQTQLINQDAPQINPSEVKASEPEAIENPSN

SEQ ID NO: 137132 - protein, 199 aa, Glycine max
  Coding DNA Sequence Number=SeqID_45447
  Homolog annotation: Hit_ID=A5BPP1; Match level="QueryCoverage=51%, HitCoverage=10%, E-value=1e-14, Identity=43%"; Hit description =Putative uncharacterized protein
MVTLGDIMITITRKEIFIVWFVGHSTAILRTRRKRAHRAYAQVIYKVVEPKNPAVGYTDDTNSNDVLPKFARRGLNFFETQEESNEQNSGSNNTLSESERVTKAETEILALKKAIAKLKDEKEAGLLQYQQSLEKMSNLELEVSTAQENSRKLDEQASKAEAEVQALKEAQIKLQAESEASLLQYQEKVKKQRTLIFKQ

SEQ ID NO: 137133 - protein, 710 aa, Glycine max
  Coding DNA Sequence Number=SeqID_45448
  Homolog annotation: Hit_ID=A2Q4W6; Match level="QueryCoverage=56%, HitCoverage=60%, E-value=1e-14, Identity=19%"; Hit description=RNA -binding region RNP-1
  Pfam annotation: Domain name=RRM_1; Domain location=67-129; Score =12.0; E_value=0.012; Accession=PF00076.13; Description=RNA recognition motif. (a.k.a. RRM, RB
MSRERNTGWGRDRLRGKRVWRDRASFGEASRRHYAGNIGRAKLKHTVTNWRDHKDITSFYFSRFVDDIIEKELWYHFKKWGDVREIFIPNRRNFTGRRYGFVRFKGVQDIPYLARQLDRIVIGGLKLFVNLPKYGREVQREAAGTTQTRPCTDRKQGAEVRTHHTKPTSYANALTRNIRRSGYQITSNTPINHKTSSSSVHIEVKPEDTSWLKEAWIGPLKNQALFERLEDELLWETGMDVTPRYMGDDQVLLQGLTENEAHQLMSGGRAGGITVFSSIERWSPSLCAGCRLTWIQCWGIPVQAWNPKYINQIVAVMGELVDLDDSMEEKRRLDRARVLIRTPWRPLIQHTVEVMVGDEKFMVHIVEECCGGYSDCLRRRRSVGGSSEEINSDDSFLDSSSHINWDLAENVPHLPELESCSDLHGVISKNLGGVEDQGSPPRPYLLELESRSACHGDDAMALAGAEDQGTVLLSSGHNDCCDSLDNNLRVNGDNQGVRQWVSLPNRDAVSQDYHQNNNEGNRGHSGLAEGQKDFGAEANDVVLAKDSLDTRGNFKYKELEGHVSEEAPRITHQDEHISNYTPKDKNSKLGFNPQAGGVGIQGRFILGRGGSASHNGDSQQQHTNTLTQPGETHNDIRDLSLQQQLSNGVTKAIPVLDNQYTIEASQIWSMAKQLGLTGEGSKKAVIQKFRQMEERDRVEANRRADSNRNQ

SEQ ID NO: 137134 - protein, 159 aa, Glycine max
  Coding DNA Sequence Number=SeqID_45449
MAFLGETSSETVVNSTLGFIFPNGAIVHNDSGVFFQASTPVPIRVTNGCDFQTLKTRIHNTLKLTDKQFLDEIYYRQPFTYADQGDPYLIRKTLTDHLDPWNYLIDMLDEAQLANAILVIRKMLRRTCKVKGESLYNVKTMKNQIRKKGSKEKFYESCS

SEQ ID NO: 137135 - protein, 182 aa, Glycine max
  Coding DNA Sequence Number=SeqID_45450
  Subcellular localization annotation: CTP_CleavageSite=66; ConfidenceScore=5.80e-01
MSAPRLMLTPPPMPPPQPMPTPSPMPTPLPMSTAPPCPAPVQTFLPLFSGPLPMPVLHLSNLGLVRTTISFNKFLNIVPPYGIVMAAYKLQSVAFALCTTAKPGAIRRNKLWDPGITFGSHVLNPQHLEDKVFLQGPRNDREARVQQATSKKPSKDSNRGVQLEAKANRTTTKPSYLKDYVI

SEQ ID NO: 137136 - protein, 517 aa, Glycine max
  Coding DNA Sequence Number=SeqID_45451
  Gene Ontology: Mol. function=calcium ion binding; Cellular component =cytoskeleton; Biological process=negative regulation of actin filament depolymerization
  Homolog annotation: Hit_ID=A7P0H1; Match level="QueryCoverage=38%, HitCoverage=37%, E-value=4e-71, Identity=56%"; Hit description =Chromosome chr19 scaffold_4, whole genome shotgun sequence
  Pfam annotation: Domain name=CH; Domain location=305-422; Score=24.5; E_value=0.0004; Accession=PF00307.22; Description=Calponin homology (CH) domain
MKEGDIIFGNDIVSNNDEGNDTRDDNKQFTMASANALCSWPSERSSIAIVVCMDIVVVRKCHFSIRKSGSSFNSSIVKEGGEGDDGSLLCPLPDVFSHIATLQCGTFDMSNPITFLVRVFEFVSEHSDFLETKSAEKEVASLVCAVEKKREFLKVEREKVEKKKREDLKASKERGKSDKRLKEEKKSKAEDTNKDKSTSRVPNKGNGLDLEKYSWTQSLQEVNVNVPVPNGTKSRAYAYLLNVLAPEHCSPVTLDTKDGNERANLVLDHAERMGCKRYLTPRDVAEDTKKMSYAEMMTDDVQTSREERCFQLWINSLGISTHVNNMFEDVRNGWILLEVVDNIFPRSVNWKHATRPPIRMPFRKVENCNQLMRFTMLQLLKILRSDSQGKEITDADILKWVNRKVKSTGRTSQIESFKAWTEASSIPRALVSIILRLPRLKFTIVTLGKDGCIMLEKCVDDANAILAVSVSLAVCNAGAAVKKIPLYKHIAWLETRLWYYLCFHSMLSMEAHMQEIS

SEQ ID NO: 137137 - protein, 1333 aa, Glycine max
  Coding DNA Sequence Number=SeqID_45452
  Gene Ontology: Mol. function=geranylgeranyl-diphosphate geranylgeranyltransferase activity; Cellular component=chloroplast; Biological process=carotenoid biosynthetic process
  Homolog annotation: Hit_ID=A7NW61; Match level="QueryCoverage=75%, HitCoverage=99%, E-value=1e-152, Identity=32%"; Hit description =Chromosome chr5 scaffold_2, whole genome shotgun sequence
  Pfam annotation: Domain name=SQS_PSY; Domain location=94-347; Score =336.0; E_value=6.6e-98; Accession=PF00494.10; Description =Squalenephytoene synthase
  Pfam annotation: Domain name=mTERF; Domain location=1066-1333; Score =69.8; E_value=9.3e-18; Accession=PF02536.5; Description=mTERF
  Pfam annotation: Domain name=mTERF; Domain location=411-686; Score =84.3; E_value=3.8e-22; Accession=PF02536.5; Description=mTERF
  Pfam annotation: Domain name=mTERF; Domain location=758-1027; Score =23.0; E_value=1.3e-09; Accession=PF02536.5; Description=mTERF
  Pfam module annotation: Pfam domain module=SQS_PSY::mTERF::mTERF::mTER F; Domain location=94-347::1066-1333::411-686::758-1027
  Subcellular localization annotation: CTP_CleavageSite=55; ConfidenceScore=5.06e-01
FEMSGVLLWVSCGPKENPISIVGLGGRGGRSQRRFGLCNGISFASFSPAVADPSRSSEERVYEVVLKQAALVKEQDKGTKRALNLDKPTIEGDLTNGDLLSDAYDRRTDELVDGPNASHITPKALDRWEQRLSDVFEGRPYDMYDAALSDTVSKYPVDIQDMIEGMRLDLRKSRYNSFDELYLYCYYVAGTVGLMSVPVMGIAPESKATTESVYNAALALGIANQLTNILRDVGEDARRGRVYLPQDELAQAGLTDDDIFRGKVTDKWRNFMKGQIQRARMFFDEAEKGVSELNSASRWPVWASLLLYGQILDSIEANDYNNFTKRAYVGKVKKLLSLPAAYGRALLGPQKLTKMVTRRTSSDSESDGNHQKGGTFTVSYLINSCGVSPTLARKLSNKVNLKTPHGPNAVLDLLNNYGFDKIQVAKLVEKHPLVLLADAENTLLPKLKFLRSIGVSNTDMPKILIANHSLKRSLKKFFIPRYEILRRVLGDDQEVVRAITSSRFGINYGDAMNLVPNIEVLRQSGVPQASISFMMIHCGTVAYWKHSRFVEAVNTAKEIGFNPLRTNFIVAIEMLLISSKAVWESRFKVYERWGWNREMALQAFRKFPNVMRLSEEAFSKKMNFLVNDMGWPSEEIAEYPQVVAYNLEKRIIPRFSVIKILKSKGLLENNVSFSSIICITEEKFLENFVISLQKDLPVLPDLYRGISSDAESDDENHHKGDTFTVSYLINSWGLSPKLASELSNRVNLKNPDGPNAVINLLNKYGFEKTHLAKLAEIKPSVIAANAENTLLPKLKFFRSIGISNADMPKILIASHHMLFRSLDKCLIPRYEILSSLLRDKGEVVRALKNAPFGFTYVDMMTHLVPNIRVLRESGVPQGSISYLLMHSGTLAYRDHSKFVEAVNTAKGFGFNPLKRTFVVGVEVLANKSKAVWESRFEVYERCGWNREIALGAVRKFPSIVKLSEEVFIKKMSFLVKDMGCSSEDIAEYPQVVTYNLEKRIIPRFSIIKMLKSKGTSFDSESDGNHHKSGTFTVSYLINSCGVSPKLARELSNRVNLKNPDGPNAVLDLLKNYGFCKTKLAKLVGRHPLVLVADAENTLLPKLKFFRFIGVSDAGMPKILIANSSILKRNLEKCLIPRYEILKSVLCDDREVVRALRNSPLGFIYGDLVNALVPNIKILKQCGVAQASISLLITIALSAAYVKHSRFVEAVKTVKEIGFSPLKNNFVVAISVLVTMRKSVWDSRFEVYQRWGWNHEMSLRAFRKFPGFMIFSGETFTKKMSFLVKDMGWPSEAIAEYPQVVAYSLEKRIIPRFSVIKILKSKGVLTCTLVPLFA

SEQ ID NO: 137138 - protein, 271 aa, Glycine max
  Coding DNA Sequence Number=SeqID_45453
  Gene Ontology: Mol. function=oxidoreductase activity, acting on single donors with incorporation of molecular oxygen, incorporation of two atoms of oxygen; Cellular component=cytoplasm; Biological process=hydrogen ...
  Gene Ontology: Biological process=peroxide-mediated programmed cell death
  Homolog annotation: Hit_ID=A7P052; Match level="QueryCoverage=92%, HitCoverage=78%, E-value=3e-68, Identity=48%"; Hit description =Chromosome chr6 scaffold_3, whole genome shotgun sequence
  Pfam annotation: Domain name=2OG-FeII_Oxy; Domain location=198-264; Score=36.6; E_value=9.1e-08; Accession=PF03171.11; Description=2OG -Fe(II) oxygenase superfamily
MSSTPSNLIDFLVNQANGVKGLADLNLPNVPHQYIQSLQARLDHSKIIPQESIPIIDFTKWDIQDFIFDATTKWGFFQIVNHGIPSKVLDGLKDAVHKFFVLPAEEKKCLKVNSSPEVVRLATSFSPHAESILEWKDYLQLVYASEEKNHAHWPAICKDQALQYMKHAEVIIRKLLKVLLKKLNVKELDKPREKTLMGAMILGFNYYPACPDPEVVAGVGPHSDVSSITVLLQDDIGGLYIMSNERYKSIEHRVVAKRNQDLHSNLCQPSS

SEQ ID NO: 137139 - protein, 583 aa, Glycine max
  Coding DNA Sequence Number=SeqID_45454
  Gene Ontology: Mol. function=ATP binding; Biological process=apoptosis
  Homolog annotation: Hit_ID=A7QT35; Match level="QueryCoverage=48%, HitCoverage=71%, E-value=4e-52, Identity=43%"; Hit description =Chromosome undetermined scaffold_165, whole genome shotgun sequence
  Pfam annotation: Domain name=LRR_1; Domain location=359-381; Score =14.2; E_value=0.5; Accession=PF00560.24; Description=Leucine Rich Repeat
  Pfam annotation: Domain name=LRR_1; Domain location=383-405; Score =5.8; E_value=26; Accession=PF00560.24; Description=Leucine Rich Repeat
  Pfam annotation: Domain name=LRR_1; Domain location=515-535; Score =1.9; E_value=1.4e+02; Accession=PF00560.24; Description=Leucine Rich Repeat
  Pfam module annotation: Pfam domain module=LRR_1::LRR_1::LRR_1; Domain location=359-381::383-405::515-535
MSIRTNRFKAVDRVLKDLERVEKEGKLNDLKSELNKIKEVFLKVKENEEELLDTLAVVDGYIRNKNIAKLREEEGHFCQKIWNSTLKLLPAAHHAQAAASSGQSSHHAQAAASSGQSSHHAQAAASSGQSSHHAQAAASSGQSSHHAQAALPSGQSSHHVTPLPSSTTPQLHQEEDLQIIKDYYNSLGRFDKRCFSSLLQFPENAVFKRREISFWFSPFDQVVDPLLEGKVIVPHGNGKSPIASKFKINPLVRHKSLSPLFQNEEVPICGYYSQIKTSSSSRASDIGYLNFGPGWMAKMKDLLVLQLGRWTKDSPKHHIEVDSEEFLKELSGHEYLFCLSLRGISRIFELPPSIVKIESLETLDLKACHNLETLPSDISSLRWLRYLNLSECYLLDRMPKGIQNLTWLEVLKGFVLGSSSKTPCRISDIAARLKRLERLSIRIGSGAVIQEGEFESLEKLRRLERLKISWGVFDTRYIDIQISVPSSLKKLHLEGFPGQNIPEWLKPSKLPQELELRELHITGGKLKSLDHGENNDWGVEMVYLKYLKYLDVDLEHLRKLFPSLRYVEIKQILNQPYLEWSIN

SEQ ID NO: 137140 - protein, 95 aa, Glycine max
  Coding DNA Sequence Number=SeqID_45455
  Subcellular localization annotation: CTP_CleavageSite=19; ConfidenceScore=5.42e-01
MAMTAQSASSWEQVAKVPSKNMFSNTTFFFLKFDAFLESHGLILSFSTSLSLTNESVGEVYSKQDVLKPLKLWAKFGACCGPINFWVGLCCHGFN

SEQ ID NO: 137141 - protein, 88 aa, Glycine max
  Coding DNA Sequence Number=SeqID_45456
MSMALGFFFFFFFFWFCYSELEFLILKILVNTRAKGRCLSLLREREEELTVFSAETHSLRSEAGFWRGAPYSELVPSHDNFTVDFADQ

SEQ ID NO: 137142 - protein, 122 aa, Glycine max
  Coding DNA Sequence Number=SeqID_45457
RLRFRDYNHIVEIVFVEIVFSTYPLSWCLSQTGLRFRDCNHTPLLLGQVKVSVEEVRDADAPVPVPTDEVSLVGQTLHTFLAWLTHLVKSLSQQVVVSPPKPPPKPDPEVDDLLYLMTLTIP

SEQ ID NO: 137143 - protein, 21 aa, Glycine max
  Coding DNA Sequence Number=SeqID_45458
RIPDEDPLLEVLSPGGSHVGI

SEQ ID NO: 137144 - protein, 134 aa, Glycine max
  Coding DNA Sequence Number=SeqID_45459
  Gene Ontology: Cellular component=membrane; Biological process=amino acid transport
  Homolog annotation: Hit_ID=Q7VS75; Match level="QueryCoverage=99%, HitCoverage=79%, E-value=5e-25, Identity=40%"; Hit description =Putative amino acid efflux protein
  Pfam annotation: Domain name=LysE; Domain location=1-130; Score= -23.0; E_value=0.013; Accession=PF01810.9; Description=LysE type translocator
MGGAVLADFILVGAVASGLGVVLAASEVAFHVIKWAGAAYLAYLGWKMLRSDAALVLPAAEPGAARPAPLLPQYATVAAVLALMNILTMLAYATLGAQLVRAFRGSGLRWLNRVCGSMMIRLAGTLALYRRSGA

SEQ ID NO: 137145 - protein, 108 aa, Glycine max
  Coding DNA Sequence Number=SeqID_45460
  Subcellular localization annotation: CTP_CleavageSite=28; ConfidenceScore=5.64e-01
MDTPPSSPPPPPPSAASHSTSTLKRTTKATRLRSLATRPVGVERPLVHVDPAIGKADSLHRKKLRTYLGIVARDKVEVTYENWKQVHAAQKDLMGGYSAEFDIPEASN

SEQ ID NO: 137146 - protein, 17 aa, Glycine max
  Coding DNA Sequence Number=SeqID_45461
MDTRLHVIGDPMNGVQR

SEQ ID NO: 137147 - protein, 355 aa, Glycine max
  Coding DNA Sequence Number=SeqID_45462
  Pfam annotation: Domain name=Transposase_23; Domain location=135-205; Score=9.0; E_value=0.00012; Accession=PF03017.5; Description =TNP1ENSPM transposase
DSFEEQATLGSFVPHGRQDVLAAAIGRPEHPGRVRAVGAGVTIKQYFGSAPRTSRNASSVPPDELQQLTQQIRDPLEESITMKVTRQVMASFSQLQSQMQSQGLAVPLKPLVGPSGPQVSTKGSCVDPSRNDPETGDSDRCDLYIEADPDRLVAMGRVYEGSTVVHSTPLLPGQVKVSVEEVTDSDAPVPVPTDEVSLVGQALHDLPCLADTSAQVFITAAVSPTKLPPKPDPEVDDPLYLMTLTIPEIFLRPYQVRWDATVFGVFNPDFPLYIKHKDLSEISHSGQCLSISVLQLWILHLTETCMRVGNSDIYGFLEPQSIQRSAQSQFESESYIKSWMQSSQRDVYLGAYLNG

SEQ ID NO: 137148 - protein, 108 aa, Glycine max
  Coding DNA Sequence Number=SeqID_45463
MWAIIDQYKEKLSLTATHEQRLEDEYVKVSVLQAKREARERVIDSLHIDAMMWMDRFAFTLNGSQELPRLLAKAKAMADVYLAPEEVHGLLNYCQHMIDLMAHIIRNR

SEQ ID NO: 137149 - protein, 136 aa, Glycine max
  Coding DNA Sequence Number=SeqID_45464
MGDQATSMHTISIDMKKSLHQLLNKNPQLRVLTIHGKETPFTLKKRNQEKLLAYKGVGMSPPPLGISQSLKNSLLSLKDENLAPCSALRYLKFTLFRPLSSEQFSWLFFNSVQIRLKKGFLISTSLIEAVPESNKH

SEQ ID NO: 137150 - protein, 82 aa, Glycine max
  Coding DNA Sequence Number=SeqID_45465
MEFLQIAIGEIKRKMKKKKIASYGSRFDEEMSKIGRFEGLGTGETSQGGRGCAGVSEKRGLDGSLLVIDYMNTCNQVTGHLF

SEQ ID NO: 137151 - protein, 76 aa, Glycine max
  Coding DNA Sequence Number=SeqID_45466
MHRSPIATLRRNRAERRRKLLQDRTIASILEEETHFSDSLSLDSSSSRESTTQLPKATIMADEQHQRITLEDYSNS

SEQ ID NO: 137152 - protein, 181 aa, Glycine max
  Coding DNA Sequence Number=SeqID_45467
MGEAEEVQEKMKADMEAIKKKMATMMEAMMSMKKIMEANAVAIAATSIVAKVNPTPPSGINQMNHPTSDMHAFPPYGLPLNYTPPNVAYTPNKNVNNSTPILIKSQQPQSDHAHVSRPMEETHEIPHHDLADFEPWLGYATEGQAVGGIPFENTLEGPQFRPQPQPLHFAVGRAPPAMAEK

SEQ ID NO: 137153 - protein, 233 aa, Glycine max
  Coding DNA Sequence Number=SeqID_45468
MTFLGETSSQMIVNSRLAFIFPNGSIIHNDTGVYFQTSTPVPIRVPNSCDFASLKTRIHNTLQLSDKQFLDEIHYRKPFTDTDGIINLLERTMPRTHDAILYYNGKWNMPPQNKFVGCAFTGKNPKKFQIPSTCTIDELKNLIKQVAPKGIPPHGIHESQTVRRLFFRQPARFEYSDTIIKYEINELMTNKELLKVLVQSNYWKKYGPIEILAVFTKYVVKIEDEVTGTSLNN

SEQ ID NO: 137154 - protein, 82 aa, Glycine max
  Coding DNA Sequence Number=SeqID_45469
MKVEQLFVCHHISEERKVPLATLSFQGELMEKLQRLRQGSMSVKEYRQQMKLLLLIGGLREEEGTNIARFLRSLNMGSKRQG

SEQ ID NO: 137155 - protein, 108 aa, Glycine max
  Coding DNA Sequence Number=SeqID_45470
MGKDWGPGTADAGCWSCPGCCAYLGMQYFSMKDLLMGGQMSFVGVTDTRENWQRPVIKAGVATYPSAGGQRVTRGCVFQERNTREVATNVYLRKTSEKSEKVWSTNFK

SEQ ID NO: 137156 - protein, 80 aa, Glycine max
  Coding DNA Sequence Number=SeqID_45471
MGKAVASGGSNLARLGKLGGNHLPYFAINRGGSEEEKGSAPLALLSLSNLLGKIVSEFRKGFNRSSTFFIRSSSFFDLQR

SEQ ID NO: 137157 - protein, 113 aa, Glycine max
  Coding DNA Sequence Number=SeqID_45472
MRPNLKGKNYNSQLQIMGGIIPLVSLELSRSIGVATYPSAGGRRETRGIRVPRKEYVRSRHQRLFEENIGKTGKDAIYELLSERFGSCIYARGRVFPFAPTYSSIWDEKIRPT

SEQ ID NO: 137158 - protein, 53 aa, Glycine max
  Coding DNA Sequence Number=SeqID_45473
  Homolog annotation: Hit_ID=A5C9P0; Match level="QueryCoverage=98%, HitCoverage=5%, E-value=1e-07, Identity=50%"; Hit description =Putative uncharacterized protein
MYGKYRGTLLIATTQDGNSHVLSLAFVVIEGETLTAWSWVFGHTCMNMKQIKM

SEQ ID NO: 137159 - protein, 135 aa, Glycine max
  Coding DNA Sequence Number=SeqID_45474
MAGTFFLLKQQNSLEIMSGKKEMTPNRVGRHTQRKDAHAKVEYVKRLYDQVKMQIAKKNESYVKQAHKKRKEVVLEPGDDPEHLRTNVFQEGGNDENHETGQIQAKGPSGEGRRLKWRRIQSPRVEKDEGPSGEG

SEQ ID NO: 137160 - protein, 91 aa, Glycine max
  Coding DNA Sequence Number=SeqID_45475
MHERQSSHGAPYKIRWWRMQTALDSQFMGLRARWMHEQRLKINSWGYGLDGGGCMNDNQFMGLRIRFDDGGCTNSARQSIRGDPDSMVEDA

SEQ ID NO: 137161 - protein, 203 aa, Glycine max
  Coding DNA Sequence Number=SeqID_45476
  Homolog annotation: Hit_ID=UPI000065F7CF; Match level="QueryCoverage =45%, HitCoverage=12%, E-value=8e-07, Identity=36%"; Hit description =Homolog of Homo sapiens "Leucine-rich repeats and IQ motif containing 1
QHALSFERATSPRLQRTTRPHLARTTRPHLQRTTHPHLQRTTRPHLERATGPHLSEDYTFSPLEGYTPSPLEDYTGLHVLLLRTTCPCLQRTTRPHLERFYTALAFRGLHVAFRGQHALALRGLHPLAFRVLTFRGLHVITFRGLHVLTFRGLHALAFRGLNVLAYRGLHAISFRRIRALAFRGLHVLTFRRATRLLLKRATC

SEQ ID NO: 137162 - protein, 228 aa, Glycine max
  Coding DNA Sequence Number=SeqID_45477
MSGHSSTRQFPSRKPEGHGRTKSDLLEESSSHIAVTWPSRLKPALIKLLLMWQGGASLAYCPNCEPWPLFFLSEIFFLMSACVDLQPNPNFPRFPLPYPNITRAPIIAISDRRGYPERESTEAMLTTSKDWKAVSNDSSVACTYGIEEGQLTRTSSSPDTMTKCPSTTNFSFWWSVEGTTPTEWIHERPKRQLYEALSIREGRSLSSPLGSCRRRHGPPWNLALDGKR

SEQ ID NO: 137163 - protein, 172 aa, Glycine max
  Coding DNA Sequence Number=SeqID_45478
MTAIKITIKETSLLRKPLHLLLCKGTLVIIVIPLELEVIPQVKELLDEGMVRKSLNPCALLLPKIGIMRHQIPMIGGMMNVLRGATLFCKIIHASNIFMIHIRRDSLGVPMNPKRIKTIPEWPTPPSVEGRSPEFQEPLDLSSNPFQRGWDDAILPPRVLNRRLQEDWARDS

SEQ ID NO: 137164 - protein, 265 aa, Glycine max
  Coding DNA Sequence Number=SeqID_45479
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMCLAVYHGRICCLCQNQDFHSKEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137165 - protein, 30 aa, Glycine max
  Coding DNA Sequence Number=SeqID_45480
MGHATLSPSSYNLCPNMRSPSARYNIGDSK

SEQ ID NO: 137166 - protein, 169 aa, Glycine max
  Coding DNA Sequence Number=SeqID_45481
  Subcellular localization annotation: CTP_CleavageSite=62; ConfidenceScore=5.58e-01
RATRPRLKRVVRPHLKRATHPRLKRTAHPRFKRTARSRLLRAARLCLQRTARPRFQRTGIPRLQRASRPRLREDCMSLPSEDCTSSPSEDCTSSAFGGLHLHDFRKCCTSFPLSGLYLLLQRALHVLPFKDYRSSPLVGLYVLTIRGLHALAFRKLHVLAFRGLHILRV

SEQ ID NO: 137167 - protein, 161 aa, Glycine max
  Coding DNA Sequence Number=SeqID_45482
YYQVITSRGLLAPTSRGLTSPRLERATRPRLEKDYTSLTIRGRTTRPRLERTTRPHHQRAARPHLQRTTRPRLERATRSPWVLVTLTLRGLHVLALRGLHRPHHQRAARPHLPEGLHVLALRGLHALTLGLHVLTIRGLHALTSRGLHVLALRGLHALALE

SEQ ID NO: 137168 - protein, 54 aa, Glycine max
  Coding DNA Sequence Number=SeqID_45483
MVEWSPQCTWELVLTMKRERAQDVYEKRAIAFTNLAKRPPICGNANAPPLSLIN

SEQ ID NO: 137169 - protein, 251 aa, Glycine max
  Coding DNA Sequence Number=SeqID_45484
MDKRSWVRGQWIPYDVSAINQFLGHPLILEESQSYEYAERRSQVLGFDEEAIGQLLCSPGHDFAWSVARRQVWIMRTSMTTLTQIWMTLLLSNILPNDYNSDLPLPKCQLFDAILTQTSVHVARLISDAIYQFIGIAPLRHPVDPEKSNKGLGFSALITGLYQFYGAGRVAGARPTAAADNRCAIIASTSATIPRVHLNSHAEDGAPDAHLHAFRTTIAWPGNRPNFQGGAGPTEAQGDEDEAEEDGDMEN

SEQ ID NO: 137170 - protein, 75 aa, Glycine max
  Coding DNA Sequence Number=SeqID_45485
MVLAVLWLIPRSEWTTGDLGRITGMEFRLKSARHRVRGLQKVECGMDKEKKRSTRAPTKGQRDKEPPAAPPSFPG

SEQ ID NO: 137171 - protein, 192 aa, Glycine max
  Coding DNA Sequence Number=SeqID_45486
  Homolog annotation: Hit_ID=A5ZQM3; Match level="QueryCoverage=22%, HitCoverage=39%, E-value=2e-11, Identity=76%"; Hit description =Putative uncharacterized protein
MRTTCTWTERPYEASLFPGIGFGLFLNNLGGGQRRPPSGGARAISLPKGNGGVQRFPRARRRLALASSGRRELDCKTHPSSRDETHIDGKVWHLDVGSSPPAAVVCSKGWAVRPLKRYVSWVQKRRETVRSISGVGVRALRGPFPSTRGPGRTHLWCASYRAHEPPVAQPRQRWVLCPSGDGAKEVLRIQEK

SEQ ID NO: 137172 - protein, 76 aa, Glycine max
  Coding DNA Sequence Number=SeqID_45487
MACDLSLVLVRCLAPIIRQFVKFQDMPENQKILMHNPPFQNILEVGLLKEEATGRQAPPRFRKMVFGASAASVILP

SEQ ID NO: 137173 - protein, 66 aa, Glycine max
  Coding DNA Sequence Number=SeqID_45488
DSTSDSPQISASPYQLDLAPYASEPYNAQWNAPGLLRDKHTLRSSRILGEMEGVFAIGSAVNRLWG

SEQ ID NO: 137174 - protein, 63 aa, Glycine max
  Coding DNA Sequence Number=SeqID_45489
MARAGDNGGVYHQLDESQRLFLDAWTTQMQRLLNRNKEKPYKRIAKSSSFTPKPLSPRERRVK

SEQ ID NO: 137175 - protein, 134 aa, Glycine max
  Coding DNA Sequence Number=SeqID_45490
LLVQYQQQPSSIAIVEATVQSSQIHETSYTDYHTQIYHEGPSSYTPIPYTTINDYYVPPFEPTEFDTHITSYTQLLGGSSNYCEMTPQLNEPTQLNVNPTTDIHVAQSESNEMSHDYHAQNGFTFIKEFVSTGT

SEQ ID NO: 137176 - protein, 103 aa, Glycine max
  Coding DNA Sequence Number=SeqID_45491
MVMRIMKLVKYRLKAQVEKDEGPSGEGQSPRVEKDEGPKVILVASTHLSSFTGSGIIQISVACIKRFAPNLRVNTSGKRKEELVTMMVYIINWTIVSAYYWTR

SEQ ID NO: 137177 - protein, 30 aa, Glycine max; identical to SEQ ID NO: 121445
  Coding DNA Sequence Number=SeqID_45492

SEQ ID NO: 137178 - protein, 39 aa, Glycine max
  Coding DNA Sequence Number=SeqID_45493
MSSGKTSRNSDITGILLSYPNFVRGPLLDDMQLLFGPCE

SEQ ID NO: 137179 - protein, 112 aa, Glycine max
  Coding DNA Sequence Number=SeqID_45494
  Homolog annotation: Hit_ID=A0PAV3; Match level="QueryCoverage=42%, HitCoverage=22%, E-value=1e-07, Identity=62%"; Hit description =Restriction endonuclease
MVKVGTSYVPINVSFSPKVGPGLPGINRDTRIYLFCEVLQWLLFLSAVPPVQLLTGVVRNGKSTAGHQRWQAAQLLGRAIGAGLFAITPAGERGMCCKAIKLGNARVFPVTT

SEQ ID NO: 137180 - protein, 189 aa, Glycine max
  Coding DNA Sequence Number=SeqID_45495
  Gene Ontology: Mol. function=chloramphenicol O-acetyltransferase activity; Biological process=response to antibiotic
  Homolog annotation: Hit_ID=P62577; Match level="QueryCoverage=94%, HitCoverage=99%, E-value=8e-88, Identity=75%"; Hit description =Chloramphenicol acetyltransferase
  Pfam annotation: Domain name=CAT; Domain location=6-170; Score=260.5; E_value=3.7e-75; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSAQSLGFIMPFVMASMSAGMLYELQQYCDEWQGGRNFFKGVIGA

SEQ ID NO: 137181 - protein, 75 aa, Glycine max
  Coding DNA Sequence Number=SeqID_45496
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=A7ZTU6; Match level="QueryCoverage=100%, HitCoverage=14%, E-value=3e-32, Identity=92%"; Hit description=ATP synthase subunit alpha
MSVAQQGLVLYAAERGYLEDVELAKIGSFEAALLAYADRDHAPLMQEINQTGGYNDEIEGKLKAILDSFKATQSW

SEQ ID NO: 137182 - protein, 89 aa, Glycine max
  Coding DNA Sequence Number=SeqID_45497
FRAGCQDIVSDIVDPAASLLHLTFILHCTAIPVFSAGCQDIISDIVDPATSILHLTFYLALYSNSSILGAGCQDIVSDIVNSAAFNIYI

SEQ ID NO: 137183 - protein, 127 aa, Glycine max
  Coding DNA Sequence Number=SeqID_45498
  Homolog annotation: Hit_ID=UPI00006A17C7; Match level="QueryCoverage =94%, HitCoverage=60%, E-value=2e-07, Identity=30%"; Hit description =UPI00006A17C7 related cluster
  Subcellular localization annotation: CTP_CleavageSite=69; ConfidenceScore=5.56e-01
MKGRTCSPLKVRTCSPLKARACSPLKVRACIPLMARTCSPLKARACSPLKVRTCSPLMARACSPLKDVQSSEGEDMQSSEGEKELLVPLTGSVQARLSIKGEELEFSEGTDMEPTEGEEPSDGVGIL

SEQ ID NO: 137184 - protein, 184 aa, Glycine max
  Coding DNA Sequence Number=SeqID_45499
KLEDSVSVEGFLSVWGFNGEQRRFVVANGACGLKCLNEKCSWERKLRAYSRHRLQDPNGQIVDKCLVKLQTKFKDNPTVNEGCTVFLPRQLHVASSTSFIKRLPQKASSDQGVPMNPKRIKVIPEWPTPPTPFIELVRNHVPSWEDAQEMGVEGRSPEYEKPWDLRSNPFQGGGNDAILSRKGI

SEQ ID NO: 137185 - protein, 32 aa, Glycine max
  Coding DNA Sequence Number=SeqID_45500
VMKRLKESDIVRDSVDAIGFDVLMMIMIMCCN

SEQ ID NO: 137186 - protein, 128 aa, Glycine max
  Coding DNA Sequence Number=SeqID_45501
MAAQLIHDRVVMECLEGDWEPSKAMRVHPEEPAHTLQQPVEWILPTPTPYQLVEPVQVIEVSSSEEDLEEDPEELPPEPAVDALDFPEDDEDPLPDVDSPEDVMSASDADSTEESGLGGTTNNDDSSS

SEQ ID NO: 137187 - protein, 94 aa, Glycine max
  Coding DNA Sequence Number=SeqID_45502
  Subcellular localization annotation: CTP_CleavageSite=69; ConfidenceScore=5.10e-01
MFAHLIKRLPSLVTDAWGANTFPMRKYNSRTFHLKFVDHVFFQFFRRFPQINVGGDSAHFPFLEDAPVSLASPSRRRIGCDSSKREQRMQLSFK

SEQ ID NO: 137188 - protein, 128 aa, Glycine max
  Coding DNA Sequence Number=SeqID_45503
  Homolog annotation: Hit_ID=O52175; Match level="QueryCoverage=64%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLGN

SEQ ID NO: 137189 - protein, 195 aa, Glycine max
  Coding DNA Sequence Number=SeqID_45504
GVYLVEMGVQIATRPTWALQKIPPEGCCFWRKQPCSPGRAGLVYPLRGHRSCVEKGKATWDQLLASMEGRLLIGSLARRKEESGFYLHAKDECHQTKASRLSSHGVSVTTTRGYSKEFARHGMRHEERTESLGETVRDDEVKASEESDEVQALKAELERARVVEEKFKAAIVSSSSEEVKGIITGQRHDLEGRAK

SEQ ID NO: 137190 - protein, 99 aa, Glycine max
  Coding DNA Sequence Number=SeqID_45505
MTDPLDESISCFLTRVNPWVLIPIFFRGLHVLAFRGLHVLTFRELHVLVKSEDYTSLSSEGLHTLTFRGLHILTFRGLHPLRLKRAARPSPLEGFTSLP

SEQ ID NO: 137191 - protein, 20 aa, Glycine max
  Coding DNA Sequence Number=SeqID_45506
MKIQKKVLTKKAQSFKNLRI

SEQ ID NO: 137192 - protein, 214 aa, Glycine max
  Coding DNA Sequence Number=SeqID_45507
LLAPIISQWNNRAEFRVDVYPRQEGLLGFNSDYMVWYRRKTKMFVDPNNGEVVETLQYIVSPQGKNTWTVNDLVPYMKKLAIISEEQERITEPVSHGPTSECEFPAQEFHILQSSVETRGIGRRREPIEAEQYSQQMMERGHGMYYTPATFSQYPSQMYQYPFEGHHIDTSASEHLFGGVAKTRPHFSWPIITPSQQHDAPMATPNAPFAPQWN

SEQ ID NO: 137193 - protein, 91 aa, Glycine max
  Coding DNA Sequence Number=SeqID_45508
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 137194 - protein, 16 aa, Glycine max
  Coding DNA Sequence Number=SeqID_45509
MAPPLTSSPLSFNASP

SEQ ID NO: 137195 - protein, 97 aa, Glycine max
  Coding DNA Sequence Number=SeqID_45510
NPHAHFSSCGVDTTYTTPYRLVEPVQVLELSSSEEDLEEDPKELPPEPAMDALDLPEDDEDPLPDVDPPEDIMSASEADSTEESGPRGITNSDDSSS

SEQ ID NO: 137196 - protein, 38 aa, Glycine max
  Coding DNA Sequence Number=SeqID_45511
MGTTTGEELATQLAQASKVASSRSNSLLEEGSGMPKWA

SEQ ID NO: 137197 - protein, 102 aa, Glycine max
  Coding DNA Sequence Number=SeqID_45512
MSHYSSSANDEGRHRSHLRPHSHRREKERKPQKANINLSYFHGKDNVEAYLDWEIRVEQQLKRKSTSKSYGAHSYPKKDQGQGILGVTPFKPKDDKGKTIEK

SEQ ID NO: 137198 - protein, 185 aa, Glycine max
  Coding DNA Sequence Number=SeqID_45513
MTTLTRIWMTLLLSNILPTDHNSDLPLPKCQLDSASFGVPVAPSKVIRPPITRAFIEKYCTQRQVQGDAPQAADEPPPHQAGPAGSFDTEQYLRHLVRQQAANHRAHVQTHDCLYQMSLSLQSQGFISFPCPTPDQFRAEVAWLGDWPEAQAGEAPAEAPDEADEAREDEEMTDLLDFLGGSGAT

SEQ ID NO: 137199 - protein, 214 aa, Glycine max
  Coding DNA Sequence Number=SeqID_45514
  Subcellular localization annotation: CTP_CleavageSite=45; ConfidenceScore=5.53e-01
MNSLPSTVHVSSTNDSGAPRIYCLALFANSPFSTIIRSPMNLLPSAVHVSSTIESGAPRIYCLALFANSPFSTFIRRPMNSLPSAVHVSSTNESGAPRIYCLAMFANSPFSTFIRRPMNALPSTVHVSSTHESGTPRIYCLVLFANSPFSTFNRSPMNLLPSAVHVSSTIESGAPRIYCLALFANSPFSTFIRRPMNSLPSAVHVSSTNESEAP

SEQ ID NO: 137200 - protein, 158 aa, Glycine max
  Coding DNA Sequence Number=SeqID_45515
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=54%, HitCoverage=72%, E-value=4e-24, Identity=66%"; Hit description=LacZ protein
  Subcellular localization annotation: CTP_CleavageSite=45; ConfidenceScore=5.38e-01
DTLIQCQHSKPVYTPLAPQYANRLSPRVGRFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGRIKRGGCGGYAQRDRYTCQR

SEQ ID NO: 137201 - protein, 41 aa, Glycine max
  Coding DNA Sequence Number=SeqID_45516
  Subcellular localization annotation: CTP_CleavageSite=22; ConfidenceScore=5.01e-01
MALPSLWPFALSWPPMSAFICSCTSSTSPITLALARVRTWG

SEQ ID NO: 137202 - protein, 107 aa, Glycine max
  Coding DNA Sequence Number=SeqID_45517
MERSMIDAASGGALGDMTPAEARNLIEKMASNSQQFSARNDVIVIRGVHEVATNSSSSAETKKLEGKLDALVNLMSSPQQQQQQPAPSFQNAAGPSRPYIPPPVQQQ

SEQ ID NO: 137203 - protein, 266 aa, Glycine max
  Coding DNA Sequence Number=SeqID_45518
  Gene Ontology: Biological process=transposition, DNA-mediated
  Homolog annotation: Hit_ID=Q1J7G7; Match level="QueryCoverage=14%, HitCoverage=67%, E-value=3e-10, Identity=72%"; Hit description =Transposase
MVKVGTSYVPINVSFSPKVGPGLPGINRDTRIYLFCEVIFPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIRFVDAVKKLGGPDMYNDDIKLIDTVDLEGGPVGKPVVPAALMNRPTRGERRFAYWALAECILAYYVGTDEEYVIQGYIPLPRSLTRYARSFDCGERKWLTNGAEISWKMPGRYLTG

SEQ ID NO: 137204 - protein, 95 aa, Glycine max
  Coding DNA Sequence Number=SeqID_45519
WLHALTLGTSTLVSRGLYVLTFRGLHVLTIRGLHALTSRGLHVLALRGLHALTLGTSYPHPSEDYTSSRCLERTTRPHHPEGCTPSPPEDYKSSP

SEQ ID NO: 137205 - protein, 86 aa, Glycine max
  Coding DNA Sequence Number=SeqID_45520
MGVQIAPRPTWALWNIPPEGGEEGKKEGVSPLGTSLSFEFAWKNRFREENLSRGASETFSVRNLAKVSIVLRPFFIRSSSFFDLQR

SEQ ID NO: 137206 - protein, 142 aa, Glycine max
  Coding DNA Sequence Number=SeqID_45521
  Subcellular localization annotation: CTP_CleavageSite=80; ConfidenceScore=5.25e-01
MSPKAMSSFGRGGRSDKGVALALPELAIKKASSISFGSPTQTGSSTQKSKLDGSSTQLTSIKLESSTQDFPKPITSKQTVADYAWSIQTLQALEETGLTKVPRWSQNIGTKIPLRQLQRPSHQDSITGQRPSIRPGNFMSLS

SEQ ID NO: 137207 - protein, 86 aa, Glycine max
  Coding DNA Sequence Number=SeqID_45522
MQGLDWLPSLRTTKGVEIEAPEEDEEVQALRAELEKAQTVKEKFKLAALKIQKENAELRDVNIATTKALEQETKRARREEHGQNKF

SEQ ID NO: 137208 - protein, 62 aa, Glycine max
  Coding DNA Sequence Number=SeqID_45523
MGAKHLTRTKEWSHVIEQRSPDEIRGPSALLIPRSTWTSGLSAPTGLVTNDLNRVTFLVRFK

SEQ ID NO: 137209 - protein, 145 aa, Glycine max
  Coding DNA Sequence Number=SeqID_45524
MSGFTRNSPQISASPHQLDLAPYASEPYNAQWNAPRLLRDKHTLRSSRILGEMEVDEPWLGLWLPLNYQVDMGASFLAAKFTSWLVFLVYAKGGVRHWKCVDRLCGRFRDGFVDDWVVGTAVATWVSPSFSPSSFAPVFLFVQAG

SEQ ID NO: 137210 - protein, 90 aa, Glycine max
  Coding DNA Sequence Number=SeqID_45525
  Gene Ontology: Mol. function=peptidase activity
  Homolog annotation: Hit_ID=Q8H6W2; Match level="QueryCoverage=75%, HitCoverage=72%, E-value=7e-11, Identity=47%"; Hit description=Gag -protease polyprotein-like protein
MVHLLLINSSGGYIHFGFQREQGRGNSIHRPPIFNGEGYHYWKTCMQIFIEAIDLNIWEAIEIGPYIPTVIDVSTSTTTQKPRDKWTEED

SEQ ID NO: 137211 - protein, 174 aa, Glycine max
  Coding DNA Sequence Number=SeqID_45526
ALSSKAKGKEKEEKDSSKKIVKKENHFATKGDIKRALLLKQSFYLLLSRETSLSTAIPLELEVIPQVKELLDKGLVRKSLTPCALLVPEIGIMRHRIPMISGMMNVLNGATLFCKITHASNIFMIHIHRDSLGRGSNEPKRIKVILEWPTPPAPLIELVRNHVPSWEDAQEMGF

SEQ ID NO: 137212 - protein, 531 aa, Glycine max
  Coding DNA Sequence Number=SeqID_45527
  Gene Ontology: Mol. function=transcription factor activity; Cellular component=membrane; Biological process=regulation of transcription, DNA-dependent
  Homolog annotation: Hit_ID=A7MRI5; Match level="QueryCoverage=38%, HitCoverage=67%, E-value=1e-93, Identity=82%"; Hit description =Putative uncharacterized protein
  Pfam annotation: Domain name=HTH_1; Domain location=7-66; Score=85.1; E_value=2.2e-22; Accession=PF00126.18; Description=Bacterial regulatory helix-turn-helix protein, lysR family
  Pfam annotation: Domain name=LysR_substrate; Domain location=90-295; Score=71.4; E_value=3e-18; Accession=PF03466.11; Description=LysR substrate binding domain
  Pfam module annotation: Pfam domain module=HTH_1::LysR_substrate; Domain location=7-66::90-295
MPVNFDLNDLYAFRALVEYGNFRLAAESICLSQSALSRRIEKLEAALGARLFDRTTRRVTLTLYGQNFAQRSEQLLDNVESMLADVERASQDRTGLITVATVPSGAYYFMPEVIRRFQARYPRVRIKLIDSSVGNVMDAVSSGQADFGICFARNLPPELTFTPLVEDVYVAACRHDHPLATRQQLSWQEYFAQDYVALDKCAGASYARPAKYLRNAPCHDAAGDGRSGHRHCCRARDVDAGERASAAAPAGADRSAGHPFGRINSPQRTYAILRRCGAGKADYRTVSARLTRGLQRQRAAAIQRGRHHRREAAKQRGCQAVGQRETGDAHFCRHHFGQRRDHRTVIQAVNKRQPQQHAQHHAEGRRLRQQRQCRVGGRQRQQRHRQQHRFTPKAVRQRTANWQPDKVGDRHQQRHQQAVRGAQHQHFFAEGGRIDGNEVERGGGHRHHQHPGNHHRPVLQQRAKYLTHIQMMTARAELLCLFQTAAQNKDKRHDQAAKQERNTPAPALMALCSSAALSAKPIAAATMMATC

SEQ ID NO: 137213 - protein, 95 aa, Glycine max
  Coding DNA Sequence Number=SeqID_45528
MALTDFCSGSWSERITHFHRKQSMTIYRQGVEINPHLKGTKAGTGPPLEVTVSISLITGSPIWPTSSPPFSPWANIIRRRQGADAAGDSGSSCRL

SEQ ID NO: 137214 - protein, 262 aa, Glycine max
  Coding DNA Sequence Number=SeqID_45529
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGEYAPVNYTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137215 - protein, 128 aa, Glycine max
  Coding DNA Sequence Number=SeqID_45530
  Homolog annotation: Hit_ID=Q5QJQ3; Match level="QueryCoverage=59%, HitCoverage=89%, E-value=5e-28, Identity=59%"; Hit description =Putative uncharacterized protein
MAYERGGDFLEDARKILNREVRGPRQSRFSIGSAPLTSITKSDAQISGGETRQDYKDTRRFPLAAPSQFAPSWTVCTNPPFSPTAAPYPVTIVLSPTRKDMQKHHWQQPLVIDLEELVFEVMRRLRLN

SEQ ID NO: 137216 - protein, 233 aa, Glycine max
  Coding DNA Sequence Number=SeqID_45531
  Homolog annotation: Hit_ID=UPI000065F7CF; Match level="QueryCoverage =36%, HitCoverage=11%, E-value=6e-07, Identity=35%"; Hit description =Homolog of Homo sapiens "Leucine-rich repeats and IQ motif containing 1
LHAFAVRRLHVLTFKGLHVLAIRGLHALTFRGLDTLAFKGLHVLHLERAARPHLQRTTRPHNERATRLHVLTFRGLHALTFRGLTSSPSEGCKCSATEDYTAAQPSPLEGCTPPSEDYMSSLLRGLHPRLRVRTFEDYVLTFRGLHALTLRRATRPHHQRAQHALMRTTYPHLQRATRPHLKRAARPHHQSAARPHLQRATRPHLQRATRPHLQRAARPRVQRTTRPHLQRAT

SEQ ID NO: 137217 - protein, 85 aa, Glycine max
  Coding DNA Sequence Number=SeqID_45532
MFSKNEGMMRILKLAKYRLKAQVEKAEGRSNPSGVYPDLSSFTGSGVYPDLSSFIGSGVIQIFVACIKRSAPTQVHIIWYQSFGS

SEQ ID NO: 137218 - protein, 62 aa, Glycine max
  Coding DNA Sequence Number=SeqID_45533
MVFHLRLVVNFKTRKGKQGSKRLSKELIQDMHVNWDASTRNFKPRLLSINGAKHTGMIERNG

SEQ ID NO: 137219 - protein, 284 aa, Glycine max
  Coding DNA Sequence Number=SeqID_45534
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVDHLRSGFLDQPGQQQENHLNHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137220 - protein, 298 aa, Glycine max
  Coding DNA Sequence Number=SeqID_45535
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIVCSGGLINAYYRTCLQFTRKSRNSYPARATLYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137221 - protein, 141 aa, Glycine max
  Coding DNA Sequence Number=SeqID_45536
  Gene Ontology: Mol. function=endonuclease activity
  Homolog annotation: Hit_ID=Q9AY32; Match level="QueryCoverage=38%, HitCoverage=81%, E-value=9e-22, Identity=96%"; Hit description=RRNA intron-encoded homing endonuclease
KKLVVGPWVGSIGPPPVCTGRLVPSAGDALLSLTGRVVPPDSDPIVLAFGIGVMINRDSRGHSYFIVRDTVLVSTINDADQGSADVAFRTPLAPYEKSKSLGSGGSMVARLKLKGIDGRAPPEWSLRLNLTQHGETYQSRH

SEQ ID NO: 137222 - protein, 196 aa, Glycine max
  Coding DNA Sequence Number=SeqID_45537
  Homolog annotation: Hit_ID=Q6WAY4; Match level="QueryCoverage=85%, HitCoverage=30%, E-value=6e-15, Identity=30%"; Hit description =Putative uncharacterized protein
MGTNQTGKKFYQVKVKSLGITSLKELGQFMGQLQRQAFRKAYGKIWDLAMVEVSTEAIASLTQYYDQPLRCFTFGDFQLSPMVEEFEEILGCPLWGRRPYLFYGFYPSLGRISKIVQISAQELDHRKQVKNGVVGIPRKYLEAKAIILAGKGEWAPFIDILTLLIFGGFLFPNVDGLVDLAAIDAFLAYHDHKESP

SEQ ID NO: 137223 - protein, 70 aa, Glycine max
  Coding DNA Sequence Number=SeqID_45538
MGRIKFVIIKKGDIVEASFMMMNQAILMMPKAQVSDSRLIQDFKIKHKSHPRFKIQEKKSRSNKSRHHIG

SEQ ID NO: 137224 - protein, 119 aa, Glycine max
  Coding DNA Sequence Number=SeqID_45539
MEAMKEQMATMMEAMMSMKKIMEANAVAISTTSVVAKVNPMPQWPQPNESSNLRYADFEPCLGYATEGQVVGGILLQNTLEGPQFCPQPQTLHSAAGKIPPIMEGMGKVGSFRGKAQGR

SEQ ID NO: 137225 - protein, 241 aa, Glycine max
  Coding DNA Sequence Number=SeqID_45540
MPTNNREIEAALRIPSRGFVLNVESHPRKILMKDLTTLAQVWSVLSYSNLAPTSHTSDLTLDRARLIFGLVSQLDMNVGALISGQITSMAQSNSSTLGFPALITTLCRSRGVASNSLVFERLSPVINLAYIRKNCWIPTDLAVTIRGARRARARPAKALSTSATPPLARTSAAPSTPSSTDFQRLEAMCHTQISSGDYYLMTCNLWLAALRYLASFVAQKMKSRDVSEIKRKQAYAIREIP

SEQ ID NO: 137226 - protein, 88 aa, Glycine max
  Coding DNA Sequence Number=SeqID_45541
MLLIPLDVSSIGACRPRIFFINGFIFFLEDQWQWNGERKRERRRHFKEKMSLEEAHHHRRPWIRAWRKKERKRRARNFVREMTWKSEV

SEQ ID NO: 137227 - protein, 150 aa, Glycine max
  Coding DNA Sequence Number=SeqID_45542
MKQSHSPNFTKSYSYIIGAFHRALGGCMFGHKLQENGGNVACPIASEYNTAPRPSHTNPQLNKSSIKATQNCLTNISTFSQFRAPKDEENTSMVSQRALLRASKARLTGVLSKGGKMRGVATNVYLWETSEKPKETGQNENSKFGSCIYA

SEQ ID NO: 137228 - protein, 340 aa, Glycine max
  Coding DNA Sequence Number=SeqID_45543
GKFDYVSSTSANANRIGATGAKRKEGDTHVVTSAPAWVKPPQASHGTHQYAQHHPSFSACVGNSSNSTPVQPRASAPIQREAPQASAPTTTRPADNAHFGASSNMMRNFPPKPILEFTPLPMTYQDLLSSLIVNQMAIITPGKIYQPPFPKWFDPNATCTSKPLKDVATPRRFIFETLQMGGVIPHSGHEEDSCLLHPSELHDMESCLAVEELLQQMIDQGRLEVGDEGREEQHICMQSADERSLGRPKPLVIYFTKDAASQKPRYPSAAKLVPFPYQNSHAVPWRYTPLSERKEEATDISSLSAKVTNITRLSGVTRSGLVFAPPDLPTQPANIKGKAK

SEQ ID NO: 137229 - protein, 30 aa, Glycine max
  Coding DNA Sequence Number=SeqID_45544
EGPVFRGFWSQTQVPGIAPYRVVLEYIKDK

SEQ ID NO: 137230 - protein, 214 aa, Glycine max
  Coding DNA Sequence Number=SeqID_45545
  Gene Ontology: Mol. function=dTDP-4-dehydrorhamnose reductase activity; Biological process=extracellular polysaccharide biosynthetic process
  Homolog annotation: Hit_ID=Q46769; Match level="QueryCoverage=52%, HitCoverage=42%, E-value=1e-34, Identity=64%"; Hit description=dTDP -4-dehydrorhamnose reductase
  Pfam annotation: Domain name=RmlD_sub_bind; Domain location=13-186; Score=-49.1; E_value=1.1e-09; Accession=PF04321.8; Description=RmlD substrate binding domain
TDGVVRNGKSTARTSALASVAAAQLLGRAIGAGLFAITPAGERGMCCKAIKLGNARVFPEFDVYAGKGNNFAKTMLRLAKEREELAVINDQFGAPTGAELLADCTAHAIRVALNKPDVAGLYHLVASGAQSRHSLALNKLNAVPTTAYPTPARRPHNSRLNTIKLIDTVDLEGGPVGKPVVPAALMNRPTRGERRFAYWALAECILAYYVGTDE

SEQ ID NO: 137231 - protein, 262 aa, Glycine max
  Coding DNA Sequence Number=SeqID_45546
  Gene Ontology: Mol. function=RNA-directed DNA polymerase activity; Biological process=RNA-dependent DNA replication
  Homolog annotation: Hit_ID=Q0ZCD0; Match level="QueryCoverage=79%, HitCoverage=19%, E-value=4e-11, Identity=27%"; Hit description =Integrase
MTSNSQQFSARNDAIVLRGVHEVATDSSLFAENKKLEGKLDVLVNLVTQLAMNQKSASVPVARVCGLCSSADHHTDLCLSLQLSGVNEQPEAYAANIYNRPPQQQNQQQQTNYDLSSNKYNPSWRNNPNLRWASPPQQQQPVPPFQNVAGPRKPYVPPPMQQQQRQQATEALPQPSLEELQETGASIQSLTNQMGQMATQLNQAQSQNSDKLPSQTVQNPKNVSAITLRSGKQTEVPLPIAALAPKHVKLHSTPENEDEIVA

SEQ ID NO: 137232 - protein, 300 aa, Glycine max
  Coding DNA Sequence Number=SeqID_45547
MRGAPTEESLSPFLVRDLPAQGLKVIQRIHMAWRSPLRKDKELRGIRNGVIGGYHGWLRIHTRGLDWLSKLKVIDEENFEAPEEDEEVRALKLELGKARLAKEKFKSAATHIRKECTELQEENAATARALEQETKRARKEEYGREKFRGALWGSNNELKLRREERDRSRVHGMILKEELVACARSKRSLAQHLEATEQSMLAIIGQYKEELNQSMAHEQKLVEDFAQVYAEKEARGRVIDALHQEATMWMDSSPDLEWKSRPPASISQSKSHGRSVYCPRGDSWANQLLSTHDRFDGPYN

SEQ ID NO: 137233 - protein, 127 aa, Glycine max
  Coding DNA Sequence Number=SeqID_45548
  Homolog annotation: Hit_ID=A2Q186; Match level="QueryCoverage=56%, HitCoverage=18%, E-value=2e-09, Identity=36%"; Hit description =Reverse transcriptase-beet retrotransposon, putative
MNANRNRNSIRGVFIDGSWTDDPHKVKEEVKSFFFHRFQEPIGQRPKIDGIRFQTVNLQQNNELLAPFMDEEIQKAIFKAAYEGRQFTKGLHGFNGNRYAYQKKRLAWASRILKHSTSHYLENGSGN

SEQ ID NO: 137234 - protein, 43 aa, Glycine max
  Coding DNA Sequence Number=SeqID_45549
MEAMKEQVTTMMEAMLSMRRIMEVNAATAVAASTAIEVDLTHC

SEQ ID NO: 137235 - protein, 69 aa, Glycine max
  Coding DNA Sequence Number=SeqID_45550
MVPSGIANYRNLPFGGRAKRGLTGASSMGGKCAESPPTFIQGKCRKNRKKHGLRTLSVKGSRVVFTHGE

SEQ ID NO: 137236 - protein, 125 aa, Glycine max
  Coding DNA Sequence Number=SeqID_45551
MKVEQLFAYHHISEERKVPLATFSFQGVPLGRGTLPSIVKGSLWTCSKGLDKNNQTRPLQRISICFKINSRMLQQTKALVSDSQKIKPCLKTKGFKVMQGSGKLITWKCNQLPEGKNEKEMLKGF

SEQ ID NO: 137237 - protein, 212 aa, Glycine max
  Coding DNA Sequence Number=SeqID_45552
  Gene Ontology: Mol. function=phosphoprotein phosphatase activity; Cellular component=membrane
  Homolog annotation: Hit_ID=A7PWW8; Match level="QueryCoverage=43%, HitCoverage=34%, E-value=4e-17, Identity=47%"; Hit description =Chromosome chr19 scaffold_35, whole genome shotgun sequence
MTCSSSCSSSIQTRSDPIDCDVLWMQPKHVLEHVWTGEPDRKLHIRRAVPTYQGVRPQEGEIEGSVVKLSWLAHHFSHMNIDEDNVEQLQRFTRAWILRFIGGVLFINKSSSRVSLRYLQFLRDFEQCSTYAWGPAVLAYLYRKMYVSHDESFAYDSSQSPYSIAMTFCFANQAFLYDTLYANSLLILSSIKEIFIDGSSLIMPVNNITKFQ

SEQ ID NO: 137238 - protein, 112 aa, Glycine max
  Coding DNA Sequence Number=SeqID_45553
MSLHVLYLYAFSGFPPGISCLLYLSLQSFKEMNVDLRLFSPHGQDHLGLPSGVKTKHERQKPIKVLKDERKQGWGHDRPIVTFFCAKQAGNVAARQPRILCILRLSFTICLF

SEQ ID NO: 137239 - protein, 130 aa, Glycine max
  Coding DNA Sequence Number=SeqID_45554
MGEVEEVQEQMKANMEAMKEQMATMMEAMMSMKKIMEANAVAIAATSATAEEDLTPPYGLNQINHPTPDMVGLEGKELGGTGGPHYAQIQNNHVFPPYGLPPNYTPPNVAYTPSEDVNNSTPIPIESRQP

SEQ ID NO: 137240 - protein, 45 aa, Glycine max
  Coding DNA Sequence Number=SeqID_45555
MPLQGEDKSRTSSPTLETMDKSLKVGEDERREKERRGTKFCASNE

SEQ ID NO: 137241 - protein, 76 aa, Glycine max
  Coding DNA Sequence Number=SeqID_45556
MHLRDQGSLLNNKEKNKMKDCKNTSGEDVSFTSRISQSLTNSSQALKPALASSSGLYRSLYSKISQNSLELGPFSL

SEQ ID NO: 137242 - protein, 113 aa, Glycine max
  Coding DNA Sequence Number=SeqID_45557
MMTTKYDDKSDEQKAQVNQRTSISRIKIQDSSSRIKKNSRLKKKAYKQRFKISRIKIKIQDLKNQDQDSRSQESRSRFKNQESRIKTQDLKISRIKIKIQDSRFKNEEKTQSR

SEQ ID NO: 137243 - protein, 98 aa, Glycine max
  Coding DNA Sequence Number=SeqID_45558
HLSNTINPKRIKVIPEWPTPPTPLIEMVRNHDPSWEDAQEMGFQTLPYFNIPSTTNTYVFVLFTSVEEKSPEFQEPWDLRSNPFQGGGNDAMYFVPQM

SEQ ID NO: 137244 - protein, 15 aa, Glycine max
  Coding DNA Sequence Number=SeqID_45559
GTLKRVAWGLDVEAQ

SEQ ID NO: 137245 - protein, 107 aa, Glycine max
  Coding DNA Sequence Number=SeqID_45560
  Subcellular localization annotation: CTP_CleavageSite=38; ConfidenceScore=5.11e-01
TYQGNPCGVYPDLSSFIGSGVYPDLSSFTGSGVYPDLSSFTGSGVYPDLSSFTGSGVYLDLSSFIGSGVYPDLSSFTGSGVIKTFVACIKQSAPTQVYIIWYQSFGS

SEQ ID NO: 137246 - protein, 112 aa, Glycine max
  Coding DNA Sequence Number=SeqID_45561
ALEVVSNAYMESLPMLLCSFGVALMVAQENGIASLVEFIENRGRFGLGYEPTCTDKRKIALERRERSSTQSQGLKVERIPFCHIDESFVSAGWMCKGWVAVIDEETPQDQPI

SEQ ID NO: 137247 - protein, 46 aa, Glycine max
  Coding DNA Sequence Number=SeqID_45562
MRLPIDAILRRKGPVTRAMSKRLQEDWARAAEEGPRVLMNLRGSIL

SEQ ID NO: 137248 - protein, 100 aa, Glycine max
  Coding DNA Sequence Number=SeqID_45563
MAEKGKADHLKERLRAIEGGEDYAFANLGKLFLEPNIITPPKFKVLDFDKMQLQNMCKKGDGSFKEHAQKVEGSGGPGGTPNNGKGDDNRDGRHIIGTLL

SEQ ID NO: 137249 - protein, 68 aa, Glycine max
  Coding DNA Sequence Number=SeqID_45564
  Homolog annotation: Hit_ID=A5ACR1; Match level="QueryCoverage=100%, HitCoverage=3%, E-value=1e-07, Identity=39%"; Hit description =Putative uncharacterized protein
MAEYEAFALGIQAAIDFDAKLLKVYGDSALEERDGKPWYFDIKQYVKNKEYPPGISEHDKRTLRRLAT

SEQ ID NO: 137250 - protein, 106 aa, Glycine max
  Coding DNA Sequence Number=SeqID_45565
  Homolog annotation: Hit_ID=A6FJQ2; Match level="QueryCoverage=35%, HitCoverage=84%, E-value=2e-11, Identity=92%"; Hit description=50S ribosomal protein L5
MRKEKIPHQAPFAIQAAQLLGRAIGAGLFAITPAGERGMCCKAIKLGNARDGDLDLNASPQALDKLLGHVLAFKACSKIDPSNVDCNDATQAERFMLYAAISVCHS

SEQ ID NO: 137251 - protein, 91 aa, Glycine max
  Coding DNA Sequence Number=SeqID_45566
  Subcellular localization annotation: CTP_CleavageSite=57; ConfidenceScore=5.16e-01
MESKWVFQRKRKNIQWWFQSKKRCKDKMNITRNKRRITVTSNKTVKGFNGELWRFVVATSGCGVVKKKLGTLGKGFGRKKEKVMVVFQGYT

SEQ ID NO: 137252 - protein, 281 aa, Glycine max
  Coding DNA Sequence Number=SeqID_45567
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=98%, HitCoverage=30%, E-value=1e-151, Identity=83%"; Hit description=DNA -directed RNA polymerase subunit beta
  Pfam annotation: Domain name=RNA_pol_Rpb2_6; Domain location=1-270; Score=300.5; E_value=3.3e-87; Accession=PF00562.19; Description=RNA polymerase Rpb2, domain 6
MPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQEIKWLGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQRVGGGIL

SEQ ID NO: 137253 - protein, 102 aa, Glycine max
  Coding DNA Sequence Number=SeqID_45568
MSRGSGDLGDVRWGAIAQNQAWPIPTQPGHSQLVRTCGVPKQCYMLLVIDYQLCVIDYTVSYATGNRLPFMCNRLHGVTFRFQCVKAVVIHFWALVIDYILW

SEQ ID NO: 137254 - protein, 53 aa, Glycine max
  Coding DNA Sequence Number=SeqID_45569
MLSFCIINFKATTIHHPKAFSEELTKRAYRAKRVHPLRMNTHPLAELPVAKRG

SEQ ID NO: 137255 - protein, 84 aa, Glycine max
  Coding DNA Sequence Number=SeqID_45570
  Homolog annotation: Hit_ID=UPI0000ECBAF8; Match level="QueryCoverage =48%, HitCoverage=48%, E-value=1e-16, Identity=100%"; Hit description= UPI0000ECBAF8 related cluster
MTNTFNTRDTLRYTVAEVLEQEAMKEGSRPAGMQAWHWPSFYNVVTGKTLALPNLIALQHIPLSPAGVIAKRPAPIALPNSCAA

SEQ ID NO: 137256 - protein, 128 aa, Glycine max
  Coding DNA Sequence Number=SeqID_45571
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAKPRHMKLKGPQLKKRRYSGIL

SEQ ID NO: 137257 - protein, 105 aa, Glycine max
  Coding DNA Sequence Number=SeqID_45572
MEQKDLEAATILEEEPQSSKASSSFPIAGHFHLDPIKDHIMAKDPRRVTLEDYSSSNMPQFFSSIAQPEVQAQTITYPPSLIQLIQNNLFHGLPNEDPYAHLPPT

SEQ ID NO: 137258 - protein, 94 aa, Glycine max
  Coding DNA Sequence Number=SeqID_45573
MEKSEKKNINEKKLKKAYITWDENDMESSEDSENEEINPCLMAKSYESDEEAIDLNILGPRTSYVPSINSRKVQSNLEKPSSNCEKQRLDLLVQ

SEQ ID NO: 137259 - protein, 151 aa, Glycine max
  Coding DNA Sequence Number=SeqID_45574
  Subcellular localization annotation: CTP_CleavageSite=77; ConfidenceScore=5.18e-01
SLTFESFSPAINLAYIKKNCWNLDDPTVSFPGTHKARARGSEGPSSAAPQTSTTPAPIPSTLVPVTSGPSTQSIDLMMAMLQSIHQGGLARSLAFFSWRRGKSSDYGGQSIGITNIYTSVGAEHPQGSPTGTLVLHLTNDEAMDQDPPQDQ

SEQ ID NO: 137260 - protein, 157 aa, Glycine max
  Coding DNA Sequence Number=SeqID_45575
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLPTWAFQILPPEGCCFWRKQPYSPGRAELAWARRRGSAFLALLILSKLLRKIVSVKKIQAEALPLQL

SEQ ID NO: 137261 - protein, 116 aa, Glycine max
  Coding DNA Sequence Number=SeqID_45576
  Homolog annotation: Hit_ID=UPI00016621D1; Match level="QueryCoverage =75%, HitCoverage=36%, E-value=7e-08, Identity=42%"; Hit description =UPI00016621D1 related cluster
MTDPLNESISCFLIKVSPWVLVPIALRGLHALAFRGLHVLTFKGLHVLTFKGLHVLTFRGLHILAFRGIHVLTFRGLHVLPFRGLHVLTFRGLHVLTFKELHALAFRGLRTLMMRT

SEQ ID NO: 137262 - protein, 55 aa, Glycine max
  Coding DNA Sequence Number=SeqID_45577
  Gene Ontology: Mol. function=NADH dehydrogenase (ubiquinone) activity; Cellular component=mitochondrial respiratory chain; Biological process=mitochondrial electron transport, NADH to ubiquinone
  Homolog annotation: Hit_ID=Q04614; Match level="QueryCoverage=80%, HitCoverage=44%, E-value=4e-13, Identity=93%"; Hit description=NADH -ubiquinone oxidoreductase chain 4L
MGQSFASLVSTVAAAESAIGLAIFVITFRVRGTIAVEFINSIQGSGPFSLASASD

SEQ ID NO: 137263 - protein, 150 aa, Glycine max
  Coding DNA Sequence Number=SeqID_45578
MEDSHEWWSVVVVQPLLNREDMIVGVHYGVFGKPIKVDLNTLNAEYRRFARVYVEFAPPMAIMVIGVGSALTNLKWRRWLQTLMQGWRWQKPKTTTFVSHTDFARSNPINEPHSNTPLTPAKGNFINGSTKGKGVAATTLQTSTEPFRLS

SEQ ID NO: 137264 - protein, 252 aa, Glycine max
  Coding DNA Sequence Number=SeqID_45579
MEFFSNENFECFQAFENSNLIPFMSLKLPVYSELVKAFYSNLEIHEGILMSEIYGIKMVIDQSLFYDLTKLPSEGVPFEGALIDEWKFDFSMHDARRVVCTNQADMTRRLLAGSLAFESRILHYLIVLILLPRSSNLAQVSEEDLIVMWAFHKGASVIASFGYQKEHDGSWVKKGAQHVDEEGHGGEDSSLLQKILDRFDGLQTFVGERFDTLELQVDIRFNEMESRITKVKEDVSYICSSFDLPPPSPPSS

SEQ ID NO: 137265 - protein, 137 aa, Glycine max
  Coding DNA Sequence Number=SeqID_45580
MIIKGQDIYSSQDETTTSASSSESEEAKAEESSEEIYPQEEGQPLMVKEECKEVSVSSKRLAKKERHFEIKTNTKEISPLRQPPHFVLCKKTFVSIATPLRLEFIPQVKELLDEGLICKSLNPCALLVPKIVIKGFP

SEQ ID NO: 137266 - protein, 100 aa, Glycine max
  Coding DNA Sequence Number=SeqID_45581
MEIISKRFEELDVCGKVTLKSKLWEIAYSYLNSMCPPPEKVNTKGAQKKPKMETANFLMSPLHKIDISPRSPIFNEHAIKGLNLVATTNPSISAAGLPNF

SEQ ID NO: 137267 - protein, 76 aa, Glycine max
  Coding DNA Sequence Number=SeqID_45582
  Homolog annotation: Hit_ID=B0HC01; Match level="QueryCoverage=46%, HitCoverage=74%, E-value=3e-12, Identity=100%"; Hit description =Putative uncharacterized protein
MRKRHRFPKGERRTGGRSLWKNASNAGLFYGSWPFAGLLLTCSFLRYPLILWITVLPPLSELIPLAAAERPSAASQ

SEQ ID NO: 137268 - protein, 174 aa, Glycine max
  Coding DNA Sequence Number=SeqID_45583
MPSSFVDLGFAGKRIEVGLKRGKFDYVSSTGANAGRIGATGAKKKEGDTHAVTSAPAWVKLPQASHGTHQYAQHHASFSAHAGNFSNAAPAQPRAPAPIQRGAPLSSGSNHDSPGRQCPLWFQFQHDENLSPEANSRIHPTPNDVRRPLAVPHRQPNGCDNSREDLPIPFPKVV

SEQ ID NO: 137269 - protein, 168 aa, Glycine max
  Coding DNA Sequence Number=SeqID_45584
  Homolog annotation: Hit_ID=A6TIQ8; Match level="QueryCoverage=100%, HitCoverage=100%, E-value=5e-76, Identity=77%"; Hit description =Putative uncharacterized protein
  Pfam annotation: Domain name=ArdA; Domain location=9-168; Score =293.9; E_value=3.1e-85; Accession=PF07275.2; Description =Antirestriction protein (ArdA)
MSITTTTPAVYVGTWHKYNCGSIFGKWFDLTEFDGREDFYEACQALHADEWDAEFMFQDWEGIPSQFASESSIDWDFIAAYKRAEEEGREAAFIAWAEYTGECDYDAFDDAYRGEAESEEEFAHGFVEDNALLNDVPESLRVYFDYEAYARDLFSSGYVFHGGYVFSN

SEQ ID NO: 137270 - protein, 87 aa, Glycine max
  Coding DNA Sequence Number=SeqID_45585
  Homolog annotation: Hit_ID=Q51617; Match level="QueryCoverage=70%, HitCoverage=88%, E-value=1e-16, Identity=75%"; Hit description =Putative uncharacterized protein
  Subcellular localization annotation: CTP_CleavageSite=71; ConfidenceScore=5.93e-01
MVMAALHNSLTVMPSVRCFSVTGVSRGPFVSRVSVMTVKTSDTCSSRRRSQLVCKRMPGADKPVRARQRVLAGVGAGLTMRHQSRLY

SEQ ID NO: 137271 - protein, 77 aa, Glycine max
  Coding DNA Sequence Number=SeqID_45586
MVFHLRLVVSFKTRKGKQGSKGLSKELIQGRINRIKPRLCASINGANTPNDYNDDGSNSHKGKIITFKLSFQNYHDM

SEQ ID NO: 137272 - protein, 398 aa, Glycine max
  Coding DNA Sequence Number=SeqID_45587
  Gene Ontology: Mol. function=sequence-specific DNA binding; Cellular component=cytoplasm
  Homolog annotation: Hit_ID=Q1GY08; Match level="QueryCoverage=32%, HitCoverage=72%, E-value=8e-27, Identity=45%"; Hit description=ProQ activator of osmoprotectant transporter ProP
  Pfam annotation: Domain name=ProQ; Domain location=111-273; Score =100.9; E_value=4e-27; Accession=PF04352.4; Description=ProQ activator of osmoprotectant transporter ProP
MWRLLDKAPMSMLEVKAVYESMPSDLRSIFVEPEYKIKGIFWKRLSEPESFIEALRKFQPLPVFIALLAMVKEAEITQDQWTHYLALKTAIDINLGTEESKKKQQAKPTKPKNTTPVDPVVLIIGKLQKLYPKAFPKNPTPKVPLKIGILEDLQARSEEISISKEDLQLAIKTWCKSSRYWQACKEGADRLDLDGNPVGVVETTGAAHAKGMVRKQAKAKQTPTETTQNYPHTRNSIGTVAHPSRGVSPRLAGANIHAFTTSCASSSRIFRPLDCFTSTEPALPLASTRTRTGGGCTTGPAATDSVDVVGAAATGPSLRLSQKKLGIAAGIDEFTASPRMNQYERGVHIPDYSTLERLAQVLEVPVPYFYAADDELADWIKCFPRLGKAEREKIIAAS

SEQ ID NO: 137273 - protein, 15 aa, Glycine max
  Coding DNA Sequence Number=SeqID_45588
MVQLFQHEIQKDLHM

SEQ ID NO: 137274 - protein, 62 aa, Glycine max
  Coding DNA Sequence Number=SeqID_45589
  Homolog annotation: Hit_ID=A5BYF6; Match level="QueryCoverage=100%, HitCoverage=10%, E-value=1e-17, Identity=66%"; Hit description =Putative uncharacterized protein
YQQGSDYNIGTANEHKTFSLAMSSKESNLWHNAMKDEMDSMAFNQVWDLIQLPSGVKVIGCR

SEQ ID NO: 137275 - protein, 76 aa, Glycine max
  Coding DNA Sequence Number=SeqID_45590
FLQKAVASGGSNPARLGELGGNHLPYFAINRGGRQEGRAEAPPKRFRNVFREESRKAFNRSSTFFIRSSSFFDLQR

SEQ ID NO: 137276 - protein, 144 aa, Glycine max
  Coding DNA Sequence Number=SeqID_45591
  Homolog annotation: Hit_ID=A7PC13; Match level="QueryCoverage=63%, HitCoverage=10%, E-value=1e-07, Identity=39%"; Hit description =Chromosome chr2 scaffold_11, whole genome shotgun sequence
MFLSPRKIKWDEVTLPERWVMDKATPSIPRPAPTIEHIKQDNSGKTTLIGTVEDIIGLRSNIFQQCIHNKTVSLMDRNPVLDSLPKHPVFHGLDMKEGSIPAALIYRIQYKVMNTCASRVLLKPQKGETTLFITDMTKLRRVSR

SEQ ID NO: 137277 - protein, 72 aa, Glycine max
  Coding DNA Sequence Number=SeqID_45592
MPIDWTSQKSGADIEEEELTYLRSNPLQGEGDDAILPRKGPVTIAMSKRLQEDWARAVEEGPRVLMNLKVEL

SEQ ID NO: 137278 - protein, 34 aa, Glycine max
  Coding DNA Sequence Number=SeqID_45593
MASYGEAKDSIDEEDPRPTSFTWSYIMWYQSIFI

SEQ ID NO: 137279 - protein, 178 aa, Glycine max
  Coding DNA Sequence Number=SeqID_45594
  Gene Ontology: Mol. function=DNA-directed RNA polymerase activity; Cellular component=chloroplast; Biological process=transcription, DNA-dependent
  Homolog annotation: Hit_ID=Q8HVY3; Match level="QueryCoverage=90%, HitCoverage=11%, E-value=2e-79, Identity=96%"; Hit description=DNA -directed RNA polymerase subunit beta''
MNLEKRVDTWNGRITKILASLGILIGAELTIAQSRISLVNKIQKVYRSQGVHIHNRHIEIIVRQITSKVLVSEDGMSNVFLPGELIGLLRAERAGRSLEEAICYRVLLLGITKTSLNTQSFISEASFQETARVLSKAALRGRIDWLKGLKENVVLGGMIPVEKMARSFIKGQSSVEEK

SEQ ID NO: 137280 - protein, 265 aa, Glycine max
  Coding DNA Sequence Number=SeqID_45595
MAKFDPEIVLEFYANAWPTEEGVRDMRSWVRGQWIPFDADAISQLLGYPMVLEEGQECEYGQRRNRSDGFDEEAIAQLLCIPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKMSLSMQSQGFAPFSCPTPDQFRAEVAWPGDWPEAQAGEAPPEAPGDGEEAHEDEEMADLLDFLGGSGDT

SEQ ID NO: 137281 - protein, 61 aa, Glycine max
  Coding DNA Sequence Number=SeqID_45596
MESPTVATYPSAGGRRGAHGFVFHGRKMHGVTTNVYSRKTSEKPEKVDKGVSLAPTYPQLR

SEQ ID NO: 137282 - protein, 45 aa, Glycine max
  Coding DNA Sequence Number=SeqID_45597
MQFAEHLLPASQLCLVPGQDSLTIARGGPSADGTVRARQRRRTDH

SEQ ID NO: 137283 - protein, 257 aa, Glycine max
  Coding DNA Sequence Number=SeqID_45598
  Homolog annotation: Hit_ID=A2Q480; Match level="QueryCoverage=74%, HitCoverage=27%, E-value=4e-57, Identity=60%"; Hit description=Emr1, related
MGNQELLDCFCDYAALKARHSYGPQGHRGMSALIFEESTIGYLEALRLHKHFKEQGIDREAWDCYQNPFLPGGKRQLYGYLASKEDLDIFNKHSRRKTKLKFEMRSYQEMVESKIKHINDDSQNLDYYKSMVAKEQIKSQVGTDSLLRISEKLSLTTEENRVDQQNKEGDQSGSRCFARMLQPYGISIGLKEHSNPVTPKAYTPKSPSGPLPPDSGPTPKIILAHRHCSRIIQYPRPHTRVLNTYNILRYNLTLVPK

SEQ ID NO: 137284 - protein, 151 aa, Glycine max
  Coding DNA Sequence Number=SeqID_45599
MGEVEEVQEQMKVDMEALKEKMATIMEAMMSIKEIMEVSEAYRTRARARVMGEVKEVQEQMKVDMEALKEKMATMMEAMMSIKEIMEVNAAYRTRARARVMGEVEEVQEQMKADMKAMKEKIATMVEAMMSMKKIMEANMVAVAATSAVAK

SEQ ID NO: 137285 - protein, 196 aa, Glycine max
  Coding DNA Sequence Number=SeqID_45600
MILRVQDIYSSQDEATTSPSSSEREEAKWEEASEEIYHQEEGQPLMVKEECKEVIVSSKRLAKKESHFTIKTNIKETSPLRQPPYFLLCKKILVSIATPLGLEFIPQVKELLDEDLVRKSLNPCALLVPKVGIIRHQIPKIGGVPMNPKRIKVILEWPTSPSVEENSQEFQKPRDLRSNPFQGGGNDAILPRKGIG

SEQ ID NO: 137286 - protein, 216 aa, Glycine max
  Coding DNA Sequence Number=SeqID_45601
MRSQIMVISHTFSSFRHSRVRWHAETNVILYTFLSCKGGVPDDMPRQIMVIPHTFSPFRHSHVRWHAETNVVFYTLLSSRGGGPDDMWRQIMVIPHTFLPFRHSRVRWHVETNVVFCTFLSSRGGGPDDMQRQIMVILHIFLPFRHNRVRWHAETNVIFCAICHPEAAGPMTCGVKLWSFRTPFRHSDTVVSDGTQRLTSSSTPFCHPKAVCPMTC

SEQ ID NO: 137287 - protein, 230 aa, Glycine max
  Coding DNA Sequence Number=SeqID_45602
MKVVYPQAEEELIDFLNRCKLENKIVMLCPRCSAVCDKEATEGLKKYQVVNKGARQNQRFDKGKGVMVQSNTNQKSGRRNTFVPPGSVPVEKWMHQGLIRFNKGIMEVGGSSGTKQIGPQKANRYSYRNNYKGKNPMTRTQWRRFQRQKKLAQQNPQMGQYKEVSRRPVKERLLPPVDEDKMEDEDLLDSEPDFDVICVVSILPSEYDVQSEVTEIESEFDHFDMADPKP

SEQ ID NO: 137288 - protein, 43 aa, Glycine max
  Coding DNA Sequence Number=SeqID_45603
MCAINLYDWLTVLESLFTLAKSSKNSMKLTVFVTYRIPNDKIV

SEQ ID NO: 137289 - protein, 112 aa, Glycine max
  Coding DNA Sequence Number=SeqID_45604
MNCHSLDYRVEPSSCFYKKVHQVKLKYGSNRLAKLGQTMNRVTSLLRLLPNIFRIIDVLVTSSFTLTKMSWTSKMIQPHILRKNSQYFDCTSFACIHAFHWLHCSLHSFLEK

SEQ ID NO: 137290 - protein, 131 aa, Glycine max
  Coding DNA Sequence Number=SeqID_45605
  Homolog annotation: Hit_ID=Q3D528; Match level="QueryCoverage=76%, HitCoverage=45%, E-value=1e-07, Identity=36%"; Hit description =Putative uncharacterized protein
MVWGDILAKFDIPEAEKAKKKVMSTMGTRWRQSKSSLTTKFVYADTQAGQEENPSVKYGMDKQTWDEFVASRKTPDWQEIRKKAKESQKYNDCPHVLSRGGYDLLEKKLLDEKTKQRQQQTLVSGGAAISH

SEQ ID NO: 137291 - protein, 157 aa, Glycine max
  Coding DNA Sequence Number=SeqID_45606
MEAMKEQMTTMMEAMMSMRKTMEVNMATVVAVSTAIEVDPTHPPGLNQHSFPPYGLPPNYTPPNVSHAPDENVDNSAPIPFESQHPQSGHAQVPQPMGETHEVPRDHTLADFEPHLRYATEGQAFGGVTLPNTLGGPQYRPQTQSLHFAVGRVPPAM

SEQ ID NO: 137292 - protein, 276 aa, Glycine max
  Coding DNA Sequence Number=SeqID_45607
  Homolog annotation: Hit_ID=Q6Z8F0; Match level="QueryCoverage=23%, HitCoverage=58%, E-value=4e-21, Identity=79%"; Hit description =Putative uncharacterized protein P0459B01.18
YALTRTLHRRSGSVGGATHRGIPPISFLAPYGPTPGARRCRGTPRARAAIHNRDDDVSTSISTARAWATIAIRVGQCPESIGGPALTPWTEFTRLIGAAFPNNPTRRQRLVVRQGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVI

SEQ ID NO: 137293 - protein, 30 aa, Glycine max
  Coding DNA Sequence Number=SeqID_45608
NFRDDAKDLTWHANGRNCDGLLRHPADSTQ

SEQ ID NO: 137294 - protein, 108 aa, Glycine max
  Coding DNA Sequence Number=SeqID_45609
EEARNAIQKHKPKRVESVNADAEAFAEALEHTKKRDTGHQSVSLDNKTGDSTVLKIGNLAKVVIKQDMKGRRHKYGFNNNKREKAEKKRVVDDETGDKHQLHEVLRMP

SEQ ID NO: 137295 - protein, 114 aa, Glycine max
  Coding DNA Sequence Number=SeqID_45610
MWISPCESIGWGCTNKTPSGPREVQQGPWVSSSGYGPLSVLQGARTPQQGIVPARHPVDPENSNRVLGFPALITSLCQFYGVPVTPNKVIRPRINQASIKKYCAPRQAQGKTPQ

SEQ ID NO: 137296 - protein, 107 aa, Glycine max
  Coding DNA Sequence Number=SeqID_45611
MAVCGGYWWLWVMEKELGTLEMVLEERRRKKWHFSKATRKAKAETLKCFCLRERKRSSHARHCTKDRNGQIMDICPMNLQTKFREDPMVNEGWEAFLPRQLHVASRI

SEQ ID NO: 137297 - protein, 136 aa, Glycine max
  Coding DNA Sequence Number=SeqID_45612
  Homolog annotation: Hit_ID=A6BLN7; Match level="QueryCoverage=78%, HitCoverage=20%, E-value=3e-07, Identity=34%"; Hit description =Putative transposase
MAPFICACGKYNKEVVLRRYRLEVMINHGDENTKFLLWDRECSELIGQSANAVNKLKIEDGDVDLNVSPQALDKLLGYELAFKIKVQPKFRNFVVLKCSTDTSLINVVIDMLADAETSSKINIPAFDSNHSTQHES

SEQ ID NO: 137298 - protein, 28 aa, Glycine max
  Coding DNA Sequence Number=SeqID_45613
MASSETPVIFTVLQISMYVARCAYGSSL

SEQ ID NO: 137299 - protein, 235 aa, Glycine max
  Coding DNA Sequence Number=SeqID_45614
  Homolog annotation: Hit_ID=A6FJQ2; Match level="QueryCoverage=16%, HitCoverage=84%, E-value=7e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPHHFVIRHGRPRVGETEQETVHEQMYPAGFHVLGNHEEWRGEHQARPRVRFRFEVHEERGESSHGLAEEECREVFVGVAIADVEEEGEGGGGDFVHVAEVALETVGAGYRARIRNHGHSCFLCEIVIRSQFHTTYEPEA

SEQ ID NO: 137300 - protein, 199 aa, Glycine max
  Coding DNA Sequence Number=SeqID_45615
AGDSDRCGLYIEADHARLVALGRVYEGSTVVHNTPLLLGQVKMQMLQFMYPLMRFLSGASNSHLLCLVDTSGEVFITAAMSPAKPPQKPDSEVDDPLYLMTLTIPELFLRPYQVTWDATVFEVFNPDFPLYIKHEDLSEIAHGGQCLSISVSQLWILHLTETSMQAGNSDIYGFFKPQSIQSALKGLDDAPQPKSKAPA

SEQ ID NO: 137301 - protein, 145 aa, Glycine max
  Coding DNA Sequence Number=SeqID_45616
  Gene Ontology: Mol. function=hydrolase activity, acting on acid anhydrides, catalyzing transmembrane movement of substances; Cellular component=proton-transporting ATP synthase complex, coupling factor F(o); Biological ...
  Gene Ontology: Cellular component=process=ATP synthesis coupled proton transport
  Homolog annotation: Hit_ID=Q2PMS9; Match level="QueryCoverage=88%, HitCoverage=69%, E-value=2e-50, Identity=82%"; Hit description=ATP synthase B chain
  Pfam annotation: Domain name=ATP-synt_B; Domain location=1-117; Score= 19.4; E_value=0.00014; Accession=PF00430.9; Description=ATP synthase BB' CF(0)
MFINGLNPIYLRQECEKRKILRTIRNSEELREGAIEQLEKAQARLRKVETEADRFRVNGYSEIEREKLNLINSIYTTLEQLENYKNEAIHFEQQRVINQVRQRVLQQALQGALGTLKSCLNNELHLRTVSANIGMFGTMKEKITD

SEQ ID NO: 137302 - protein, 236 aa, Glycine max
  Coding DNA Sequence Number=SeqID_45617
  Gene Ontology: Mol. function=phosphoprotein phosphatase activity
  Homolog annotation: Hit_ID=A7R0W1; Match level="QueryCoverage=41%, HitCoverage=26%, E-value=3e-16, Identity=42%"; Hit description =Chromosome undetermined scaffold_325, whole genome shotgun sequence
MEIWFSCTAIICFSIVEWHQTNRVKLQFGLQQDTSVDPMNLDRLHQIDMRGNHYIDWMEYHAEWINIWKNKHNDVLARQWVEGIVTHTPAYMEWYRKNTTLFLSVAQQLHDPHTKITIMLQGQSMYCIPSLVHQTFGQTGESVTATSHEWMSDLFDVDFNTPNLTTSYLASLQQFNAPHSFGEQGQSSSATTTNIGYTNIEQQHHHDMGEPVIQERRNPRRNRRPPPCGTGHRLGH

SEQ ID NO: 137303 - protein, 138 aa, Glycine max
  Coding DNA Sequence Number=SeqID_45618
  Homolog annotation: Hit_ID=A5BSR3; Match level="QueryCoverage=52%, HitCoverage=23%, E-value=1e-12, Identity=48%"; Hit description =Putative uncharacterized protein
MDEKRKKKLEEATQSGSTDTIIDPPSPIKRHVKWKLARTKKTGDMTSEAAKEIADKIDALEEQASQGSFVTHGRHDILTAAIGRPEHPGRVRAVGAGITIKQYFGSASRTSSIAPEYLQQLTQQIKDQLEDSITEKVT

SEQ ID NO: 137304 - protein, 102 aa, Glycine max
  Coding DNA Sequence Number=SeqID_45619
MWTTTAISREREVPKKLNLFFFTPPPIYSKIGEELATQLAQASKVASSRSNSLLEEGSGRPKWARLLFLSKKLRKLTDCAKTPLFDFRHITEFHGLRKPTSF

SEQ ID NO: 137305 - protein, 133 aa, Glycine max
  Coding DNA Sequence Number=SeqID_45620
  Gene Ontology: Mol. function=protein binding; Cellular component =nucleus; Biological process=apoptosis
  Homolog annotation: Hit_ID=A7NUQ8; Match level="QueryCoverage=63%, HitCoverage=19%, E-value=1e-28, Identity=59%"; Hit description =Chromosome chr18 scaffold_1, whole genome shotgun sequence
AQYANRLSPRVGRFINAAGTTGFPTGKRAVSATQLIYDHDYEFELGTKLIRTLSVAFAGDTDLGLQYVLEGCPNLQKLEIRDSPFGDGALRSGLHHFYNMSEEDKADDIEILYMYRSLDRPRDDAPKVVTILC

SEQ ID NO: 137306 - protein, 110 aa, Glycine max
  Coding DNA Sequence Number=SeqID_45621
MSSRCSRLIKNTSRFKRKFDSKNQESRFKVQASKNQDQDSRLKIQESREDLIKIRYILCGTSRGYIYLGLTENKRGYISCGSVLVEGISTRFKENKGGYIPSGSLLVKGF

SEQ ID NO: 137307 - protein, 163 aa, Glycine max
  Coding DNA Sequence Number=SeqID_45622
MELIENMAASDHAILHDRVHVPTKKSLLELSSQDALLEQNKFLSKQLEVVLFVAELMNSAVVFPLKNTIMKLTIWEINKGMVTIKVDTQVGQLAKQIVEKSSSSFGANTEKNPKEECKAVITRSRRPVLAENEGEVTVKKPVVVEDVIEEEDDEKQKRETPIT

SEQ ID NO: 137308 - protein, 27 aa, Glycine max
  Coding DNA Sequence Number=SeqID_45623
MAPTTEITGMGKLVQLQGLPSLNKVLL

SEQ ID NO: 137309 - protein, 92 aa, Glycine max
  Coding DNA Sequence Number=SeqID_45624
MATIALSSRYGSKLAYDTGIWGMAFVDNLVVGKEKVCYWLSNDIVGLVGSFHVGMTVTTLTRFDPFPGEDQIRKALKVPLELPGLSIFGRIL

SEQ ID NO: 137310 - protein, 78 aa, Glycine max
  Coding DNA Sequence Number=SeqID_45625
ALGFPALVTGLYSPTGCPFPPTRSHHHRDRACKTPSGPKEVQQGLGVGETPQQPGDGQQRATDTPPSPLDFTSAHPQK

SEQ ID NO: 137311 - protein, 103 aa, Glycine max
  Coding DNA Sequence Number=SeqID_45626
MSAFSDGDFPSLTSYPELRRSEFLIGGYVGARASLLSTTPPFVAMTQELVARGDTLWLFAPFCHPEAAGPMTSRDQVWSFCTHDTRRYLMVPPFCIIQRRRAR

SEQ ID NO: 137312 - protein, 71 aa, Glycine max
  Coding DNA Sequence Number=SeqID_45627
MITKDDDKGDDKKLKDRIKNTSRFKRKVEFKNQDSRDQGSRLKIQESRKGYSRIKKKLNQDKYEKGFSKTK

SEQ ID NO: 137313 - protein, 39 aa, Glycine max
  Coding DNA Sequence Number=SeqID_45628
MAGGKIGGEGFRESERLQGRVVIDYTIMVIDYQRAILLW

SEQ ID NO: 137314 - protein, 108 aa, Glycine max
  Coding DNA Sequence Number=SeqID_45629
  Homolog annotation: Hit_ID=Q6WAY6; Match level="QueryCoverage=69%, HitCoverage=15%, E-value=5e-07, Identity=34%"; Hit description =Putative uncharacterized protein
MGTRGCNSYNPVIAIRQLGYPMRGAPLEEEIAPFISRGFDKTNVETLQKDKELRGSNNGPIGGYRKWLKAHVQGLDWLPSLRIAKREEVEAPEEETEVQDLRAELEQA

SEQ ID NO: 137315 - protein, 107 aa, Glycine max
  Coding DNA Sequence Number=SeqID_45630
MVNDIFTPSRYKETIMVQPKPSAGLKGKSLQHALTFMPSRIQKSKAWVPRPKSCFGIYPNFRKISIYPKMAQTALRHFTEHLVGALLGTNNKGIGAMWLAPSFQNTT

SEQ ID NO: 137316 - protein, 160 aa, Glycine max
  Coding DNA Sequence Number=SeqID_45631
  Homolog annotation: Hit_ID=Q84VH5; Match level="QueryCoverage=76%, HitCoverage=17%, E-value=7e-44, Identity=75%"; Hit description =Envelope-like protein
  Subcellular localization annotation: CTP_CleavageSite=21; ConfidenceScore=5.18e-01
MATSPKETSAPGSPAVPSSPSSTKAPSNQERLEFNIQPIQMIPGQAPVPEKLVPKRQQGVKIAENPSPATSPREVDPEMDKKIRSIVSNILKNASVPEADEDVPTSSTPNVSVPDVDKDVPTSSAPNAEALPSPSEEESTEEDDQATEETPAPKAPEPAP

SEQ ID NO: 137317 - protein, 115 aa, Glycine max
  Coding DNA Sequence Number=SeqID_45632
  Subcellular localization annotation: CTP_CleavageSite=48; ConfidenceScore=5.42e-01
MSPPPLEPHNHSQTHLMLSRWLPLFAQFSRALVNFGLARVFSLSGWTQAVHLTGLALAQGTCTAHPSSKFFLALSQRSVALSEWLAKPADWLSEQMKISISQTCLINLKLRGNDY

SEQ ID NO: 137318 - protein, 89 aa, Glycine max
  Coding DNA Sequence Number=SeqID_45633
MAKFYAIPEFLQTLLTTTKQVLTKKWKHKHKNGCDLYPELIRSRAWKRSKTQALQAEAQLVKTIMGLYMRPVVGRLLANQMPVILLRIK

SEQ ID NO: 137319 - protein, 69 aa, Glycine max
  Coding DNA Sequence Number=SeqID_45634
MKTKGSAQHALSMQGSTGAKRGVKHEDAGSITRAKREPRANRVIQQKHTLSLQQALSARSECAKRAVSR

SEQ ID NO: 137320 - protein, 135 aa, Glycine max
  Coding DNA Sequence Number=SeqID_45635
  Subcellular localization annotation: CTP_CleavageSite=82; ConfidenceScore=5.48e-01
MSASICSCTSSTLPITPSLAQIFNMVHDIFFKVKLEVTRTSTILNVFGSRRSSDVTRSIFCPNFCKMVTSILQLDSMNLFVKARARFNPITQGMVILIANTSSTFHRDERLGNTHAMHGKCNYEIEMPEETSFLS

SEQ ID NO: 137321 - protein, 130 aa, Glycine max
  Coding DNA Sequence Number=SeqID_45636
  Subcellular localization annotation: CTP_CleavageSite=84; ConfidenceScore=5.50e-01
MNLLPSAVHVSSTIESGAPRIHCLAMFANSPFSTFIRSPMNLLPSAVHVSSTTESGAPRIDCLVLFANSLFSNLIRRPMNSLPSAVHVSSVIKRGASEEKKRRSRDESRHHGKGRMDEISVLSFLSSYLR

SEQ ID NO: 137322 - protein, 179 aa, Glycine max
  Coding DNA Sequence Number=SeqID_45637
  Gene Ontology: Mol. function=transporter activity; Cellular component= integral to membrane; Biological process=transport
  Homolog annotation: Hit_ID=Q1IAH2; Match level="QueryCoverage=96%, HitCoverage=38%, E-value=7e-56, Identity=60%"; Hit description =Putative transporter, MFS family
  Subcellular localization annotation: CTP_CleavageSite=60; ConfidenceScore=5.00e-01
MKQLLHFNDATTLVYSSLSSLCAALVMPFGGMFTDRYGRKPFLIVTGLFATVCMIWFFAVADGATPSTFIWPLMATAISFGLYVSSTYATMSELLPTKVRSTGIALAYNLPVALFGGTAPMVSTWLIQRTGDISSPMYFFAATGVVSLVSLTLLRKQDFVAGGSSASIERPSDPAMRSI

SEQ ID NO: 137323 - protein, 63 aa, Glycine max
  Coding DNA Sequence Number=SeqID_45638
MKGNQQRVPSGVATVATYPSAGGRCETRGMRVPRKEYARSRHQRLFEENVGKTGKDAIYELFK

SEQ ID NO: 137324 - protein, 225 aa, Glycine max
  Coding DNA Sequence Number=SeqID_45639
  Homolog annotation: Hit_ID=Q6WAY6; Match level="QueryCoverage=29%, HitCoverage=11%, E-value=4e-07, Identity=43%"; Hit description =Putative uncharacterized protein
MGTRGCIRYNPVLAIRQLGYRMRGASLEEEIAPVISRGFNKTNVETLQKVRKAWEVVQKKDKELRGSNNGPIGGKRKTAKREEVEAPEEDEEVQALRAELEQAQTVKERFKSVALKIRKENAELRDINIATTKALEQETKRARRFAQGPKETCLSGYARQRPTLYAEKEARGRVIDSLHQEATMRMDRFALTLNGIQELPRLLAKAKAMADTYSAPEEIHGLLSY

SEQ ID NO: 137325 - protein, 103 aa, Glycine max
  Coding DNA Sequence Number=SeqID_45640
RSDDESLEGTSTWDPTINFEQETNQTEDEEDEDVGLPPELEKIVAHEDQEMGSHQEETKLVDLGTGNGKKEVKIGTAPITSKSRVFPEWVANIVPVPKKDGKV

SEQ ID NO: 137326 - protein, 93 aa, Glycine max
  Coding DNA Sequence Number=SeqID_45641
MGIQKNSQAVKPLNAFGEERQKEFRRLVLGKFFLANGEENEKMNSTSFQGLENQKTSEIFWYKEEEEVQRDSRLVKDCNENDWKRIQDSCSKD

SEQ ID NO: 137327 - protein, 262 aa, Glycine max
  Coding DNA Sequence Number=SeqID_45642
  Gene Ontology: Mol. function=secondary active sulfate transmembrane transporter activity; Cellular component=integral to membrane; Biological process=sulfate transport
  Homolog annotation: Hit_ID=A7Q6Y1; Match level="QueryCoverage=40%, HitCoverage=16%, E-value=5e-46, Identity=84%"; Hit description =Chromosome chr12 scaffold_57, whole genome shotgun sequence
  Pfam annotation: Domain name=Sulfate_transp; Domain location=121-262; Score=-67.9; E_value=4.3e-07; Accession=PF00916.11; Description =Sulfate transporter family
DAGSRQARQGASAGVAGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPCRLGFLIDFLSHAAIVGFMAGAAITIALQQLKGFLGIKTFTKKTDIVSVLHSVFDAAHHGWNWETIVIGVSFLAFLLITKYIAKKNKKLFWVAAISPMISVIVSTFFVGTELEFVIMVIAVSCVKLLSAHNSTQHTSRKHKV

SEQ ID NO: 137328 - protein, 198 aa, Glycine max
  Coding DNA Sequence Number=SeqID_45643
  Homolog annotation: Hit_ID=A6FJQ2; Match level="QueryCoverage=19%, HitCoverage=84%, E-value=5e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPACKTKDSDAQVTCLFGSSTAKGQVSGRETCRASCINESANARGEAVCVLGALPLPRSLTRCARSFGCGEPVSAHSKAVIRLSTESGDNAGKNMLSKRPAKGQEP

SEQ ID NO: 137329 - protein, 228 aa, Glycine max
  Coding DNA Sequence Number=SeqID_45644
  Gene Ontology: Mol. function=helicase activity; Biological process =viral genome replication
  Homolog annotation: Hit_ID=Q2A9E0; Match level="QueryCoverage=80%, HitCoverage=13%, E-value=6e-28, Identity=35%"; Hit description =Putative uncharacterized protein
  Subcellular localization annotation: CTP_CleavageSite=42; ConfidenceScore=5.30e-01
MQNYQNAKRSNSAKARINRKRIMQQKRHPHAQSSSQPTINCTSEYDKSVNSESTQGSGSNFLTAYEDCQSPTNQPVINTEGYSDLGDQLMQCKYCNAQMWYDERISKDKNYGSPRFSLCCGDGKVELPLLQNPPQYLQQLLFDDNTIDIKNYQHNLRAYNMMFAFTSAGIKLDKTINDSRGPPTIRIQGQPCHRIGSLLSMSGKKLKFAQLYIFDTENEVQNRINAMR

SEQ ID NO: 137330 - protein, 153 aa, Glycine max
  Coding DNA Sequence Number=SeqID_45645
MGTNQTGKRFYQVKIKGLDVTSLKELGRLMGPLQMQAFRRAYRKILDLTIAEIFTEAVVSLTQYYDQPLRCFTFGDFQLGFGKRVGSCKANSKRRSGPTTKVLRRQGKGYGESRGVGLVYGRISIANLWSCPLSKHGRFGGPSRNRRFPCISP

SEQ ID NO: 137331 - protein, 251 aa, Glycine max
  Coding DNA Sequence Number=SeqID_45646
MTFLGETSSQTIVNSRLAFILPNGSIIHNDTGVYFQNSTPVPIRVPNSCDFASLKTRIHNTLQLSDKQFLDEIHYWKPFTDTGNQIRFECMKLINDDDVNTMLMCNDQFSCVGPIELLCTVGRTPDGIINLLEHTMPRIHDTILYYNGKWNMPPQNKFVGCAFTGKNPKKFQIPSTCTIDELKNLIKQVAPKGIPPHGIHESQTLMTNEELLKVLVQSNYRKKYGPIEILAVFTKYVVKIEEEVTGTSLNN

SEQ ID NO: 137332 - protein, 123 aa, Glycine max
  Coding DNA Sequence Number=SeqID_45647
  Subcellular localization annotation: CTP_CleavageSite=38; ConfidenceScore=5.06e-01
TYQGNPCGVYPDLSSFIGSGVYPDLSSFTGSGVYPDLSSFTGSGVIQTFVACIKRSAPSDEDMTKSKGKDPLEGLGGPMTRARARKAKEALQQVLSILFEYKPKFQGEKSKVVSCIMAQMEED

SEQ ID NO: 137333 - protein, 163 aa, Glycine max
  Coding DNA Sequence Number=SeqID_45648
MIMRGQDIYSSQEETSSCPSSSGSEDEVRGEESSEEVYPHEEGDLLMVAKDQLTMKDKRDEEEKLDKQKKKKDSKALSSKAKGKEKEEKDSSKKIVKKENHFATKGDIKRALLLKQSFYLLLSRETSLSTAIPLELEVIPQVKELLDEVFGSQELKFLCFVGA

SEQ ID NO: 137334 - protein, 91 aa, Glycine max
  Coding DNA Sequence Number=SeqID_45649
MTPIEHFLLVIDASSIGACRPRIFFINGFLCFLEDEWQRNGERKRERRRHFKEKMSLEEPHHHRRPWIRAWRKKKMNEGRGREEHEILCSK

SEQ ID NO: 137335 - protein, 108 aa, Glycine max
  Coding DNA Sequence Number=SeqID_45650
MTRGLWWESMCWIQAIGAFSADPASHFIQFCDGFGAGRNHSRRGGWWIALSITIWQHRNSLLFQGIPFEPQKVLDDALFLAWSWLKVGEKGFNTLFNHWSTNLVEAFG

SEQ ID NO: 137336 - protein, 55 aa, Glycine max
  Coding DNA Sequence Number=SeqID_45651
MLWLRSSSDFVLVIDYRPNKPYGNRLQDVVIDYRLPVHVYSITLDGNRLPEPILS

SEQ ID NO: 137337 - protein, 175 aa, Glycine max
  Coding DNA Sequence Number=SeqID_45652
MGEAEKLPLLSAVAKVNPMLPSGLKQMNRPTSNMVDKDLGSTDDPMMCKFKTSTPSHHMACLPTIHHPMWHTLSMKISITPLRYSLRTNNLIRHISLKTMGKTHEIPHHNLADFEPWLGYATEGQAVGGIPFENPLEGPQYHPQLHLLHSTADKNPHDYGRNGKVGSSKGKAQGH

SEQ ID NO: 137338 - protein, 62 aa, Glycine max
  Coding DNA Sequence Number=SeqID_45653
APVSLASLARKRACCDTYSERSFASLTLLRKVEDEPQLLVVFFVTAAAAIALEEEHMACLDQ

SEQ ID NO: 137339 - protein, 440 aa, Glycine max
  Coding DNA Sequence Number=SeqID_45654
  Gene Ontology: Mol. function=altronate dehydratase activity
  Homolog annotation: Hit_ID=A6TED0; Match level="QueryCoverage=100%, HitCoverage=88%, E-value=0.0, Identity=91%"; Hit description =Altronate hydrolase
  Pfam annotation: Domain name=GD_AH_C; Domain location=86-440; Score =762.8; E_value=2.2e-226; Accession=PF04295.4; Description=D -galactarate dehydratase  Altronate hydrolase, C terminus
  Pfam annotation: Domain name=SAF; Domain location=4-63; Score=19.5; E_ value=0.012; Accession=PF08666.3; Description=SAF domain
  Pfam module annotation: Pfam domain module=GD_AH_C::SAF; Domain location=86-440::4-63
MTSGSVVTIDNDTVTLSQDVVRGHKFALRAIAKGENVIKYGLPIGHALADIAPGEHVHAHNTRTNLSDLDAYRYQPDRVEQPAQPADRDVEIYRRASGEVGVRNELWILPTVGCVNGIARQIQNRFLKETNDAEGTDGVFLFSHTYGCSQLGDDHINTRTMLQNMVRHPNAGAVLVIGLGCENNQVDAFRETLGDFDPERVHFMICQHQEDEVEAGIEHLHQLYEVMRHDKREAGKLSELKFGLECGGSDGLSGITANPMLGRFSDYLIANGGTTVLTEVPEMFGAEQLLMSHCRDEETFGKLVTMVNDFKQYFIAHDQPIYENPSPGNKAGGITTLEDKSLGCTQKAGSSQVVDVLRYGERLKVHGLNLLSAPGNDAVATSALAGAGCHMVLFSTGRGTPYGGFVPTVKIATNSELAAKKKHWIDFDAGQLIHGKAMPQ

SEQ ID NO: 137340 - protein, 74 aa, Glycine max
  Coding DNA Sequence Number=SeqID_45655
  Subcellular localization annotation: CTP_CleavageSite=41; ConfidenceScore=5.22e-01
IALTFGNFRLLFSDFPLQIGPDFTVAAVSANFLQRSVQAVNAMLIMVFFGIADLPLDTLFFFLTRRGCEGAGAK

SEQ ID NO: 137341 - protein, 47 aa, Glycine max
  Coding DNA Sequence Number=SeqID_45656
MWDRHKLKGALKPGVFTYTLNSPLGPLPPDSDTAHELYNIHDLTLVF

SEQ ID NO: 137342 - protein, 105 aa, Glycine max
  Coding DNA Sequence Number=SeqID_45657
  Gene Ontology: Mol. function=hydrogen ion transporting ATP synthase activity, rotational mechanism; Cellular component=proton -transporting ATP synthase complex, coupling factor F(o); Biological process=ATP synthesis coupled proton transport
  Homolog annotation: Hit_ID=P09003; Match level="QueryCoverage=35%, HitCoverage=18%, E-value=1e-11, Identity=94%"; Hit description=ATP synthase protein MI25
MPSSSLSILCLGARRSQGLFPTRPEDLRCQLLSPLTQSTAESAIGLAIFVITFRVRGTIAVEFINSIQGFIIFSRKSLGKTFKVTLDGRIQAIQEESQQFPYPNE

SEQ ID NO: 137343 - protein, 298 aa, Glycine max
  Coding DNA Sequence Number=SeqID_45658
  Homolog annotation: Hit_ID=A5C0V9; Match level="QueryCoverage=81%, HitCoverage=45%, E-value=8e-09, Identity=25%"; Hit description =Putative uncharacterized protein
  Pfam annotation: Domain name=Transposase_23; Domain location=5-75; Score=4.2; E_value=0.00041; Accession=PF03017.5; Description =TNP1ENSPM transposase
NDPETGDSDRCGLYIEADPARLVAIGRVYEGSTIVHNTPLLLGQVKVSVEEVRDADAPVPVPTDEVSLVGQALHTFLAWPTHLVKSLLQQVAVSPPKPPPKPDPEVDDPLYLMTLTIPELFLRPYQVRWDATVFGVVNPDFPLYLKHEDLSEIAHGGQCLSISVLQLWILHLTETCMRAGNSDIYGFLEPQSIQRFGQSQFESESYIKSWMQSSQRDVYLGAYLNGFHCSGHWQMVVILPKEHAIKGLDDAPQPKSKAPARWIVVKCNRQKGTTECGYYVMHWMSTIILGTFRNNCEA

SEQ ID NO: 137344 - protein, 94 aa, Glycine max
  Coding DNA Sequence Number=SeqID_45659
  Homolog annotation: Hit_ID=A6FJQ2; Match level="QueryCoverage=40%, HitCoverage=84%, E-value=3e-11, Identity=92%"; Hit description=50S ribosomal protein L5
MTVKPLTHAAPVDGHSLSVSGCREQTSPSGRVSGYWRMRKEKIPHQAPFAIQAAQLLGRAIGAGLFAITPAGERGMCCKAIKLGNARVFPVTTL

SEQ ID NO: 137345 - protein, 97 aa, Glycine max
  Coding DNA Sequence Number=SeqID_45660
MDNKEGVQEQMKVDLSALEDQMASITEAMLKLQKTIEDNATAVASNTAREAEPVLQPAINLGRDRNATGFNRRYSPQAYPYGLPLDFTPRTAPDDLS

SEQ ID NO: 137346 - protein, 66 aa, Glycine max
  Coding DNA Sequence Number=SeqID_45661
  Subcellular localization annotation: CTP_CleavageSite=38; ConfidenceScore=5.37e-01
MDPQSEISLPRVLNPSLQSPTPFYSQNRGGGCRPGELVASTRSNMLALASCCFLQKVPDGPKWAQG

SEQ ID NO: 137347 - protein, 35 aa, Glycine max
  Coding DNA Sequence Number=SeqID_45662
MSTGHSALKLKNHSCLVLEWAPESKFGSKPQYHCE

SEQ ID NO: 137348 - protein, 82 aa, Glycine max
  Coding DNA Sequence Number=SeqID_45663
MPSNIILMMPENQESRKFQRINSQTSFKNQDQDSRFKNNQDQDSRFKNNQDQDSSKESRLKIEESREDSIKISIKRVFQNIE

SEQ ID NO: 137349 - protein, 197 aa, Glycine max
  Coding DNA Sequence Number=SeqID_45664
MERSAKEREALDATAKLKESEREVVRKNKANKELEDELIMFKKEAELFIEGLDLNLLDPFKDEKDGQLFDEDEIAAMEESDGGEKDDGADFWLGLGLSVRCVRYETIMLDGPTKEEPWVCRAFGDSTRNTFILGVASLTMGELWEFIGPRFGKTHQGRTLGLRAFGDSTRNTFVLDSPRVDLEFDEPLEIRLGMRLS

SEQ ID NO: 137350 - protein, 132 aa, Glycine max
  Coding DNA Sequence Number=SeqID_45665
  Homolog annotation: Hit_ID=A3Q834; Match level="QueryCoverage=90%, HitCoverage=43%, E-value=1e-07, Identity=30%"; Hit description =Putative uncharacterized protein precursor
MESRKRARTEDIPLSSTPAPPSVTVGQEPEAQLPLVRPNKAAPPEPTPVQVNTEPSDPQSLVVNPPSSPELEAVPPSPPLIVISDASSYEAAAPPDSPVAETADPSVSPIGGIADLSDSSSGEAIALTDSPV

SEQ ID NO: 137351 - protein, 238 aa, Glycine max
  Coding DNA Sequence Number=SeqID_45666
MEPGSLTRCNGFDWVRLRRNQTQIKSLNETVMFRGERGIWVRAIESVVFVHHVFDFIIVGGGDEGVEVFAGELVLEGEVLWQGAAEGSNEDLSVIANIEELVVMGAGRDLVIVATHELGLSISCERVKDLPESEYDKSKRGLRIFAQDQARVFQKLVVVPVLMVNMLTSNNNERAWHVQFWEFATVTPPFLQPNREISIGPNLSRVNCLLDQESCVTSIELKNNVSIFLSLCVFHGLV

SEQ ID NO: 137352 - protein, 201 aa, Glycine max
  Coding DNA Sequence Number=SeqID_45667
  Gene Ontology: Mol. function=protein serine/threonine kinase activity; Cellular component=cell surface; Biological process =protein amino acid phosphorylation
  Homolog annotation: Hit_ID=A2Q1L9; Match level="QueryCoverage=75%, HitCoverage=36%, E-value=2e-52, Identity=67%"; Hit description =Protein kinase
MTRGRGTPGYAALELWMPNFPVTHKCYVYSFGILLFEIIGRRRNLGVQLVESQEWFPIWIWKRFDAGEFQKLIIACGIKEKNREITERMVDVALSFVQYRPDSRPIMSDVVKMLEGSVEILKPLNPFQPFMDGNFTSHPVQVPLTYTTDTNGFSDVLVGLGSSSSMDSFTSWKINGSGMEKEEREETPLQGEDESRRSSPP

SEQ ID NO: 137353 - protein, 556 aa, Glycine max
  Coding DNA Sequence Number=SeqID_45668
  Gene Ontology: Mol. function=metal ion binding; Cellular component =cytoplasm; Biological process=ubiquitin cycle
  Homolog annotation: Hit_ID=A7P4X9; Match level="QueryCoverage=93%, HitCoverage=99%, E-value=1e-128, Identity=51%"; Hit description =Chromosome chr4 scaffold_6, whole genome shotgun sequence
  Pfam annotation: Domain name=PHD; Domain location=478-522; Score= -1.2; E_value=0.018; Accession=PF00628.20; Description=PHD-finger
  Pfam annotation: Domain name=zf-C3HC4; Domain location=479-519; Score= 25.6; E_value=0.00011; Accession=PF00097.16; Description=Zinc finger, C3HC4 type (RING finger)
  Pfam module annotation: Pfam domain module=PHD::zf-C3HC4; Domain location=478-522::479-519
MDEYSRKRGVDGMVFPRKGMGHVFRDTANTRDRNGQICSRLGCSSRANLPKVAHVRSSEKGKSLRPSFQSSSSSKDAIGSSSRTTSYPAKRLIEPRKTLSSQFEAHSSETSSVQDGPEFSVPIPPTEEIRRGPLVEGESTESSNAILMEVGSSSAVSNTRSQRAGLRAQEIKSTGAVRRAVSSRYGLRNLKCNSISDVVPAGCSPLDSSLNRRKDTIKKGNCEGGNSSTVRGKNITGSSLEGRNSGSRNGISISDSRRSRNVPSHRSTSVASVRTQRSISGQARGRFCSQGNENPVASSDSPLNIPLSPHSGDLDAPGFSYHTSMETPLSGSSSYGRPGNSSEQLSGVMPASPAEDDNTHSLINRDSFRHYNMGGIAEVLLALERIEQDAELTHEQILLLEANLFLSGLNFYDHHRDMRLDIDNMSYEELLALEERMGTVSTALPEEALAECLKRSKYQSAPLDDADESCNEDKDDIKCCICQEEYVVGDEVGDLQCEHRFHVVCIQEWMRLKNWCPVCKVRYELIMPWVGEHSIRKMNALFKPNHYLSTKCNATY

SEQ ID NO: 137354 - protein, 104 aa, Glycine max
  Coding DNA Sequence Number=SeqID_45669
  Subcellular localization annotation: CTP_CleavageSite=30; ConfidenceScore=5.10e-01
MQNQIYPGSATIRAYIQSPMITTKKLCPLLAMNPKAVSVLSPVITTKKLYPLLAMNPKAVSLLDPVINQEANPLLAMNPKAVSFLDPVINQEANPLLAMNPKSG

SEQ ID NO: 137355 - protein, 394 aa, Glycine max
  Coding DNA Sequence Number=SeqID_45670
MVSCGLWTVARLGGRRGLVIAFEKDSKGVIMMWKKALAPYFRTIRQSWGTVISHDGPKGLEPLDTQNHIGTTQGQDMKVHHKLDALDSNGDCFTELVTMKMLTIPDHDAKRRSGASSEAQFLHQWFLNKVVGAAPIKQVNQLVSGDVAQQTQVGLVASSGSGGSSNWVGSSRFASSSSAIKRNIRETHLCPRWNCLSQLKHRPRSLRKANSSGERHFRGIGGGVFGGAGSNGVTTAGKGGRGGAVRGGGRARLKEPNLQSQPRYKATQKEQCRQADNTIRKIFEFRKVGIGGVELDANKDGEEVSGWANFWINSSSFRVIVCTVSIKERAPKLIDYSGIEDQKPPKKRRRGNSRHHPNGKYRIQGNDRQAKENVDSVAGREDFDAYSAISTLSQ

SEQ ID NO: 137356 - protein, 44 aa, Glycine max
  Coding DNA Sequence Number=SeqID_45671
MEISLIRANIEETNEATMGCESGATIEEETNLQEDFIHLFFLEG

SEQ ID NO: 137357 - protein, 127 aa, Glycine max
  Coding DNA Sequence Number=SeqID_45672
MVSSIEEFFILKLFKIDENARKAHQEVSPGAVASGTIFQYNSRDFLGAFVVHLGNSFSFNAKIFVALMAIEIARDKQWLSLLVGDKLNFGGRSFQDSFFGTLEPFTTDEKCYFLHKIYAFLDISCLS

SEQ ID NO: 137358 - protein, 208 aa, Glycine max
  Coding DNA Sequence Number=SeqID_45673
  Homolog annotation: Hit_ID=Q5XM22; Match level="QueryCoverage=34%, HitCoverage=40%, E-value=4e-20, Identity=61%"; Hit description =Resistance-like protein HAAS-2
MLHLLSSSFIFCFLLCRCCRLHSFSPLSQALPLSSRVRHCLQCHRVYVRLSWLQDIYRSKCDVRQWTVAARAYLLHLISCSLFANKSATCVHVIFLDAFRDLTHTGSYAWVVATLIHIVGSTSTFIMLLLLLLPKIIMRGNHLPAIGSLGRHYQYRCNISVWTIPPHPVAPSLCIEDIDDRWIQFSKYLASVGQICVALGQCAADYMK

SEQ ID NO: 137359 - protein, 101 aa, Glycine max
  Coding DNA Sequence Number=SeqID_45674
MLDQRAHAIKIIVEAIGRDNRLQLTSLAMTMTIATTSCSTSPNCNSKLLPTLTKKEANMNKNAHVCLKEIVITSGGSDELTKISSVETNPLIIPTTKHTQV

SEQ ID NO: 137360 - protein, 443 aa, Glycine max
  Coding DNA Sequence Number=SeqID_45675
  Gene Ontology: Mol. function=sequence-specific DNA binding; Cellular component=nucleus; Biological process=regulation of transcription, DNA-dependent
  Homolog annotation: Hit_ID=A7LHH2; Match level="QueryCoverage=79%, HitCoverage=100%, E-value=3e-99, Identity=77%"; Hit description =WRKY31
  Pfam annotation: Domain name=WRKY; Domain location=364-424; Score =137.6; E_value=3.4e-38; Accession=PF03106.6; Description=WRKY DNA -binding domain
MEGLKGMDNLIQILSHHPSYINTELANIIVSKFKKLNALLNRTGHARFRRTPIHSTAPVHSTNPVHNASTSSTQVPLSENPNLFALVQSPVPVQVHRMPASVALDFMEPHNPLISFNAKSVELEFSKETFNVPSKSSFISPAITNNGNVSNKEIFLASAPPTTSVEKVLAFKKQCYEHHEQSVDISGSSKCHYLKQRRAPVQYSSPHAPVHNTNASTSSIQLPPPPQNPNIPALAQFPTPAPVAVHHTPVTLDFTKPHNALLSSNAKSVELEFSKETFSVSSNSSFMSSAITGDGSVSNGKIFLAPPATSAGKRPAFKKRCHEHREHSDDVSGNSKCHCVKRRKNRVKSTVRVPAISSKVADIPPDEYSWRKYGQKPIKGSPYPRGYYKCSTIRGCPARKHVERAPDDPAMLIVTYEGEHRHAVQAAMQENAAGVVGLVFEST

SEQ ID NO: 137361 - protein, 150 aa, Glycine max
  Coding DNA Sequence Number=SeqID_45676
  Homolog annotation: Hit_ID=A5AHN6; Match level="QueryCoverage=46%, HitCoverage=59%, E-value=5e-07, Identity=45%"; Hit description =Putative uncharacterized protein
KSKFSPRDDGPFQVLERINKNAYRTKGGDGTKEEEPTDLRPNPLQRGGDDVILPRKGPVTRAISKKLQEDWAKVGEEGPKVLMNFRRGVSSPHLASQGSFLPCFPRKLPSLLLKEASNYIFGMGVSLAIGGLPKEATFLASQGSFPCARL

SEQ ID NO: 137362 - protein, 122 aa, Glycine max
  Coding DNA Sequence Number=SeqID_45677
MCPLPIHLKHFMELVFSCILVLRGCFSIVFPLSSLGLEENTEDNKVVVEEKGLSGVGDKVDLEEKVTSVEDKVVVEEKVSCVEDKQVVSKTIEQEKKVVEPVEKEKVVTRWMLFPIIGQRFV

SEQ ID NO: 137363 - protein, 120 aa, Glycine max
  Coding DNA Sequence Number=SeqID_45678
  Homolog annotation: Hit_ID=A3B8S7; Match level="QueryCoverage=62%, HitCoverage=7%, E-value=8e-08, Identity=42%"; Hit description =Putative uncharacterized protein
MAIIIRAKEEEVERKPCVKALPFKVKAMSRGSSSQKARMCVEIYKGVTTSQLNELVAETTAAMIANHPDYSSVRLFSFLAFFCGFYIFGVAKSDEARWSFVNYFNLGKRICLGESVKIEE

SEQ ID NO: 137364 - protein, 85 aa, Glycine max
  Coding DNA Sequence Number=SeqID_45679
MATSKYLIAPGAFGSGLNMCIPHMTKGQGELRLWRLSGGVCGMHFNEGAINPLLDISPSRMTVYGGSLERLLDDSIEVLDLFGAS

SEQ ID NO: 137365 - protein, 192 aa, Glycine max
  Coding DNA Sequence Number=SeqID_45680
CWIYEHFPSVAESLSDPDYDEMSPHVCRWISTKASSKSLPTSVYRKHLDGLTIVDVCWMPYGDHCVVIYDGIPLSSDTDQRGWCGNLDMFRPFLHGFNPTDPAKHPPVTQDDTYMEPRILEVLVAPAAAPAHAPSDVEQPRHAVACQAIKERFECLLNLRIVTAGTEIHEVMKDCLMIVRGVTAEGNVYVRS

SEQ ID NO: 137366 - protein, 117 aa, Glycine max
  Coding DNA Sequence Number=SeqID_45681
MMTFKIEFKTESRTLQGSKFDFKNQDSRIIKIKIQDYKIQESREDLIKISIKKFFKTLSSTRSFHKIITKEFYSLNKRRYISCGLVLVEGTSTRLFKENKGGYIPCGSLLVKGFLQG

SEQ ID NO: 137367 - protein, 112 aa, Glycine max
  Coding DNA Sequence Number=SeqID_45682
MGEIVLPQRFFPEESSSGTILEDTFFENFLEEPSFRRRWCHSGRTPEYIPKERVPECFRKKGLSEDNLLIPEEALASHLKEVNLAIRELLKEVFSKKLLKKVFSRKLLKEAT

SEQ ID NO: 137368 - protein, 90 aa, Glycine max
  Coding DNA Sequence Number=SeqID_45683
MHYSDHLAAARLICLVPGQCLADYMEWFFRISHSFITPTQAADQPRHPLVPQHEAYVEPDIPEVPVAPEAGPSQAADPPRHAVDACEEIA

SEQ ID NO: 137369 - protein, 152 aa, Glycine max
  Coding DNA Sequence Number=SeqID_45684
  Homolog annotation: Hit_ID=A2Q2H3; Match level="QueryCoverage=48%, HitCoverage=61%, E-value=1e-09, Identity=48%"; Hit description=IMP dehydrogenase/GMP reductase, related
  Pfam annotation: Domain name=DUF1723; Domain location=39-98; Score =24.6; E_value=0.00038; Accession=PF08330.1; Description=Protein of unknown function (DUF1723)
MTEDVPAPSVKASDVAKGLAGDDAEGSAGDDAEGFPGGPRDPSVLTSFVDHVAHSIWNGERWHKETSSFHLPVGELTITLDYVVSLLHLLIIGAFHSFEPLHVDKVIIMLVELLEVSGEEARAETAQCYGAYLNDASQSTGRQLAGYITLLQ

SEQ ID NO: 137370 - protein, 75 aa, Glycine max
  Coding DNA Sequence Number=SeqID_45685
MANRFTRLVELDYSQFALRDFCAITDFDLVVIANHFPCLRVLNLYNCEDEDHMLLKALFKTKKLKIFKMDDQDSL

SEQ ID NO: 137371 - protein, 59 aa, Glycine max
  Coding DNA Sequence Number=SeqID_45686
MGIVGKGFMGHGWVEGVVEWSLLNVDKVEDEGEDKGAIMKGWKKDLDQKEKVEVGVVGE

SEQ ID NO: 137372 - protein, 158 aa, Glycine max
  Coding DNA Sequence Number=SeqID_45687
  Homolog annotation: Hit_ID=A2Q4P8; Match level="QueryCoverage=32%, HitCoverage=22%, E-value=8e-13, Identity=62%"; Hit description=IMP dehydrogenase/GMP reductase, related
  Pfam annotation: Domain name=DUF1723; Domain location=51-100; Score =66.4; E_value=9.3e-17; Accession=PF08330.1; Description=Protein of unknown function (DUF1723)
MKLTLTAEAAQIGGDSSMTTTEELNDDDAEETKEDEARRGLSPLITCLLDTGDQGLMFAFMERWHKETSSFHLPVGDMTITLDDMAMLLHLPITGAFHTFESLHVDDTILQLVELLEVSAEEARAETIQCHGAYVRLSWLRDVYRSKCDTTQWTPAAQ

SEQ ID NO: 137373 - protein, 49 aa, Glycine max
  Coding DNA Sequence Number=SeqID_45688
MEDRLEDMIRDLGQESFQQAHAPMYDTLQTDSKKPLYPKCQNSLTLLSA

SEQ ID NO: 137374 - protein, 37 aa, Glycine max
  Coding DNA Sequence Number=SeqID_45689
MYLGKVAMEKKKRVVTVLSAMEKKKLRRRTREEDRQE

SEQ ID NO: 137375 - protein, 46 aa, Glycine max
  Coding DNA Sequence Number=SeqID_45690
MGEVVDTLKIVNLRSWEQTDNSRLHGVRCLLLEPPSRCDDVEIILG

SEQ ID NO: 137376 - protein, 693 aa, Glycine max
  Coding DNA Sequence Number=SeqID_45691
  Gene Ontology: Mol. function=transferase activity, transferring glycosyl groups; Cellular component=integral to membrane; Biological process=cell wall organization and biogenesis
  Homolog annotation: Hit_ID=A5BPE5; Match level="QueryCoverage=100%, HitCoverage=99%, E-value=0.0, Identity=75%"; Hit description =Putative uncharacterized protein
  Pfam annotation: Domain name=Glycos_transf_2; Domain location=230 -405; Score=15.5; E_value=0.0039; Accession=PF00535.17; Description =Glycosyl transferase
MAPSFDFANRWMKETQKGTPVVVTMENPTFSVVEINGADAAFMPVEKTRGKNAKQVTWFLFLKAYHAIGCVTWFATVLWSFMGAIGKRLIHREGLALESEKLEKGKILFRVIKVFVVSSLVVMVFEVVAYLQGWHFGNPSLHIPRPVDLEGLMYLVYVAWLTFRGEYIAPPMQALSKFCIVLFLIQSVDRMMLCFGCFWIKYKRIKPKIDGDALKVDDIEGSACNHPMVLVQIPMCNEREVYEQSISAVCQINWPRDCLLIQVLDDSDDESIQWLIKTEVTKWSQKGINIIYRHRLVRTGYKAGNLKSAMSCDYVKDYEFVAIFDADFQPNPDFLKQTVPYFKDNPELGLVQARWAFVNKDENLLTRLQNINLCFHFEVEQQVNGAFLNFFGFNGTAGVWRIKTLEESGGWLERTTVEDMDIAVRAHLNGWKFIFVNDVKVLCEVPESYEAYRKQQHRWHSGPMQLFRLCLPAILRSKISPWKKGNLILLFFLLRKLILPFYSFTLFCIILPLTMFVPEAKLPLWVICYIPVFMSFLNILPAPKSFPFLVPYLLFENTMSVTKFNAMISGLFQLGSSYEWIVTKKAGRSSESDLVAAAEREAKSIIEQQKIHRGASDRVLVESNQSKEHKETSGKPVKKANKIYKKELTLAFLLLTASVKSLLSAQGVHFYYLLFQGVTFLLVGLDLIGQQMS

SEQ ID NO: 137377 - protein, 163 aa, Glycine max
  Coding DNA Sequence Number=SeqID_45692
  Gene Ontology: Mol. function=DNA topoisomerase type I activity; Cellular component=chromosome; Biological process=DNA unwinding during replication
  Homolog annotation: Hit_ID=A5AWM5; Match level="QueryCoverage=76%, HitCoverage=11%, E-value=9e-53, Identity=80%"; Hit description=DNA topoisomerase
MVLMHDRNYVTVKSRVLSPEFRGCMVSAFLSHHFSEVMDYGFTADMETELDNVSGGLTEWKGLLRDYWTRFKSYCERTSNVHIHQVEKMLEKKFGDYLFASLPDQSRVCPSWAGGSCMEGTLIFKAVINILGAMLYMLCTTLHMLYTVSYTFGRMEYLKIVFY

SEQ ID NO: 137378 - protein, 158 aa, Glycine max
  Coding DNA Sequence Number=SeqID_45693
  Homolog annotation: Hit_ID=A5AE61; Match level="QueryCoverage=98%, HitCoverage=12%, E-value=4e-18, Identity=34%"; Hit description =Putative uncharacterized protein
MAVSGLVFSFSGTPTITTAKLNWKNYPSWSASVKLWFLGQGHHDHLEKASDSIPMTRDLNGRSLTTSSALYYGKIFANDIQSLFDATMKVTALKQTSHDMIAHVGKARAAVEELRKFLVADSLEEVNRKLDKFYMVLILRSLHSDFDYVRDQVLARDQ

SEQ ID NO: 137379 - protein, 327 aa, Glycine max
  Coding DNA Sequence Number=SeqID_45694
  Gene Ontology: Mol. function=aminoacyl-tRNA ligase activity; Cellular component=cytoplasm; Biological process=tRNA aminoacylation for protein translation
  Homolog annotation: Hit_ID=Q5BD96; Match level="QueryCoverage=51%, HitCoverage=16%, E-value=2e-32, Identity=42%"; Hit description =Putative uncharacterized protein
  Pfam annotation: Domain name=Anticodon_1; Domain location=186-315; Score=-4.8; E_value=5.2e-05; Accession=PF08264.4; Description =Anticodon-binding domain
  Pfam annotation: Domain name=tRNA-synt_1; Domain location=1-222; Score=-392.9; E_value=0.0028; Accession=PF00133.13; Description=tRNA synthetases class I (I, L, M and V)
  Pfam module annotation: Pfam domain module=Anticodon_1::tRNA-synt_1; Domain location=186-315::1-222
MVANTTIFMENMLFIHLMITSAHDPNDFEVGKRHNLEFINGLYRGSENNEMRPGVCLRRNDVLEPMIKPRWYVNCNDLEKQALPTVVDEENKRIEIIPKQYLADWKRYLYLCLLFANSCNEHGKIYPTEHFSIMIYLHPMVCDAHGHKMSKPLGNVIDPIEVINGISLEGLHKRLEVGNLDPKELATTIESQKKDFPNGIDECGVDALRFALVSYIAQYQLCDAFIEVIKPYIIGNDPKFAFEKCFAKDTLWFCLGNGLRLLHPFIPFFIEELWQRLPSTREYDRAKSIMICDYPSTIEVSFALQNIARISLHVIYCYPSAPTNEGL

SEQ ID NO: 137380 - protein, 160 aa, Glycine max
  Coding DNA Sequence Number=SeqID_45695
MDKSFKEGEDEWREKEIRSMKFSASNEVFPKALTLATELYEALVKVINKGEIEQLEKDMLLIEGNANCSPLESKAKDWTLRLEIVAKQRWLGKAQRGRRRRKRGLNHFHTKEKKKKRSGHEGRVRGSRRVGAPTVVFVASNPGGESKSERESHNTGSARE

SEQ ID NO: 137381 - protein, 71 aa, Glycine max
  Coding DNA Sequence Number=SeqID_45696
MMTKVMNQRMSSRCSRGKLKNTSRFKRKVEFKNQESRFKDQASRIKIKIQDSRIKRRLNQDKYEKVFSKTE

SEQ ID NO: 137382 - protein, 73 aa, Glycine max
  Coding DNA Sequence Number=SeqID_45697
MKVHITKFESNEMLLSPIALKVVFPLLLDSNSSRDGTNPPFQFPKWQFTNKETKRQAITKDPKNEMKAKPIEF

SEQ ID NO: 137383 - protein, 110 aa, Glycine max
  Coding DNA Sequence Number=SeqID_45698
MGRRPLPSSGQMKSAAARQPKGANCANTTREGGYHAATMHTGARFHPCRCKKTSADRAHQHDHSYTDMGHAHKTPSGLGEVQQGPGVSSSSYGPLSVLQVLVGKYAYSSN

SEQ ID NO: 137384 - protein, 172 aa, Glycine max
  Coding DNA Sequence Number=SeqID_45699
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTVAPYPVTIVLSPT

SEQ ID NO: 137385 - protein, 329 aa, Glycine max
  Coding DNA Sequence Number=SeqID_45700
  Gene Ontology: Cellular component=viral envelope
  Homolog annotation: Hit_ID=Q84VH5; Match level="QueryCoverage=94%, HitCoverage=47%, E-value=1e-146, Identity=83%"; Hit description =Envelope-like protein
MAQKKSTPITPTTSRRSKVAIPSKKRKEISSSDSDDDVEPDVPDIKRTKTSGKKVPGNVPDAPLDNISFHSIGNVERWKFVYQRRLALERELGRDALDCKEIMDLIKAAGLQKTVTKLGDCYESLVREFIVNIPSDITNRKSDEYQKVFVRGKYQTDGVVDIAVSEHQIAKEITAKQVQHWPKKGKLSAGKLSVKYAILHRIGAANWVPTNHTSTVATGLGKFLYAVGTKSKFNFGNYIFDQTVKHSESFAVKLPIAFPTVLCGIMLSQHPNILNYTDSVMKRESPLSLHYKLFEGTHVPDIVSTSGKAAASGAVSKDALITVLKDTCK

SEQ ID NO: 137386 - protein, 145 aa, Glycine max
  Coding DNA Sequence Number=SeqID_45701
  Subcellular localization annotation: CTP_CleavageSite=19; ConfidenceScore=5.18e-01
MMKHKTEKNTSLGIPRSCRSAPPRKSNRLPPCLGIGPVSRPCDLSRKLLRGRAYKRGGTLPLLTAAEMILLHAQWLSRISLPRWWRCARALRCVTLCLPRRAVLLNEGSGDQWSDHFVGGDLNSEGLAEACDQSRKTQGHVRLIR

SEQ ID NO: 137387 - protein, 73 aa, Glycine max
  Coding DNA Sequence Number=SeqID_45702
MECPRAPPRYAHVAFESYPQKNGGLREPSRGYGYHCVIKLFATKSISWLVSTPVCAKGGLRHWKCGRQALWLI

SEQ ID NO: 137388 - protein, 61 aa, Glycine max
  Coding DNA Sequence Number=SeqID_45703
MPTLRRVCQGLSLLIQGLIINSSPFKGLIINSSPLKGLNINSSPKKGLSINSSLSKGLMIV

SEQ ID NO: 137389 - protein, 184 aa, Glycine max
  Coding DNA Sequence Number=SeqID_45704
METLQKVCKAWEVVRKKDKEFRGSNNGPIGGYQPLKGRKWRHLEEDEEVQALRTELEQAQAVKERFKSAALKIRKENAELRDINIATTKALEQETKRARREEHGRKKFRGALSKRSLSQQLYETETNMLAIITKYQEELYLATAHEHRVADEYAQVYAEKEARGRVINSLHQEATMWMDRLALT

SEQ ID NO: 137390 - protein, 60 aa, Glycine max
  Coding DNA Sequence Number=SeqID_45705
MPKDRGTCLDFRDCHHQRGGDCRQRIKLNVLMMPKFHMRLKALFKTKKLKIFKMDDQDSL

SEQ ID NO: 137391 - protein, 52 aa, Glycine max
  Coding DNA Sequence Number=SeqID_45706
MASAELSHMNAHPCQDGVHQLTLRQGEVGITIAGQDVAEQQSHPYLSEGGHV

SEQ ID NO: 137392 - protein, 122 aa, Glycine max
  Coding DNA Sequence Number=SeqID_45707
MPISACRCIGWDRAHKTPSEPEESPTGPWGFQLWLRASVVLQGARSPRQGHGSRLQDTQWTRRSPTGSWSCQALITGLCQFYGVPVTSSKGIRPPTNRAFIKKYCVSRQAQGETPQQPGDGR

SEQ ID NO: 137393 - protein, 71 aa, Glycine max
  Coding DNA Sequence Number=SeqID_45708
MSHPILSEHCMPVSSSIRLLPLSKIIGILVRVTLFCKNAPTMWDRHKFKGVLKPGDPQGLHSEESVRVSPS

SEQ ID NO: 137394 - protein, 81 aa, Glycine max
  Coding DNA Sequence Number=SeqID_45709
MYLLVVERVVQNQFWMFSKFLLLPYFAWFCWSMMIGCGITWMLWKLERIDGDLALRGTRIRATWEYVSSVGGGQQGMVGYT

SEQ ID NO: 137395 - protein, 95 aa, Glycine max
  Coding DNA Sequence Number=SeqID_45710
  Homolog annotation: Hit_ID=A5AV98; Match level="QueryCoverage=94%, HitCoverage=11%, E-value=5e-21, Identity=51%"; Hit description =Putative uncharacterized protein
MKKKFIIKAWERSNRLSLMLMRMTVADSIKITLPKIESTKKFMELVGECSQTADKSIAGTLMSTLTTMKFDGSRTMYEHVIEMTNITARLKTLRI

SEQ ID NO: 137396 - protein, 128 aa, Glycine max
  Coding DNA Sequence Number=SeqID_45711
  Subcellular localization annotation: CTP_CleavageSite=60; ConfidenceScore=5.32e-01
MKLCFYTNRLNSFVSPFSLSKRIQRTNRLRYLLFPLTKIQRTNHLKILCVNTLEGTSFVVQVEGTSTWVVVTENKRGYISCGSTQVEGTSTWLFKENKGGYIPCGSLLVKDFTTLKEISRTGGCLGTG

SEQ ID NO: 137397 - protein, 148 aa, Glycine max
  Coding DNA Sequence Number=SeqID_45712
MGEVEKTQENMKADMEAIKEKMATMMEAMMSVKKIMEANAVAIAATSVVAKVNPTSPSGINQMNHPTSDMVGKDLGSTGGPHNVQIQNEHAFPPYGLPLNYTPPNVAYTPNEISITPLPYSLRANNLNLIMHMSLDPWRRHMKFPTTI

SEQ ID NO: 137398 - protein, 41 aa, Glycine max
  Coding DNA Sequence Number=SeqID_45713
MDKSLKVGEDEWKEREKGKHNFEREKRENEQANAHLPLGLV

SEQ ID NO: 137399 - protein, 221 aa, Glycine max
  Coding DNA Sequence Number=SeqID_45714
MTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDAPQAAGTPPPPHQAGQAGAFDMEQYLRHLVRQQAANHRAHSQGFASFSCPTPDQFRAEVAWPGDWPEAQAGEAPPEAPGDGEEAREDEEMADLLDFLGGSGDT

SEQ ID NO: 137400 - protein, 167 aa, Glycine max
  Coding DNA Sequence Number=SeqID_45715
  Gene Ontology: Mol. function=transcription factor activity; Cellular component=intracellular; Biological process=regulation of transcription, DNA-dependent
  Homolog annotation: Hit_ID=Q1GY41; Match level="QueryCoverage=100%, HitCoverage=100%, E-value=1e-44, Identity=56%"; Hit description =Transcriptional regulator, MarR family
  Pfam annotation: Domain name=MarR; Domain location=54-125; Score =66.2; E_value=1.1e-16; Accession=PF01047.13; Description=MarR family
MLLLKELPTSKSLEKFVTRYPGTDISAISDFVSILRAASDISSALDALLAQHGLLQGRWWVLVLLMRQDDLTSSPSELAEKAGVTKATMTGFIDGLEREGLVSRFMDTNDRRKFLIRLSVAGQQKLDEVMPVYVQCVTQFMNVLGKPERNTLITDLARLASRVDLIK

SEQ ID NO: 137401 - protein, 92 aa, Glycine max
  Coding DNA Sequence Number=SeqID_45716
MSLVELILTRQHYGYSIPKNQVTTLPVQIYDKLALSIQILRIKPFPNKDDPNYICPHTQNSLPILCFQALYGNPIGGLSLSANLALSLEDDG

SEQ ID NO: 137402 - protein, 57 aa, Glycine max
  Coding DNA Sequence Number=SeqID_45717
MTTGGRRKPPLLATEPRHQEEHFNRSGILIILLKDLVEKIPPIHHFIASLRVFLHFL

SEQ ID NO: 137403 - protein, 108 aa, Glycine max
  Coding DNA Sequence Number=SeqID_45718
MGRRVRIMRTRMTTLTQIWMTLLLSNILPSDHNSDLPLLKCQLVYAILTQSQDIIPFPWPTPNQFRATVAWPGDRPDFQTGPGLAGTPRDKDGAQDDDGMADVMDFFL

SEQ ID NO: 137404 - protein, 67 aa, Glycine max
  Coding DNA Sequence Number=SeqID_45719
METKSDPPNKTSKANGPRRNPSPPNPPLGDVGEEEPPFLPLISLPPGLREFSFSIPFFTFIPIVQIY

SEQ ID NO: 137405 - protein, 239 aa, Glycine max
  Coding DNA Sequence Number=SeqID_45720
  Gene Ontology: Mol. function=3-deoxy-7-phosphoheptulonate synthase activity; Cellular component=cytoplasm; Biological process=aromatic amino acid family biosynthetic process
  Homolog annotation: Hit_ID=A7MHW0; Match level="QueryCoverage=87%, HitCoverage=58%, E-value=1e-103, Identity=88%"; Hit description =Putative uncharacterized protein
  Pfam annotation: Domain name=DAHP_synth_1; Domain location=8-239; Score=288.3; E_value=1.5e-83; Accession=PF00793.11; Description=DAHP synthetase I family
NSYDHDYEFELGTPIEYARRFKALAEEVSDSLYLVMRVYFEKPRTTVGWKGLINDPHMDGSFDVEAGLKIARRLLVELVSMGLPLATEALDPNSPQYLGDLFSWSAIGARTTESQTHREMASGLSMPVGFKNGTDGSLATAINAMRAAAMPHRFVGINQAGQVCLLQTQGNPDGHVILRGGKAPNYSPADVAQCEKEMEQAGLRPALMVDCSHGNSNRGSSRVDLQACKLGTGRRFTTS

SEQ ID NO: 137406 - protein, 158 aa, Glycine max
  Coding DNA Sequence Number=SeqID_45721
  Homolog annotation: Hit_ID=Q2HS67; Match level="QueryCoverage=85%, HitCoverage=38%, E-value=8e-08, Identity=29%"; Hit description =Cyclin-like F-box; F-box protein interaction domain
MLSLEVSEKTEMKVYGAAKVGGVYLSGTLNWVKGKETIHSEIIIISVDLEKETCRSLFLLDDFCFFDTNIGVFRDSMCVWQDSNTHLGLWQMRKFGDDKSWIQLINFSYLHLNIRPYEEKSMILPFCMSNNGDFFMLKFTRNADDEYQTILYNQRDDV

SEQ ID NO: 137407 - protein, 150 aa, Glycine max
  Coding DNA Sequence Number=SeqID_45722
MANQGDWVPFMDVLALLIFGVVLFPNVEGLVDLAAIDAFLAYHHSKESPVVAVLADLFDTFDRRGCINYNPTLAIRQLGYPIRGAPTEESMSPFLVRDLGAQNSKTIQRIHKAWETPLRKDQELRGIRNGIIGGYHEWLKVHIRGLDWLA

SEQ ID NO: 137408 - protein, 65 aa, Glycine max
  Coding DNA Sequence Number=SeqID_45723
EVLVGGHPVSFLLFVATCPFAGERGEAHGCAFQRRKRCAESPPTKVDNSGALAPTYPPSKRKSDL

SEQ ID NO: 137409 - protein, 26 aa, Glycine max
  Coding DNA Sequence Number=SeqID_45724
MESSEDLKNEDINLCLMAKSYESGEE

SEQ ID NO: 137410 - protein, 37 aa, Glycine max
  Coding DNA Sequence Number=SeqID_45725
MAHQMGRSHRHSQEAIIVRKVDANSTTRSNDMRARIV

SEQ ID NO: 137411 - protein, 130 aa, Glycine max
  Coding DNA Sequence Number=SeqID_45726
IAGARGASSIGSKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRGV

SEQ ID NO: 137412 - protein, 110 aa, Glycine max
  Coding DNA Sequence Number=SeqID_45727
  Homolog annotation: Hit_ID=A2Y1D2; Match level="QueryCoverage=83%, HitCoverage=16%, E-value=7e-09, Identity=39%"; Hit description =Putative uncharacterized protein
MVAHIPDPRVDPSQYRDLVHYWCSGKGQKISNINKRSCSKYKDLHCMGTNNLPRRIHEMTTKAKGVQPSREKIYIDTRTRKDGSIVTEKAAIVIDELKKKMVETESSQNL

SEQ ID NO: 137413 - protein, 118 aa, Glycine max
  Coding DNA Sequence Number=SeqID_45728
MSLHSSSSVNGEGFTPKDPFYKILDELRSLKLWKEKQERKEKEGVIVHILNITPKEEKRIEGLKRLTLASHISMEKIMLRPYLDWEMKVEQLFACLHISEERKVPLATLNFQAYALYW

SEQ ID NO: 137414 - protein, 58 aa, Glycine max
  Coding DNA Sequence Number=SeqID_45729
AFCDIEAIYTFEGTYDINTLVIGREITALGVVLRKGPKRPLREKLTLMQCQSEWDIEK

SEQ ID NO: 137415 - protein, 129 aa, Glycine max
  Coding DNA Sequence Number=SeqID_45730
MTSRGSEMPQRTFLRRRHGPSVGKPTKEKSHDKTLHKIKWPKLSKKQSPVESPTIAAGPSTGGRRVTRGMRVPRKEYARSRHQRLFEENVGKTGKDAIYELLSEKVRELYLRAGKVLAPHTSVPRDDNL

SEQ ID NO: 137416 - protein, 108 aa, Glycine max
  Coding DNA Sequence Number=SeqID_45731
MVYNNGTNLKILMSHLETSNNSFQNCPIQHQLDLAPYASEPYNAQWNAPRLLRDKHTLRSSRILEEMEVDEPWLGLWLPLNYQVDMGANFVADLGIAFVDNWAVGKEK

SEQ ID NO: 137417 - protein, 135 aa, Glycine max
  Coding DNA Sequence Number=SeqID_45732
  Homolog annotation: Hit_ID=Q84VI1; Match level="QueryCoverage=77%, HitCoverage=28%, E-value=1e-33, Identity=95%"; Hit description =Envelope-like protein
TKYLGRPTDGVADIDVSEHQIAKEITAKRVQHWPKKGKLSAGKLSVKYAILHRIGAANWVPTNHTSTVATGKAAASGAVSKDALIAELKDTCKVLEATIKATTEKKNGAGTADRKDSQTVALMMVKQLREEEAAE

SEQ ID NO: 137418 - protein, 60 aa, Glycine max
  Coding DNA Sequence Number=SeqID_45733
MVSITPVKVPQPPFFRGYESNTTCAYHGGVLGHFIEHCMTLKRKDFQVYAIIVNHSYNAK

SEQ ID NO: 137419 - protein, 150 aa, Glycine max
  Coding DNA Sequence Number=SeqID_45734
MDFFSNESFECIQAFENSNLIPFMSLKLPVYTELVKAFCSNLEIQEGTLISEVYGIKMIIYQSLFYDLTQLFSEGVPFEGTLNNDWKFDFSVHDARRLVCTNQADMTGRLLAGSLAFESRIIHYLIVCCFQDLQILKRNLKDCRSLGDWM

SEQ ID NO: 137420 - protein, 174 aa, Glycine max
  Coding DNA Sequence Number=SeqID_45735
  Homolog annotation: Hit_ID=UPI00006A2D9E; Match level="QueryCoverage =86%, HitCoverage=85%, E-value=1e-12, Identity=15%"; Hit description =UPI00006A2D9E related cluster
MAGSLDESISCFLIRVDPWVLVPIAFGRLHALAFRGLHVLALRGMHDLPFKGLHVLAFRGLHALTFRGLHVLAFRGLHALVFRGLHALAFRGLHALTFRGLHTLTFRGLHVLAFRGLHLFAFRRLYVLAFKGQHILPLRGLHVLTLRGLHVLPFRGLHVLAFRGLHALAFRGLH

SEQ ID NO: 137421 - protein, 137 aa, Glycine max
  Coding DNA Sequence Number=SeqID_45736
VLALRGLHVLAIRGLHALTSRGLPVLALRGLHALTLGLHALTLGTSYPHQLRGLHVLALRDTPIRGLHALAFRGLHVLALRGLHALTLGISYPHRERTTRPRLERTTRPHHQRAARPHLQRTTRPRLERATRPHLGY

SEQ ID NO: 137422 - protein, 72 aa, Glycine max
  Coding DNA Sequence Number=SeqID_45737
  Subcellular localization annotation: CTP_CleavageSite=24; ConfidenceScore=5.17e-01
MAVVNPEKIYLSPFPSMRDSPNVRTNSLTSHGGSMVNAVEECGPRGPKRMEDVLTSKRFILEALHEAGYDLP

SEQ ID NO: 137423 - protein, 163 aa, Glycine max
  Coding DNA Sequence Number=SeqID_45738
MAPRKLASKRSRKDKAAEGTSSAPEYDSHRFRSAVHQQRFEAIKGWSFLRERRVQLRDDKYTDFQEEIGRPAVGITEEGVRDMRSWVRGQWIPFDADAIGQLLGYPLVLEEGQECEYGQRRNRSDGFDEEAIAQLLCIPGQDFARTAAGRRVRIMRTNMTTLT

SEQ ID NO: 137424 - protein, 94 aa, Glycine max
  Coding DNA Sequence Number=SeqID_45739
  Subcellular localization annotation: CTP_CleavageSite=22; ConfidenceScore=5.04e-01
MTVQNGGFNPFSLSLTFWNPNRATRGRSLESTKSTVIDNVKHLSDYIEKNDDLRLLNRWIVVKFKHQIRNPIPSIPTNGNFDIMSGMRDIPFAS

SEQ ID NO: 137425 - protein, 185 aa, Glycine max
  Coding DNA Sequence Number=SeqID_45740
  Homolog annotation: Hit_ID=A5B5G7; Match level="QueryCoverage=89%, HitCoverage=11%, E-value=4e-10, Identity=30%"; Hit description =Putative uncharacterized protein
GQWRTHPSNQFNKDQGGPLNRQQQGPSLYDRMMKLEETLAQFMQVSMSNQKSTESAIKNLEVQVGKLAKQLADRPSRSFGANTEKNPKEECKAVMTRSKMVSMNEEIDLVVEPLSETEEKVEAEDDQQKEIPIIVSEKEINMLTQKNKYIHSENIIVEGNCSAIIQRILPPKHKDLGSVTILCAI

SEQ ID NO: 137426 - protein, 199 aa, Glycine max
  Coding DNA Sequence Number=SeqID_45741
MSFTKGKMCVNEMAQKKLSTKRSRRDATREGSSAASEFDSHRFRSAEHQQHFEAIRGWSFHRERHVQLREDEYTDFQEEIARRHLTPLVTPMAKFDPKIVLEFYPNAWPTEEGVRDIRSWVRGQWIPFDTDALSQFLGDLLILEEGQQCEFGQRRSQADGFDEEAIAQLLCIPGQDFSWTTAGRRVRIMRTSMTTLTQI

SEQ ID NO: 137427 - protein, 29 aa, Glycine max
  Coding DNA Sequence Number=SeqID_45742
DQKDALQNGLVTMEDVQMAVADYFISDFV

SEQ ID NO: 137428 - protein, 50 aa, Glycine max
  Coding DNA Sequence Number=SeqID_45743
MAQARQKGGRSLPPQLAQASKVASSRNNSLLEESSGGPKWAWLLFAPFFY

SEQ ID NO: 137429 - protein, 226 aa, Glycine max
  Coding DNA Sequence Number=SeqID_45744
MRGAPTKESLSPFLVRDLGTQGLKVIQRIHKAWRSPLKKDKELRGIRNGVIGDWLSKLKVIDEENFEAPKEDEEVRALNLELGKARLAKEKFKSAATHIRKECTELQEENAATARALEQETKRACKEEYGREKFRGALWGSNNELKLRREERDRSRVHGMILKEELVACARSKRSLAQHLEATEQSMLAIIGQYKEELNQSMAHEPKASGGFCTSVYRKRSKRKGD

SEQ ID NO: 137430 - protein, 122 aa, Glycine max
  Coding DNA Sequence Number=SeqID_45745
METISKRFEELDVCGKFTLRTKLWEIAYPDQNSMCPPPAKVNTKGAPKKAMSKNPRYGSRLLVGVHNHLLKELAKFLEDYIKLFGSTERFEELRMSLLVDGLAKVTTDKWMDITDMGHVFAS

SEQ ID NO: 137431 - protein, 307 aa, Glycine max
  Coding DNA Sequence Number=SeqID_45746
  Gene Ontology: Mol. function=unspecific monooxygenase activity
  Homolog annotation: Hit_ID=Q2GLW7; Match level="QueryCoverage=32%, HitCoverage=90%, E-value=9e-29, Identity=68%"; Hit description =Putative uncharacterized protein
LAPGRQNEREPTNGEGRIKATRAESQWIVAARPLCHLQYPVAYLSRLQRILPAARWELRFKASRRANPPHEGRQRHVPLGGRGPLLLVGKRTAGARVASSPDSDLEAFSHNPTHGSFAPLAFQPSAMTNCANQRKSRHRRIKKQRRYERLAATSQLSPVGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWES

SEQ ID NO: 137432 - protein, 92 aa, Glycine max
  Coding DNA Sequence Number=SeqID_45747
VPPVQLLTGWCVTAKAPPDISAGKCSGRVPFAIQAAQLLGRAIGAGLFAITPAGERGMCCKAIKLGNARVFPEFDNQRLLVSHVGGGAVKQR

SEQ ID NO: 137433 - protein, 81 aa, Glycine max
  Coding DNA Sequence Number=SeqID_45748
MGHATLPPFSCNLCLNEMAPRKLASKRSRKDKAAEGTSSTPEYDSHRFRSAEHQQRFEAIKGWSFLRERRVQLRDDKYTNF

SEQ ID NO: 137434 - protein, 54 aa, Glycine max
  Coding DNA Sequence Number=SeqID_45749
MTATATKSISSTPLGRDGTVRRHLAQEIAIVVPRYAVKPLATVTLESTDHRWRG

SEQ ID NO: 137435 - protein, 44 aa, Glycine max
  Coding DNA Sequence Number=SeqID_45750
MGLPGLKEHSNPMTPKAYTPKSPSGPLPPDSGPTPKIILAHRHC

SEQ ID NO: 137436 - protein, 25 aa, Glycine max
  Coding DNA Sequence Number=SeqID_45751
MKAKCNQRWHGGAKTVSPGMLAQAS

SEQ ID NO: 137437 - protein, 92 aa, Glycine max
  Coding DNA Sequence Number=SeqID_45752
  Subcellular localization annotation: CTP_CleavageSite=35; ConfidenceScore=5.21e-01
MNCVFVHVSSIGAMRSDCLVQFSILNLFTSPMNCVVVHVSSIFEFGALRSDCLVQFSILNCRNLPFGGRATRDSRDACSTKGIRAESPPTFI

SEQ ID NO: 137438 - protein, 53 aa, Glycine max
  Coding DNA Sequence Number=SeqID_45753
MSEKTQKGVVYELLSVKGSEVVFTHEEGIGTPRVRHKGRQPLIKGVSLAPTYS

SEQ ID NO: 137439 - protein, 62 aa, Glycine max
  Coding DNA Sequence Number=SeqID_45754
MMGCPFHDSFAGSWDGDRLLPSGPEEESVSLSWFLSQQVSYSPDKSSRLEVEPCWLPGVSLL

SEQ ID NO: 137440 - protein, 97 aa, Glycine max
  Coding DNA Sequence Number=SeqID_45755
MNRGKTTFITEEKRLSLVRVDVAKVGSKISRVGLRVAFVKRTRGGTCKIKDFDTKIIEYLPQDKKVTTYSNNGYLEIICQFGNPPTKRGTSMLMRQG

SEQ ID NO: 137441 - protein, 77 aa, Glycine max
  Coding DNA Sequence Number=SeqID_45756
MDSSGAFSRMIRRSAKMYSSSFFQILPHAQPKEWFYTQCGSKAFQVYFDDAKDSSQELRVKQVSRIKESFNQESRYK

SEQ ID NO: 137442 - protein, 170 aa, Glycine max
  Coding DNA Sequence Number=SeqID_45757
APTGAEKREELEPERRHANRGRISASKKKFQKLLPPFHVAFLPSSSPFLFLSTPNCKENPFSESWSLPLLRGALNFRKLVEMMGRVNLRLNVRMVVLTCKKAWTEQMRKMSDRCERKEPFLGHGLGLVGSNLSKIGCMQVGFRNMPNCAAKAVKLCSKFDQMCRKMVVQC

SEQ ID NO: 137443 - protein, 212 aa, Glycine max
  Coding DNA Sequence Number=SeqID_45758
  Homolog annotation: Hit_ID=Q84VH5; Match level="QueryCoverage=100%, HitCoverage=35%, E-value=2e-98, Identity=78%"; Hit description =Envelope-like protein
MDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVATESFAVKLPIAFPTVLCGIMLSQHPNILNNIDSVKKRESPLSLHYKLFEGTHVPDIVSTSGKAAASGAVSKDDLIAELKDTCK

SEQ ID NO: 137444 - protein, 190 aa, Glycine max
  Coding DNA Sequence Number=SeqID_45759
MAHQLPSQGVPFEGTIVDDWKFDYSNHDAHRIVCNDQADMTGRLLAWSLAFDCRIMHYIIAFLTDRQIEWAHLVRYHMHKALWTNAPLPYPQLVTLFLCHFQIPLDDEPFVQVKKSFAIGVGARDASSTLMHEVLYELRGLRAFVADCFDGMDSRLDAMHACFEGMATRITQLEDDMGFILHCFDPPAAP

SEQ ID NO: 137445 - protein, 43 aa, Glycine max
  Coding DNA Sequence Number=SeqID_45760
MATPMSTACYLDKDETGQSIDIKKYRDFNQIPKNHILVQLREL

SEQ ID NO: 137446 - protein, 66 aa, Glycine max
  Coding DNA Sequence Number=SeqID_45761
  Subcellular localization annotation: CTP_CleavageSite=47; ConfidenceScore=5.17e-01
MSPPFSWVSVSPNLNLLNDVLCLFSAGKGQRSVGRDPSPTCIRPYVPASRKQKYATNRDRSSSYLG

SEQ ID NO: 137447 - protein, 152 aa, Glycine max
  Coding DNA Sequence Number=SeqID_45762
LLVVPSVVRLMKQANVFPLKKTLKKFIIWEINRDKDILKEDSQASSRGGPSNRPIQQGPNIFQRTTKLEETLTQLKQVGQLAKQIANKSSNSFVVNTEKNPKLEWKAMMTRSKKFVEAEDEDNVVSKKKAAEKKGIDEKKYDVRGESNQENK

SEQ ID NO: 137448 - protein, 129 aa, Glycine max
  Coding DNA Sequence Number=SeqID_45763
  Homolog annotation: Hit_ID=A5BVM8; Match level="QueryCoverage=99%, HitCoverage=7%, E-value=2e-16, Identity=42%"; Hit description =Putative uncharacterized protein
MGNARFLEEVEFGKEENIRKVVFEKEPIIDSAQVLIPIVVQETTPVIENNVQTIVDDIVQEQDNDEVLPQRPIQQPQQPQEVLLRRSNRERRSAIPDDYIIFLQEHEDGIGFTEDDLINFCQTMLSSNS

SEQ ID NO: 137449 - protein, 47 aa, Glycine max
  Coding DNA Sequence Number=SeqID_45764
MDTKGFLAGERITDAGMLLGGRAQIGGDGFSKKLSKTLESNLRVLPT

SEQ ID NO: 137450 - protein, 54 aa, Glycine max
  Coding DNA Sequence Number=SeqID_45765
MATEWRGKGERRRHFKEKMSLEKAQHHRRPWIRALRKKEPTNPRSSPRFSTKCA

SEQ ID NO: 137451 - protein, 85 aa, Glycine max
  Coding DNA Sequence Number=SeqID_45766
MVTLINGVFHPSKVAAKVVTLSIRQQFGQPWPTWGAIPKDHQELFSSILRWFYQLVGSRHLPEELGRTVYVDEVFQQTHLRKDTS

SEQ ID NO: 137452 - protein, 21 aa, Glycine max
  Coding DNA Sequence Number=SeqID_45767
MSRNFTDCPMMGVKYLEAVKR

SEQ ID NO: 137453 - protein, 259 aa, Glycine max
  Coding DNA Sequence Number=SeqID_45768
  Homolog annotation: Hit_ID=A2Q4S5; Match level="QueryCoverage=40%, HitCoverage=15%, E-value=5e-11, Identity=35%"; Hit description=IMP dehydrogenase/GMP reductase, putative
CWIYEHFPSVHRSVADDGFAEASPRACRWLTGKAQMISIKEAPYRARIDGLTVTDVCWMLYAEHRGVRGYDLISSYMGQVRWGPIIVYLRPERVVRQMGYIQTVPLPSVRDSLTGTDIDDRWVQFSDHVAPTGELCVVPGQVAPDYMECFFQISHPFVTPTEDIAEPRPAPPLPTHDDDFVEPPVAQVPIASDPPTHSVVDCTACVRMGRIAEHLERVINLRMVTARTDLYDIMDLCLRIARDDDPDDSLRPRQRPRIN

SEQ ID NO: 137454 - protein, 78 aa, Glycine max
  Coding DNA Sequence Number=SeqID_45769
MVPNAWLTRKWCFFGHLNFIITFSVHKLKGCPSHSSVWEVVEVLAIRIAIPWITGLNRAHAFTKSFTLTKDVGTMLKI

SEQ ID NO: 137455 - protein, 16 aa, Glycine max
  Coding DNA Sequence Number=SeqID_45770
DKQNCKFGELLVGEYD

SEQ ID NO: 137456 - protein, 48 aa, Glycine max
  Coding DNA Sequence Number=SeqID_45771
MLLGTSSLSIHNAINDASFDCTGCRTTPHKDTKKGLAKCHQAKVPGRN

SEQ ID NO: 137457 - protein, 160 aa, Glycine max
  Coding DNA Sequence Number=SeqID_45772
MMTMIVDTLPVFYYGEWWATHLQSFADLVFASERIDVGLKRGKFSHPAWTNEKTGANEEGEDEGEARAVTAIPIQPSFPPTQQCHYSANNKPSPYPPPSYPQRQSLNQPQTITLAKVHQPPFLREYDSNATCACHGEASGRSIEHCRALKRKVQGLIDAG

SEQ ID NO: 137458 - protein, 180 aa, Glycine max
  Coding DNA Sequence Number=SeqID_45773
MSEVHGTSMVIDQSLFFSLTHLPSQGAPFEGTIVDDWKFDYSSHDARRMIDWAHLVRYRMHKALRANAPLPYPHLITLFLRHFQIPIDDEPFVQVKRSFAIGAGAVTSFGYRKDRNGQWLKKDALPPQDERTPSPPPQREDSALMNEVLSELRGLRSYVGDRFDFVRFTLCRYGHSPYTA

SEQ ID NO: 137459 - protein, 178 aa, Glycine max
  Coding DNA Sequence Number=SeqID_45774
MTQELVTRGDTLQLSAPRRSVTPSVIDEQRPMWSSAPFPEMSASSGGDFFKSHKLSRTTGGGPDDMRRQNLVIPHSFAIQTQSCPMARRDKIWSFCTLLSSRGGGPDDMQRQNLVIPHPFAIQTQLCPMARRDKIWSFCTLLSSRGGGSDDMRRPNLVIPKPFAIQTQSCPMARRDKI

SEQ ID NO: 137460 - protein, 104 aa, Glycine max
  Coding DNA Sequence Number=SeqID_45775
  Subcellular localization annotation: CTP_CleavageSite=34; ConfidenceScore=5.81e-01
MAYPPTSPPPPPSSPPPPPPYPLSNASALSAIVKRTRKASRLRSLSTRPPSVERPVVHVDPATSKADGPHRKKLRTYLGIVTRDKVDVTYENWKEVPTAQKDLI

SEQ ID NO: 137461 - protein, 85 aa, Glycine max
  Coding DNA Sequence Number=SeqID_45776
MKENLKKLRDMNKDGTNSQANVVKSVEDEDDVFLATNDEHICRDRKMFDTLKIDGEFSHFKLGNGGKMKVEGIESVRMKLHDRAI

SEQ ID NO: 137462 - protein, 90 aa, Glycine max
  Coding DNA Sequence Number=SeqID_45777
MLNGMPRDSSMISTCYVRVVSSEKWRLRNLGWVMATIALLSRYGSQLAYNTKIGVNSIGFFAGKFVPWLVLWFMIRVVFGIGYAVGGIYD

SEQ ID NO: 137463 - protein, 49 aa, Glycine max
  Coding DNA Sequence Number=SeqID_45778
MQCMNMCPMCAVKKVIWTFQLPVTKDETNIQRMRDNMMQMRKSATVGCT

SEQ ID NO: 137464 - protein, 71 aa, Glycine max
  Coding DNA Sequence Number=SeqID_45779
MARTKKTGEMTTEAAKEIAEKINAMYHCVFSVQDSFEEQATQGSFVPHGRPEHPGRVRAAGAGVTIKQYFG

SEQ ID NO: 137465 - protein, 210 aa, Glycine max
  Coding DNA Sequence Number=SeqID_45780
QGATFEGTIVDDWKFDYSSHDAHRMVCNDQAEMNDRLLAGSLTFDCHIMHYIIIRILLPRSSNLAQASEEDLILMWAFLTGRQIDWAHLVRYRMHKALRANAPLPYPQLVTLFLRHFQIPLDDEPFVQIKRSFAIGASAVTSFGCRKDRNGQWLKKDALPPQEEPLMTEVLSELRGLCTYVGERFDSLDGRFEGMDTRITQLEEDVTYLR

SEQ ID NO: 137466 - protein, 215 aa, Glycine max
  Coding DNA Sequence Number=SeqID_45781
  Homolog annotation: Hit_ID=Q6WAY6; Match level="QueryCoverage=91%, HitCoverage=36%, E-value=6e-22, Identity=30%"; Hit description =Putative uncharacterized protein
MARVAKVVKISAQELDRVKQNRNGVVGIPRKHLEERAEALAYQGEWTSFIDILALLVFGVVLFPNVNGLVDLVVIDAFLAYHHSKESPVIVVLADAYDTFDLRCEKRSRPVFPLQGHRMCTEKGKENWEELLVCMVEASISWFPQWKEGGARVLCSCEGFPNVPLMGTKGCINYNPILAIRQLGYPIRGAPSEEIIAPFVARGFREGNAKMLQRI

SEQ ID NO: 137467 - protein, 264 aa, Glycine max
  Coding DNA Sequence Number=SeqID_45782
  Gene Ontology: Mol. function=nucleoside-triphosphatase activity; Cellular component=intracellular; Biological process=chlorophyll biosynthetic process
  Homolog annotation: Hit_ID=Q1GYB2; Match level="QueryCoverage=96%, HitCoverage=51%, E-value=1e-96, Identity=69%"; Hit description=Mg chelatase-related protein
  Pfam annotation: Domain name=AAA_5; Domain location=91-247; Score= -3.6; E_value=0.0053; Accession=PF07728.5; Description=ATPase family associated with various
  Pfam annotation: Domain name=Mg_chelatase; Domain location=68-264; Score=483.4; E_value=2.9e-142; Accession=PF01078.12; Description =Magnesium chelatase, subunit ChlI
  Pfam annotation: Domain name=Sigma54_activat; Domain location=72-219; Score=-174.6; E_value=0.0099; Accession=PF00158.17; Description=Sigma- 54 interaction domain
  Pfam module annotation: Pfam domain module=AAA_5::Mg_chelatase::Sigma5 4_activat; Domain location=91-247::68-264::72-219
MTYQLLQDKVSTRAAILPQESAYEASLVEGCTIFAAGSLLEVCAHLSDKQTLPAHPLVTPNKSVVLPDYQEVKGQLRAKRALEIAAAGQHSLLMSGPPGTGKSMLAQRFVSILPEMSTQEALESAAILSLTGQFPATQWKQRPFRAPHHTASAVALVGGGSVPRPGEISLAHHGVLFLDELPEFDRKVLEVLREPLESGHITISRAARQATFPAQFQLIAAMNPCPCGYYGHYNQRCRCTAEQILRYKNKLSGPLLDRIDMNID

SEQ ID NO: 137468 - protein, 57 aa, Glycine max
  Coding DNA Sequence Number=SeqID_45783
  Gene Ontology: Mol. function=RNA-directed DNA polymerase activity; Biological process=RNA-dependent DNA replication
  Homolog annotation: Hit_ID=A5AMK2; Match level="QueryCoverage=100%, HitCoverage=7%, E-value=1e-13, Identity=57%"; Hit description =Putative uncharacterized protein
MDEYYKEMQISLIRSQIEESQEATMARFLHGLNREIQYIVELHHHASLEGLIHQAIK

SEQ ID NO: 137469 - protein, 29 aa, Glycine max
  Coding DNA Sequence Number=SeqID_45784
MAKGSPPLDDKRAQNDHNLSLRATGDDCV

SEQ ID NO: 137470 - protein, 216 aa, Glycine max
  Coding DNA Sequence Number=SeqID_45785
DFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQAQGDVPQAAGAPPPPHQAGQAGAFDMEQYLRHLVRQQAANHRAHTSSGQRLHGPEIGPRPKQERRPQKAPGDEKRPTRTRDGRFA

SEQ ID NO: 137471 - protein, 61 aa, Glycine max
  Coding DNA Sequence Number=SeqID_45786
  Subcellular localization annotation: CTP_CleavageSite=16; ConfidenceScore=5.12e-01
MICFFPSSVFLKSPKRSALALAPAPAPAPAPAPAPAPAPAPAPAPAPAPAPAPALELNEAQ

SEQ ID NO: 137472 - protein, 56 aa, Glycine max
  Coding DNA Sequence Number=SeqID_45787
  Subcellular localization annotation: CTP_CleavageSite=33; ConfidenceScore=5.33e-01
MGVQIAPRPTWALQNIPPEGCCFRNVSVTFSVKNFAKVSTVLRGSSFVLHRSSIFN

SEQ ID NO: 137473 - protein, 352 aa, Glycine max
  Coding DNA Sequence Number=SeqID_45788
  Gene Ontology: Mol. function=ferredoxin-nitrite reductase activity; Cellular component=chloroplast; Biological process=electron transport
  Homolog annotation: Hit_ID=O04840; Match level="QueryCoverage=18%, HitCoverage=11%, E-value=6e-14, Identity=56%"; Hit description =Nitrite reductase
  Pfam annotation: Domain name=DnaJ; Domain location=198-249; Score =8.8; E_value=0.00058; Accession=PF00226.22; Description=DnaJ domain
MVVELGQQAVELSTLVTRAANDMSSNLEGTGCHLGGVLQKYGMSTPRTEAGLDTIALKGFVDGSFDLKLAYSVFCDLQVTSDINLFKLLHRWPGPERIRMFIWKISHESIFTNAKRMRIGISVNDECSTCQAEVEALASFPRILRYLRSEEVKRQVVVTRPVRTHWTTFPNTYGEVQVAHISFMGRMARDDNGKATDEIELTANDTTIKKQYRKFALQLHSNKNKFAGAKAAFKLIGEAQRVLLVSKLLVCRTIVKIMVLSMSNTESHKKKGPTVDVSVKLNGKRKRKQVAQSSESAESVSNTDSKEQKQNFYFEESLQNIDEEIKEVRKQQAVGSSKLDKPSEHSPPKSTR

SEQ ID NO: 137474 - protein, 90 aa, Glycine max
  Coding DNA Sequence Number=SeqID_45789
  Subcellular localization annotation: CTP_CleavageSite=25; ConfidenceScore=5.40e-01
MPRRFHNVSVGDFAKVFNRSSFVLRSSTALESGIFFMTGFLRFFRRFPQINVGGDSAHFPPLEDAPVSLASLARERVGCDSWRLHWGLFL

SEQ ID NO: 137475 - protein, 83 aa, Glycine max
  Coding DNA Sequence Number=SeqID_45790
MHHTQVFRKLRSPIPEEGLPEVVSGRTSSGIGLHHFRKKVFRKLRSPIPEEVLPEELLPQLAFTTSGRPSSGSGHSGPSSFCA

SEQ ID NO: 137476 - protein, 242 aa, Glycine max
  Coding DNA Sequence Number=SeqID_45791
  Homolog annotation: Hit_ID=UPI00006A2D9E; Match level="QueryCoverage =62%, HitCoverage=80%, E-value=6e-10, Identity=17%"; Hit description =UPI00006A2D9E related cluster
MIGSLNESISCFIIRVDPWVLVPIAFRGLHVLSFRGLHVLAFRGLHVLTFRGLHVLAIRGLDVLAFSGLHALAFRGLHALAIRGLHVLASRGLHVLTFRGLHTLTFRGLHVLAIRGLHVLAFRGLHAFAFRGLHVPLFRGLHTLAFRGANSFLLSVPGPPPDPGGGPPMQVQPEEEAIVQLLCIPGQDFTHAAAKKRVRIMHTNMTTITQIWMTLLLSNILPSDRNVDLPLWKYQLVCAVPT

SEQ ID NO: 137477 - protein, 143 aa, Glycine max
  Coding DNA Sequence Number=SeqID_45792
MAAQLIHDRVEMECLEGVWETLEGNPRCRFWGTIWFTATSLVHPEELARTLQHTVEWILPAPTPYRLVEPVQVIEVTSSEEDPEEDPEELPPEPAVDALDFPEGDEDPLPEVDSPEEVMLASEADSTEESGPGGIATSGGSSS

SEQ ID NO: 137478 - protein, 99 aa, Glycine max
  Coding DNA Sequence Number=SeqID_45793
MKNAEIHSQGAQGSLEQPPSAFYRKKGEEVAAQLTQATLARPASWVASPEATQLQKTFWKAQFKISKLLFAPPPILISSPPLFRNLRKSYGSLTEAYRT

SEQ ID NO: 137479 - protein, 65 aa, Glycine max
  Coding DNA Sequence Number=SeqID_45794
MTINSWGFGLDGGGRTNSARQSIRGTLYSMVEDARTALGNQFVGLQTRCARQSIRGAQDSMVEDA

SEQ ID NO: 137480 - protein, 296 aa, Glycine max
  Coding DNA Sequence Number=SeqID_45795
  Homolog annotation: Hit_ID=Q6WAY6; Match level="QueryCoverage=73%, HitCoverage=38%, E-value=9e-23, Identity=32%"; Hit description =Putative uncharacterized protein
MANQEDWVPFMDVLALLIFGVVLFPNVDGLVDLAAIDAFLAYRHSKESLVVAVLADLFDTFDRRCEKSSARIICCLPRSLCLSHRSCTEKRRIDWDQFLTGIGGRTINWFPRWKEGKEGVLFSCGGYPNIPLIGTRGCINYNPALAIRQLGYPMRGAPTEEIMSPFLVRDFGAQNFKAIQRIHKAWETPLRKDQELRGIRNGIIGGYHEWLKVHIRGLDWLAKLKVVSEESFEAPEEDEEVQALKSELGKAKLAKEKFKLAATNIRKECAGLREENATTARALEQETKRARKEEYG

SEQ ID NO: 137481 - protein, 77 aa, Glycine max
  Coding DNA Sequence Number=SeqID_45796
MADCLEGSHLGNHETQLQTRKWRTHEHLAITFMGLRKRGRMEDCLVGPHLGNYETQLKTRKWSTHERKTHSWGPEKG

SEQ ID NO: 137482 - protein, 54 aa, Glycine max
  Coding DNA Sequence Number=SeqID_45797
MGVQIAPRPTWALRNIPPEGAEALPKRFRNVFREESRKGFNRSSTFFIVLRSST

SEQ ID NO: 137483 - protein, 42 aa, Glycine max
  Coding DNA Sequence Number=SeqID_45798
MGIKEHSNQVTPKAYTLKSPLGPLPPDSGPTPKIIFSSRHCS

SEQ ID NO: 137484 - protein, 125 aa, Glycine max
  Coding DNA Sequence Number=SeqID_45799
  Homolog annotation: Hit_ID=A5C7C5; Match level="QueryCoverage=44%, HitCoverage=8%, E-value=7e-08, Identity=44%"; Hit description =Putative uncharacterized protein
MESSEDSENEEINLCLMAKSYESDEEVSLRKEWYVDSGCSKHMTRNASKFTHISPKKSGHVTYGVNNKVSQRALRRRARARLTDALSKGGKVRGVATNVYLWKTSGKPKETGQNENSKFGSCIYA

SEQ ID NO: 137485 - protein, 78 aa, Glycine max
  Coding DNA Sequence Number=SeqID_45800
  Subcellular localization annotation: CTP_CleavageSite=57; ConfidenceScore=5.09e-01
MHDGMHMTQMQSRNAGAGGIVSFLDTTSRGSKAPQHTFLRRRHGPSVGIILFEEHIVAVGTTSNNKFSKRKALDEGSL

SEQ ID NO: 137486 - protein, 72 aa, Glycine max
  Coding DNA Sequence Number=SeqID_45801
MKMLLIPHDVSSIGAYEWQRNEERKRERRRHFKEKMSLEEAHHHRRPWIRAWRKKEMNEGRGREEHEILCSK

SEQ ID NO: 137487 - protein, 89 aa, Glycine max
  Coding DNA Sequence Number=SeqID_45802
  Homolog annotation: Hit_ID=A5C9H3; Match level="QueryCoverage=58%, HitCoverage=6%, E-value=2e-14, Identity=63%"; Hit description =Putative uncharacterized protein
  Pfam annotation: Domain name=zf-CCHC; Domain location=27-44; Score =12.3; E_value=0.021; Accession=PF00098.14; Description=Zinc knuckle
MEQHKSASLPVAYAIQGKPQGRDMSIVQCFCCKGHGHFASHCPKKFCNYSKKEGHVIIESDHHREMQQPSLQLMPLLLLLFMGIRIRLL

SEQ ID NO: 137488 - protein, 119 aa, Glycine max
  Coding DNA Sequence Number=SeqID_45803
KLFLRPYQVRWDATVFGVVNPDFPLYIKHEDLSKIAHGGQCLSISVLQLWILNLTETVRAGILISMDVPSSSIQRLGQSQFDESYIKSWMQSSQSNVYLGAYLNGFHLQRTLADGGHPA

SEQ ID NO: 137489 - protein, 162 aa, Glycine max
  Coding DNA Sequence Number=SeqID_45804
  Subcellular localization annotation: CTP_CleavageSite=79; ConfidenceScore=5.06e-01
ILRKDLTTLAQVWSVLSYSNLASTSHTSNLTVDRVRLIFGLVSHLDMNIGARISGQMTSIAQSNTSRLGFPTLITALCRARGVVSDCLTFERLSPVINLAYIRKNCWNPEDLTVSIRRARRARTRPTELPSTFAAPTPAAPSVPAQIDSQHFEAMLQSIHQG

SEQ ID NO: 137490 - protein, 45 aa, Glycine max
  Coding DNA Sequence Number=SeqID_45805
MRKITEAGRKISVQEKKGIGKEDWCHPLKNSSQEARGQPPYELLD

SEQ ID NO: 137491 - protein, 91 aa, Glycine max
  Coding DNA Sequence Number=SeqID_45806
MPFCGRARRGSWERFPKEENARSRHQRLFVENVGKTEGNRSTKAGLLLLYTLHRRENQTYVVLFKGESSDSFYLEGDHFKALDLKNDPFTW

SEQ ID NO: 137492 - protein, 137 aa, Glycine max
  Coding DNA Sequence Number=SeqID_45807
MTQELVARGDTLRLSAPRHSVTPSVIHEQRPIWSSAPFPEMSAFSDGDFSSLTKDTSEQEPYGRPFCHPEAAGPMTSRDQGHSALLVSSRGGGPDDTRRYLTVIRTLLSSRGGGPDDKQRPSLVILHPCIIQRRRAR

SEQ ID NO: 137493 - protein, 91 aa, Glycine max
  Coding DNA Sequence Number=SeqID_45808
MSDAIYQFAGIAPLRHPVDSEKSNRALGFLSLITGATTGAGPSAEPDEMHCRHLYSSRHLWSPSLFTCRGWNSICNMWLTNRRPITRDMYS

SEQ ID NO: 137494 - protein, 152 aa, Glycine max
  Coding DNA Sequence Number=SeqID_45809
  Gene Ontology: Mol. function=transporter activity; Cellular component= outer membrane-bounded periplasmic space; Biological process=transport
  Homolog annotation: Hit_ID=A8GBU3; Match level="QueryCoverage=79%, HitCoverage=48%, E-value=8e-55, Identity=85%"; Hit description =Cationic amino acid ABC transporter, periplasmic binding protein precursor
  Pfam annotation: Domain name=SBP_bac_3; Domain location=1-130; Score=- 44.2; E_value=4.7e-05; Accession=PF00497.11; Description=Bacterial extracellular solute-binding proteins, family 3
MVRNNENDIKGIDDLNGKVVAVKSGTGSVDYAKAHIKTKDLRQFPNIDNAYMELGTNRADAVLHDTPNILYFIHTAGKGRFKAVGDSIEAQQYGIAFPKGSDDLREKVNGALKTLHDNGSFVLPAFYISTATDSGVTPWSLTGASSGPPYRS

SEQ ID NO: 137495 - protein, 324 aa, Glycine max
  Coding DNA Sequence Number=SeqID_45810
  Gene Ontology: Mol. function=nucleobase transmembrane transporter activity; Cellular component=membrane; Biological process=nucleobase, nucleoside, nucleotide and nucleic acid transport
  Homolog annotation: Hit_ID=A6T7Z8; Match level="QueryCoverage=86%, HitCoverage=61%, E-value=3e-98, Identity=65%"; Hit description =Putative allantoin permease
  Pfam annotation: Domain name=Transp_cyt_pur; Domain location=26-324; Score=-75.3; E_value=5.6e-06; Accession=PF02133.6; Description =Permease for cytosinepurines, uracil, thiamine, allantoin
MSAQIPAADYSGAEKQRLSETRSIDYIPLSERHGHPFSQFTLWFGGNLQITAIVTGALAVVLGGDVVWSIVGLLVGQIVGAAIMSLHAIQGPSLGLPQMITSRMQFGVFGAVIPLVLVCIMYVGFSASGTVLAGQALAKLVNVSNAAGMIIFSAIIIVIAVLGYRVIHKLGKVASVIGVLAFVYLFITLLSSHDLAAVWQNQHFSVASFLLAVSLSSSWQIAFCPYVSDYSRYLPVDVSAKKLFSSVFFGTVLGTQASMTLGVIVAAIAGKAFSGNEVGYIVGLGSSATMGTELEFVIMVIAVSCVKLLSAHNSTQHTSRKHKV

SEQ ID NO: 137496 - protein, 110 aa, Glycine max
  Coding DNA Sequence Number=SeqID_45811
MHTGSRKIHPCPCKKTSADHAHQHDHSYMDMDDVAMVSHSAAIPTMPSPPARIAPARHPVDPEKPNRVLGFPALITGLCQFYRVPVAPSKVIRPPTNRAFIKKYCAPRQA

SEQ ID NO: 137497 - protein, 125 aa, Glycine max
  Coding DNA Sequence Number=SeqID_45812
LQVVPFVVRLMNQVIAFPLKSTLRNFITWEINRGKDTTKEDFRVPARPHQQGPNIFQRTTKLEDTLAQFMQVTMSNHKSTESALKNLEIQVGQLAKKLMPAEDEDVVSLKEQVALKDTADKKKNE

SEQ ID NO: 137498 - protein, 17 aa, Glycine max
  Coding DNA Sequence Number=SeqID_45813
KANGLDHLIQQYEHDTK

SEQ ID NO: 137499 - protein, 139 aa, Glycine max
  Coding DNA Sequence Number=SeqID_45814
  Gene Ontology: Mol. function=transporter activity; Cellular component= membrane; Biological process=transport
  Homolog annotation: Hit_ID=A8GHA6; Match level="QueryCoverage=100%, HitCoverage=36%, E-value=2e-76, Identity=94%"; Hit description =Putative outer membrane protein precursor
MTGDGDKGSYKRNGFDGGTRFRFAADYYLFDDISWISYYELGVNIPALFDWDHHYADGARNTSRRMLYTGLKSNTWGQMTFGQQNSVYYDVVGAKTDIWDYDMLAQAPGNGINGDYDGSYRSRKMLKYKNRFGDADVYA

SEQ ID NO: 137500 - protein, 97 aa, Glycine max
  Coding DNA Sequence Number=SeqID_45815
LLNDYQPMHPEFPDEDIMALFEEKLDEDRDKWTVWFDGASNILGHEALEQYWSSPDNQAASYTNVTRGVVVRFIKKEIILADMVSKEDYHGQRHQPE

SEQ ID NO: 137501 - protein, 151 aa, Glycine max
  Coding DNA Sequence Number=SeqID_45816
TPTHGFTEPIQLNIFIDGLIPQSKQLLDASVGGKIKLKTPEEAMELIENMVNNLLAKQLESLTETLSKLPTQLQAAQPSHSVVMQVGGCSICGRAHEFDCCIPQDDSAKEVTSKEGTSIKIKGKDGDHIQGINSTKIKEDLPTDLRIKGLT

SEQ ID NO: 137502 - protein, 49 aa, Glycine max
  Coding DNA Sequence Number=SeqID_45817
MWTTTENWGRSLPPARPGEQGCFLQKQRLLEEGSGRPKWARLLFAPPFY

SEQ ID NO: 137503 - protein, 138 aa, Glycine max
  Coding DNA Sequence Number=SeqID_45818
IAPTKTPSGPGEVQQGLGFPTLVTGLCQSYRVPVPPARSRHHDIGKDRAHKGTQWTRRSIAGSWSCQALIMGLCQFYGVPVTSSKGIRPPTNRAFIKKYCVPRQAQGEIPQQPGDDRQRATDTPPSPLEFTSAHPQKG

SEQ ID NO: 137504 - protein, 51 aa, Glycine max
  Coding DNA Sequence Number=SeqID_45819
MEKVYKVLGRELMHSYPPRALDRRLQEDWARDARKGPRVLMSLKVDFGPMA

SEQ ID NO: 137505 - protein, 328 aa, Glycine max
  Coding DNA Sequence Number=SeqID_45820
  Homolog annotation: Hit_ID=Q6WAY6; Match level="QueryCoverage=57%, HitCoverage=33%, E-value=1e-14, Identity=30%"; Hit description =Putative uncharacterized protein
MGSDQAPSFKKRFYHVKVKNLELASLRELGQRMDQVRPQAFNGLVDLATIDAFLAYHHSKESPVIVVLANAYDTFDLRCKKSSTRIVCCTPTLYVWLVSHVFRHEGRPVCPLQGHSMCTKKGKANWEELLAGMVGSSINWFPRWKEGGAGVLCSCEGFPNIPLMGMRGCINYNLMLVIRQLGYPMRGVPSEKILQRIRRAWNTVERKDKELRGSSNGAIGGYHKWLKSRTQGITWLPKLKGLSGKEAEVLEESEEVQALKVELEKMRVVKEALNMVVTRVWKKCDVLRDVNMTMVEALERKNQKGSKGRMEQEQALRGFMGQQQRAQA

SEQ ID NO: 137506 - protein, 82 aa, Glycine max
  Coding DNA Sequence Number=SeqID_45821
MASRKRKAPEFYANLYDPEDKSPKQVRVRGHLIKFDVDALNPFLKTLVVIEERESLLAYSRFANMRPVPQEPVYVSLGEDLS

SEQ ID NO: 137507 - protein, 99 aa, Glycine max
  Coding DNA Sequence Number=SeqID_45822
MPISPCGWIMPARHLVDSEKSNRVLGFPALITSPCQFYGVPVTPSKVIKPPINRTFIKKYYTPKQAQGETPQRPRDGRQRATNTLPPPLEFTSAHPQKG

SEQ ID NO: 137508 - protein, 73 aa, Glycine max
  Coding DNA Sequence Number=SeqID_45823
GQDHLGLPSGVETKHEQQKPIKVLKDRCKWGWGHDRPIVAPSLRETSRECRCKAAPYPLYLAAFFYYLFVFKK

SEQ ID NO: 137509 - protein, 109 aa, Glycine max
  Coding DNA Sequence Number=SeqID_45824
  Gene Ontology: Biological process=transposition, DNA-mediated
  Homolog annotation: Hit_ID=Q1J7G7; Match level="QueryCoverage=37%, HitCoverage=71%, E-value=2e-11, Identity=70%"; Hit description =Transposase
MVKVGTSTSDQRLIFAKSWPRASRYQQGHQDLFILRSDLPSQWLLFLSAVPPVQLLTGWCVTAKAPPDISAGKCSGRVPFANQAVQLLGRAIGAGLIKLIDTVDLEGGP

SEQ ID NO: 137510 - protein, 33 aa, Glycine max
  Coding DNA Sequence Number=SeqID_45825
MRKNEDMMVVITETVEPGEKERESNYGDDVVDV

SEQ ID NO: 137511 - protein, 239 aa, Glycine max
  Coding DNA Sequence Number=SeqID_45826
  Gene Ontology: Mol. function=helicase activity; Cellular component =chromatin; Biological process=viral genome replication
  Homolog annotation: Hit_ID=Q2A9I1; Match level="QueryCoverage=97%, HitCoverage=16%, E-value=2e-53, Identity=45%"; Hit description =Putative uncharacterized protein
MMFTVCKGPTSIEDLRTVGNVQYPTYREACFAMGFLQDDKEFIEAIKEAKDWGSTHYIRKLFVLLLLTATMNKPEQAWDQTWHWMAHDIVYNYKKSSTSSALQLDDRTLQNLVLLEIEQLLQANQRSLTNYPSMPYPEDVNCSTYLDNNLILVELNYDNQELRSEFEHLFSHMTEEQASIYNQIVEVVNKDEGGMFFLYGYGGTGKTYIWKTLASSLRANNKIVIMVASSDIASLLLPG

SEQ ID NO: 137512 - protein, 58 aa, Glycine max
  Coding DNA Sequence Number=SeqID_45827
  Subcellular localization annotation: CTP_CleavageSite=21; ConfidenceScore=5.40e-01
MTFPSPTTSHHQTTLPFSMTSTSTLSKSFSQRDCRHDFQFINWLKQGQTYSRLLALNP

SEQ ID NO: 137513 - protein, 342 aa, Glycine max
  Coding DNA Sequence Number=SeqID_45828
  Gene Ontology: Mol. function=catalytic activity; Cellular component =intracellular; Biological process=regulation of transcription
  Homolog annotation: Hit_ID=A7QKZ8; Match level="QueryCoverage=96%, HitCoverage=52%, E-value=1e-85, Identity=47%"; Hit description =Chromosome chr8 scaffold_115, whole genome shotgun sequence
  Pfam annotation: Domain name=Macro; Domain location=2-116; Score= -21.6; E_value=0.046; Accession=PF01661.12; Description=Macro domain
  Subcellular localization annotation: CTP_CleavageSite=44; ConfidenceScore=5.02e-01
MQLQKQLNPGGGGVNAAIFSAAGPELESATKEKVQSLSPGNAAVAPLPSSSPLFTRECVTHVIHVVGPNMNPQRPNCLNNDYNKGCKILQDAYTSLFEGFASIVTNLTWQPVGKTENLERKSLMLQVQSNCSRNYFKKIDQKSKRDVDHGSAKSKKYKGTQDGSGLTFTDSRDENVDSEHRRTERSMSKAWGSWGQAPHQIVMHPEKHKDDLLEISDDAVVLNDMYPKAQKHVLVLARTVGLDCLADVQKEHLQLLNKMHDVGLKWAEKFLNENAALNIYSRTIFPLRLSLTLKRKRICRSGPPNIPRLKSHISSCQSPFPAHLLQNGRLVRAPGEPRNNFQ

SEQ ID NO: 137514 - protein, 106 aa, Glycine max
  Coding DNA Sequence Number=SeqID_45829
MSSKQKPKYIYFVVPSYSVFFYSDLQDPPMLFASGMTYQFKAVFHVDRNIIEVPSVYHKQWAPDYPDYVVLDYNGKKHHIRVRKFSNRVYIVDGLKHFSRDMGIYE

SEQ ID NO: 137515 - protein, 15 aa, Glycine max
  Coding DNA Sequence Number=SeqID_45830
VNAVKIFPDAQNGLG

SEQ ID NO: 137516 - protein, 158 aa, Glycine max
  Coding DNA Sequence Number=SeqID_45831
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=72%, E-value=3e-24, Identity=69%"; Hit description=LacZ protein
  Subcellular localization annotation: CTP_CleavageSite=29; ConfidenceScore=5.11e-01
MAHYVNHHPNQPANVARKEGKKAKGAGARALASVSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137517 - protein, 86 aa, Glycine max
  Coding DNA Sequence Number=SeqID_45832
MCARARVMSEIEEVQEHMKADMEAMKEQMTTIMEVMMSMRKMMEVNTATVIAASTATEVREAKHWEVWAAPISCKSRASISSHHVA

SEQ ID NO: 137518 - protein, 171 aa, Glycine max
  Coding DNA Sequence Number=SeqID_45833
MGPKSTLRLIRTLGPSLASLAQSTWSFSIQCPCGVGLHQHVLALRGLLALAFGLHALTFRGPHVLTFRGLHALAIRGLRVLTFVGLHALTFRGLHVLANRGLHAFTFSGLHVLANRGLHALTLRGLHALTSRGLYILALRGLHALTFRGLRVLFFSVLHIRTLREFKVLYP

SEQ ID NO: 137519 - protein, 232 aa, Glycine max
  Coding DNA Sequence Number=SeqID_45834
VYAEKEARGRVIDSLHQEATMWMDRFALTLNGSHKLPRLLAKAKAMADVYSAPEEIHGLLSYCQHMIDLMEHMKVDMSAFKEQMTSMMEAMLGMKQLMESNAATATATSTAAEADPALPTAAHHPVPNMVGRERSTSGHISNPHPGYNRGAYPYSLPPNYTPPAMHEDMDHVSPLILKGEPPRHPNTVHENPREHAQGDVDSYSPFPAEGPAPNALPQPNIRGEPRNHLTQP

SEQ ID NO: 137520 - protein, 153 aa, Glycine max
  Coding DNA Sequence Number=SeqID_45835
MYPPLFSLNLVDVSSTRTDPQEMYPLLFSVKPKEWEESKEFSDCVVLNSLTREKGDTKEFRRLVLCSFGKGRRETQKEFRRLVLGEFFLAKGEENEKMNSTSFQGLENQKTSESFWYKEEEEVQRDSRLVKDCNEMIGKVFKILEMQNKALLL

SEQ ID NO: 137521 - protein, 75 aa, Glycine max
  Coding DNA Sequence Number=SeqID_45836
  Pfam annotation: Domain name=G-patch; Domain location=1-42; Score =26.0; E_value=0.00014; Accession=PF01585.14; Description=G-patch domain
MVARVMLKHGYEPGMGLGKDGLGNADVVDIRGNPYKYGLGAGIMSEEEVAAVGEEFPQDPPNFVQPCHPDSQVGN

SEQ ID NO: 137522 - protein, 49 aa, Glycine max
  Coding DNA Sequence Number=SeqID_45837
DDKGDDKKLKGQSKNEFKMFKIQESRFKDQASRIKIKIQDSRFKNQEKT

SEQ ID NO: 137523 - protein, 68 aa, Glycine max
  Coding DNA Sequence Number=SeqID_45838
MTLFCTRLPIESKIKRQGSKRSKVMSQWGLLSWEPNLDIWGETNSGVKVSVSGRTPLSLPKARVTMMI

SEQ ID NO: 137524 - protein, 270 aa, Glycine max
  Coding DNA Sequence Number=SeqID_45839
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLASSSGGRVLDQEPIHVLTVAPPSGRNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137525 - protein, 102 aa, Glycine max
  Coding DNA Sequence Number=SeqID_45840
MVKVGTSYVPINVSFSPKVGPGLPAGAKGGCVHTGDYYVGTDNAGCPSQKCVVAEKKAAPVLSRICNTTHYRANWSSIRGWRPLRTWTPTSVRNSMREKEMS

SEQ ID NO: 137526 - protein, 51 aa, Glycine max
  Coding DNA Sequence Number=SeqID_45841
MKIHKKLVGLGSSSSMDSFASWKMNGSGMEKEEREETPLQGEDESRRSSPP

SEQ ID NO: 137527 - protein, 259 aa, Glycine max
  Coding DNA Sequence Number=SeqID_45842
  Gene Ontology: Mol. function=phosphoprotein phosphatase activity
  Homolog annotation: Hit_ID=A5APQ3; Match level="QueryCoverage=35%, HitCoverage=5%, E-value=2e-12, Identity=36%"; Hit description =Putative uncharacterized protein
MEWHQPDRVMRQFGMQQPIPGPVMQPNNIHDLTLKGKEGKNWMRLMQPALNEWNSRYERRVEQTPPQIGTLGLNSEYMRWYRRKTKVYVDPKHARRGLLGEIAETLHFMVSPVGRRVSTFDDLLPCIEKITLLSEEEDRILEAHEDAPPSQPQFEHQQFNILRQSVETRGLARRRETVDAATYSLPPMPERQHGMYYTPPTFTQEPSQMPPMYSYPHDFQPGYSFAGIFGSSHSSTETPSFTQSGQVSTPNASLAGPWN

SEQ ID NO: 137528 - protein, 142 aa, Glycine max
  Coding DNA Sequence Number=SeqID_45843
VKQPEQDQQHQPAADAPLPPPHQPPCLESISTHLQRVEHHMHTYMRHLADQQATNHRGQMQLNDNFYHYTLHQHHQDPNPYPWPILEQFRATIARPGVTTCPSRASEGEAHGCAFQRRKDARSRHQRLFVENVGKTEGNRSK

SEQ ID NO: 137529 - protein, 370 aa, Glycine max
  Coding DNA Sequence Number=SeqID_45844
  Homolog annotation: Hit_ID=A4QGS2; Match level="QueryCoverage=60%, HitCoverage=58%, E-value=2e-10, Identity=24%"; Hit description =Putative uncharacterized protein
MAGAALPLPARIIRTTFITDKCAFWSFRHVNLLLLIHAAGENTEYPHQVSVADGDFRLFIDFWFRMIGNAETCRLDHRQIVGAIANRHGLRRRNFIFFRQFTQSIGFIFGVDDVADHVAGELAVHNFQLVGEYRVEMQLIAQIFGKEGKAAGGDGHLPAQRFQLQHQLGQPRHQRQRFPHLQQNVRVGVFQGGDALAQAGGEVELAAHRAFGHFRDQLAGAGKLSNFIDTFDLNRRGVHIHHQQARRAQMRDFAQRRDVQPGLVGQARGALRQRTRQANHLIVFHDPGRDNDQRRAELALPRRQPTFIETATIQQPAAAPGVIIQRHDLVAAQGKRQPRPQGNIFGQVAPGQTVRHYGSTSLHSGEENNA

SEQ ID NO: 137530 - protein, 50 aa, Glycine max
  Coding DNA Sequence Number=SeqID_45845
IEVGLKRGKFDYAALMNSGDMRPGENGGNKKEGETHVVAAILAWPNFPLA

SEQ ID NO: 137531 - protein, 70 aa, Glycine max
  Coding DNA Sequence Number=SeqID_45846
MLFWLKIYSIIGAYFIPIFVPKFQLKITVKTSAKARGNWKGGLVASLEEFESRSKGPTTLRAIGLRNTPN

SEQ ID NO: 137532 - protein, 86 aa, Glycine max
  Coding DNA Sequence Number=SeqID_45847
MTRGNPGDIQPFYPEIDRTFHRLVRHSVHPGHSVHFEHFEHSEYYVAGDFEYFDFEHSTTNFHTENMAQPPPRERTLREMAAPDFT

SEQ ID NO: 137533 - protein, 234 aa, Glycine max
  Coding DNA Sequence Number=SeqID_45848
MPTPSEEHTSSPSEGYTPSPSEDYMSSASENYTSSLSEEYTYLPSEDYTSSPSEDVHVIAFRGLHALAFRTLHALALRATRPLLQRTTVLLQRATTRPPFRGLHALAFRGLHVLLHVLAFRGLHVLAFRGLHGLAFRGLHGLPHRTRRPHLHRTTRPRHQRSTRPRLQRTTRSHLQRARHPRLQSTSLPSADYTSLPSEDYTSSPSEGCIASPLEDYMSSCMSSPSEGYTALPK

SEQ ID NO: 137534 - protein, 172 aa, Glycine max
  Coding DNA Sequence Number=SeqID_45849
MTFIQRGYNKMKPCKVSYQNIKQKMKFGNQELPVLTNEFHYPGREAVNNKFNCLIDNIWNIPKHTNNNEQFVCSVKKGIICALYNFCIVDNQGVPLLTKASPFGKGYTAFVLLSRPHKGVYTNFKDLCLEKEGIQSPIYKGFYSREEAEKALELNTTDINKIKRPLSQKTRL

SEQ ID NO: 137535 - protein, 230 aa, Glycine max
  Coding DNA Sequence Number=SeqID_45850
MWMTLLLSNVLPSDYNSDLPLPKCQLVYVILTRMSVHVAQLIVYAIYLFEGMPPTRHPLDLDKSNRALGFPTLITDLCQSFGVSVTPSKVIRPPITWAFIEKYCTPRQAQGDALQAADAPPPPHQADPVGSLGMERYLQHLVRQQAANHRGQVQIHECLYQLSLSQQGQGFAPFACPTPDQFKAEVAWPGDWPEAQAGEAPAGAPGDAEEARMDEEMTDLLGFLGGSGAT

SEQ ID NO: 137536 - protein, 470 aa, Glycine max
  Coding DNA Sequence Number=SeqID_45851
  Gene Ontology: Mol. function=glycine dehydrogenase (decarboxylating) activity; Cellular component=mitochondrion; Biological process =glycine decarboxylation via glycine cleavage system
  Homolog annotation: Hit_ID=Q6D974; Match level="QueryCoverage=99%, HitCoverage=49%, E-value=0.0, Identity=84%"; Hit description=Glycine dehydrogenase [decarboxylating]
  Pfam annotation: Domain name=Beta_elim_lyase; Domain location=45-270; Score=-119.0; E_value=0.013; Accession=PF01212.12; Description=Beta -eliminating lyase
  Pfam annotation: Domain name=GDC-P; Domain location=2-388; Score= -299.5; E_value=0.00035; Accession=PF02347.7; Description=Glycine cleavage system P-protein
  Pfam module annotation: Pfam domain module=Beta_elim_lyase::GDC-P; Domain location=45-270::2-388
MMRYMHSLEKKDLALNQAMIPLGSCTMKLNAAAEMIPITWPEFAELHPFCPAEQASGYLQMIGQLSQWLVQLTGYDALCMQPNSGAQGEYAGLLAIRRYHESRNEAGRTICLIPSSAHGTNPASAQMAGMAVVVVACDKQGNIDLGDLREKAAQAGDALSCIMVTYPSTHGVYEETIREVCQIVHQYGGQVYLDGANMNAQVGITTPGYIGADVSHLNLHKTFCIPHGGGGPGMGPIGVKAHLAPFVPGHSVVQIDGVLTQQGAVSAAPFGSASILPISWMYIRMMGAEGLKQASSVAILNANYIASRLQSAYPILYAGRDGRVAHECILDIRPLKEQTGISELDIAKRLIDYGFHAPTMSFPVAGTLMVEPTESESKIELDRFIDAMLAIRMEIDRVADGEWPADDNPLVNAPHTQMEIVGDWTHPYSRELAVFPAGSANKYWPTVKRLDDVFGDRNVFCSCVPMSEYQ

SEQ ID NO: 137537 - protein, 93 aa, Glycine max
  Coding DNA Sequence Number=SeqID_45852
GFPGINRDTRILFFFAKVIFRHRVLPVASVFYQLFPPVQLLAGGRVPFAIQAAQLLGRAIGAGLFAITPAGERGMCCKAIKLGNARVFPVTTL

SEQ ID NO: 137538 - protein, 139 aa, Glycine max
  Coding DNA Sequence Number=SeqID_45853
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=43%, HitCoverage=48%, E-value=1e-22, Identity=71%"; Hit description=LacZ -alpha
  Subcellular localization annotation: CTP_CleavageSite=33; ConfidenceScore=5.03e-01
MKHFTDTFISANITRSNSCSPGDPLVLERPPPRWSSNSPYSESYYNSLAVVLQRPDWENPGVTQLNRLASHPPFASWRNNEQARTDRPSQQLRTLNGEWEAPCIGALSAAGVVVTRTVTATLASADVRRCFCRYAPPRP

SEQ ID NO: 137539 - protein, 157 aa, Glycine max
  Coding DNA Sequence Number=SeqID_45854
MVLKEELIACSRSKRSLSQRLCETETNMLAIIAKYQEELGLATAHEHRIADEYAQVYAEKEARGRVIDSLHQEATMWMDRFALTLNGSQELPRLLAKAKAMADTYSAPEEIHGLLGYWKNTITKRATRHPYRTRSKSRTMGDQEETQGTDESRHVGL

SEQ ID NO: 137540 - protein, 129 aa, Glycine max
  Coding DNA Sequence Number=SeqID_45855
MSASDHAILRDRTHQPTKKSLLELTSHDALLAQNKLLSKKLEILTETLGCTMCGAAHETGQCIPTEENTQEIHFIGNQQRQGYTQGGFSGFQQGPYNQQGQWRTHLGNQFNKDQGGSSNRPIQQGPNIF

SEQ ID NO: 137541 - protein, 209 aa, Glycine max
  Coding DNA Sequence Number=SeqID_45856
MSALKEQMASMMEAMLGMKQLMEKNAATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPTPGTLPQPNLAASPIVLSMEGPPPATEERRKLDLLEERLRAVEGFGDYPFADMTDLCLVPDVLFPRSQSAGLRQV

SEQ ID NO: 137542 - protein, 271 aa, Glycine max
  Coding DNA Sequence Number=SeqID_45857
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRWHGFARKNFICLQAAFEHPLRFLLDGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137543 - protein, 184 aa, Glycine max
  Coding DNA Sequence Number=SeqID_45858
MTCGDKIWSFRTPLPFRHSRARWHAETKFGHSAPFVIQRRRARYDTGDKIWSFRTPLPFRHSRVRWYAETKFDTVVSDGTQRQNLVILHPLSSRGGGPDDTRRQNLVILHPFAIQTQSCPMARRDKIWSFCTLCHPEAAGPMTRGDKIWSFRTPLPFRHSRVRWYAETTFGHSVPFVIQRRWAR

SEQ ID NO: 137544 - protein, 140 aa, Glycine max
  Coding DNA Sequence Number=SeqID_45859
  Subcellular localization annotation: CTP_CleavageSite=40; ConfidenceScore=5.10e-01
MMSMKKIMEANAVAVAATSIVAKVNPMPPSGLNQMNHPTSAMGRQRFGKYERAPIMCKFQIKHTFPPIWACLPTIHHPMGHTLPSEDVNNSAPILIESRQPQIDHAHVSQPMGETYEIPHHNLADFEPCLRYATEGKAVG

SEQ ID NO: 137545 - protein, 100 aa, Glycine max
  Coding DNA Sequence Number=SeqID_45860
  Subcellular localization annotation: CTP_CleavageSite=46; ConfidenceScore=5.25e-01
GTSYVPINVSFSPKSWAQGFPVSTGTPGFILFCESDLPVTAVPPVPATDGGGRVPFAIQAAQLLGRAIGAGLFAITPAGERGMCCKAIKLGNARVFPVTT

SEQ ID NO: 137546 - protein, 122 aa, Glycine max
  Coding DNA Sequence Number=SeqID_45861
MMKTRMIKMTQHKKMIIFPKNGKLQEIILLTTSSVISQKGRRYMWNNLLGLKTHKNQIMSVATYPSAGGRRVTRGMRVPRKEYARSRHQRLFEENVGKTGKDAIYELLSERFGSCFYARGRY

SEQ ID NO: 137547 - protein, 134 aa, Glycine max
  Coding DNA Sequence Number=SeqID_45862
MVMGDSISRLSFPACLHFSGENTETFSSLTSYPELRRSEFLIGGYVGARASLLSTTPPFVAITQEPVIRGDTLRLSAPPLPFRHSRVRWQAETKFGHSAHMIRGDTLRLSAPLCHSDTVVFDGKQRPSLVILHT

SEQ ID NO: 137548 - protein, 62 aa, Glycine max
  Coding DNA Sequence Number=SeqID_45863
MEKSEKKNINEKKLKKAYITWDENDMESSEDSENEEINLCFMAKSYESDEEENKDMSLIRLD

SEQ ID NO: 137549 - protein, 92 aa, Glycine max
  Coding DNA Sequence Number=SeqID_45864
MQEQYVHYDAMKRCLCDAWHECIYGHKSPENHLFLLAHSGAQCPMCALKKVIWTFRLPVTKDETNIQRMCDDMMQTRKSTTRGCTQNGNIHK

SEQ ID NO: 137550 - protein, 105 aa, Glycine max
  Coding DNA Sequence Number=SeqID_45865
  Subcellular localization annotation: CTP_CleavageSite=44; ConfidenceScore=5.49e-01
MATQLNQAQSQNSDNLPSQTVQNRKNVSAITLRSGNQIQVPPPVAAPAPEPVKLHSTPEKEDEIVAQKRKLPNCRNLPFGGRATRDSREACSTKGIRAESPPTFI

SEQ ID NO: 137551 - protein, 66 aa, Glycine max; identical to SEQ ID NO: 98722
  Coding DNA Sequence Number=SeqID_45866

SEQ ID NO: 137552 - protein, 85 aa, Glycine max
  Coding DNA Sequence Number=SeqID_45867
MEEFNAQVAWPGAQSSPSGGGIHMAQEEDASTDQIPEPSPVPIPDDATPSAPAPELEQPISQDSPVAQVLDLNEHAQEQPQEQDI

SEQ ID NO: 137553 - protein, 75 aa, Glycine max
  Coding DNA Sequence Number=SeqID_45868
  Gene Ontology: Biological process=auxin mediated signaling pathway
  Homolog annotation: Hit_ID=P33081; Match level="QueryCoverage=70%, HitCoverage=64%, E-value=2e-16, Identity=79%"; Hit description=Auxin- induced protein 15A
  Pfam annotation: Domain name=Auxin_inducible; Domain location=1-60; Score=14.2; E_value=1.2e-06; Accession=PF02519.5; Description=Auxin responsive protein
MGFRLPGIRKTPKAVDSPKGYLVVYVREKIKQVVIPVSYLNQSSFQDLLSQAKSLDMIITRVASQFLAVMMSSNI

SEQ ID NO: 137554 - protein, 129 aa, Glycine max
  Coding DNA Sequence Number=SeqID_45869
  Homolog annotation: Hit_ID=Q2HW90; Match level="QueryCoverage=69%, HitCoverage=18%, E-value=5e-10, Identity=35%"; Hit description =Putative uncharacterized protein
FYQVKIKGLDITNIKELGQLMGPLQMQAFRKAYGKILDLTIAEISTEAIVSLTQYYDQPLRCFTFGDFQLVPTVDEFEEILGCPLGGRKPSFSGKLEIGIGVKAYHWEALRRQGKGYGSRGVGPIVWTY

SEQ ID NO: 137555 - protein, 265 aa, Glycine max
  Coding DNA Sequence Number=SeqID_45870
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPAPSHARVQKELVNGQWAAERTVEGLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137556 - protein, 83 aa, Glycine max
  Coding DNA Sequence Number=SeqID_45871
MKTRIKIHETKCGPPRQNRGGACHPARPGEQGCFLQKQPPYGGRNWKAQLSKKLRKLTDCAKTPLFNFRHITEFHGSRKPASF

SEQ ID NO: 137557 - protein, 73 aa, Glycine max
  Coding DNA Sequence Number=SeqID_45872
MLLSSNISEICVKVVMLVRMIRTHLFAVARVKSCPGMHSSYVIASLSSCARTVGRPSISGGGPGTNKRELLAT

SEQ ID NO: 137558 - protein, 143 aa, Glycine max
  Coding DNA Sequence Number=SeqID_45873
MMVARVIFGQEQRRKDQLERKNKGQGPWLGQRAKEAPSCHISRSFVSAGLRREGQIAAICDDDSPRRSDLVQPFPPGFQLGNWRVEERPDVYATSIRSNDESREDTNIGDPTIDFEQEASRMEDEEDEDVGLPPELERIIAQE

SEQ ID NO: 137559 - protein, 114 aa, Glycine max
  Coding DNA Sequence Number=SeqID_45874
MAEDHPQRMTLEDYSSFATPQYLTSIARLDVQAANISYPHSLIQLIQGNIFHAKRWLHSFKGNSLWTWEEMVEKFLKKYFPKSKTAEGKVEISFNHVEENTNNNSIMLNKSVHK

SEQ ID NO: 137560 - protein, 106 aa, Glycine max
  Coding DNA Sequence Number=SeqID_45875
  Subcellular localization annotation: CTP_CleavageSite=33; ConfidenceScore=5.37e-01
MIVQYFDQEYKRIPKKGAKGSPKVASSSPGPPNSFMVKKPACLGELTASGLSFSSPGFEGSEVERIERREKEEEERRGNEAKALPNHNCDQSLCCFLFGALRATVG

SEQ ID NO: 137561 - protein, 89 aa, Glycine max
  Coding DNA Sequence Number=SeqID_45876
  Homolog annotation: Hit_ID=A5C037; Match level="QueryCoverage=92%, HitCoverage=15%, E-value=3e-09, Identity=42%"; Hit description =Putative uncharacterized protein
  Subcellular localization annotation: CTP_CleavageSite=3; ConfidenceScore=5.17e-01
MAEAQSISSPMTANCKLTKAGSDLFNNPSLYRSVVGALQYTTITRSELGNKTPEIYCDNQSAVAITHFPVLHFWTKHMEIDIFLSGRKS

SEQ ID NO: 137562 - protein, 186 aa, Glycine max
  Coding DNA Sequence Number=SeqID_45877
MYEYPRRTRSLTCKHSFQNSYGCSCFVGKREMTPKKLSTKRSKRDATVEGSSATPEFDSHRFPSAEHQQRFEAIKGWSFHREKRVQLREDEYTDFQEEIARRRWTLLVTPMAKFDPEIVLEFYANAWPTEEGVRDMHSWVRGQWIPFDADALSQFLGDPLVLEEGQQCEFSQRRNRVDGFDEEVIA

SEQ ID NO: 137563 - protein, 182 aa, Glycine max
  Coding DNA Sequence Number=SeqID_45878
MTPTKHPLDPDKSNRALGFPALITGLCQSFGVPVTPSKVIRPPITRAFIEKYCTQRQVQGDAPQAADAPPPHQAGPAGLFDTEQYLRYLVRQQAANHWAHVQTHDCLYQMSLSLQSQGFTSFSCPTPDQFRAEVAWLGDWPEAQAGEAPVGAPAEAPDEADEAREDEEMTDLLDFLGGSGAT

SEQ ID NO: 137564 - protein, 155 aa, Glycine max
  Coding DNA Sequence Number=SeqID_45879
  Homolog annotation: Hit_ID=Q6WAY4; Match level="QueryCoverage=87%, HitCoverage=24%, E-value=4e-13, Identity=31%"; Hit description =Putative uncharacterized protein
MGTNQSGKRFYQVKIKGLDITSIKELGRLMGPLRMQAFRKAYGKILDLTIAEISTEAIVSLAQYYDQPLRCFAFGDFQLVPTVEEFEEILGCPLRGRKPYLFSGFFPSLSKVTVVVRDSARGLDRVKQTRNDIVGLPRKYLEDKARDMANQEEWV

SEQ ID NO: 137565 - protein, 87 aa, Glycine max
  Coding DNA Sequence Number=SeqID_45880
  Gene Ontology: Mol. function=aspartic-type endopeptidase activity; Biological process=DNA integration
  Homolog annotation: Hit_ID=A5B2I2; Match level="QueryCoverage=63%, HitCoverage=10%, E-value=2e-14, Identity=58%"; Hit description =Putative uncharacterized protein
MVVFNKLRRFLKPPQNNFHYLTFFFCSEECPKYAAWHVKKDTWWVDSGATTHISMTMQGCLWSQPPSDDERFIFVGDCKKMEFDFYF

SEQ ID NO: 137566 - protein, 133 aa, Glycine max
  Coding DNA Sequence Number=SeqID_45881
  Homolog annotation: Hit_ID=Q6UUU1; Match level="QueryCoverage=45%, HitCoverage=40%, E-value=9e-19, Identity=78%"; Hit description =Putative uncharacterized protein
MATIFPCKSSVVSCGQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137567 - protein, 119 aa, Glycine max
  Coding DNA Sequence Number=SeqID_45882
MERIAKVVKISAQELDRVKQNRNGVIRIPRKHLEEKAKALADQGEWASFINVLALLVFRVVLFPNVDGLVDLAAIDTFLAYHHSKESPIVAVLADAYDTFDRRCEKSGARIVCCTPALY

SEQ ID NO: 137568 - protein, 38 aa, Glycine max
  Coding DNA Sequence Number=SeqID_45883
MGHLRVPMNPKRIKVIPEWPAPPSVLREGAQSIKNLRI

SEQ ID NO: 137569 - protein, 276 aa, Glycine max
  Coding DNA Sequence Number=SeqID_45884
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDHLHPLYAILSPTGFVHSPVNNSVTSLWALEAGSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137570 - protein, 29 aa, Glycine max
  Coding DNA Sequence Number=SeqID_45885
CQDVEDCDMMEQKETHLEGKKQVTCHKNL

SEQ ID NO: 137571 - protein, 159 aa, Glycine max
  Coding DNA Sequence Number=SeqID_45886
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=3e-25, Identity=55%"; Hit description =Putative uncharacterized protein
  Subcellular localization annotation: CTP_CleavageSite=53; ConfidenceScore=5.53e-01
MTMITPSSKLTLTKGNKSCNIFLKGQQSRPIRGHSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137572 - protein, 117 aa, Glycine max
  Coding DNA Sequence Number=SeqID_45887
MLYLGCDPIPKAVENEDDLDDVPVAGHEEDVGAGEHVSAGEQRDAGEQRDASEQRDADAGEPRDGGEQRRGILMLVSKEMVVSRGMLMLVSREMPVVKREMLLIVRRKRKLTVMSGL

SEQ ID NO: 137573 - protein, 215 aa, Glycine max
  Coding DNA Sequence Number=SeqID_45888
MARKDKIWSFCTLLSSRGGGPDDTQGQNLVIPHPFAIQTQPCPMARRDKIWSFCILLSSRGGGPDDTRRQNLVIPHPFAIQTQRCPMARRDKIWSFCILLSSRGGGPDDTQRQNLVIPHPFAIQTQSCPMARRDKIWSFCTLLSSRGSGPDDTRRHLMVIRTLLSSRGGGPDDKQRPMWSFCTLSSIVADKPVDTRRFTSSSTLTRSVILTFESC

SEQ ID NO: 137574 - protein, 156 aa, Glycine max
  Coding DNA Sequence Number=SeqID_45889
  Homolog annotation: Hit_ID=A5AY67; Match level="QueryCoverage=60%, HitCoverage=10%, E-value=2e-15, Identity=40%"; Hit description =Putative uncharacterized protein
  Pfam annotation: Domain name=zf-CCHC; Domain location=52-69; Score =8.9; E_value=0.07; Accession=PF00098.14; Description=Zinc knuckle
MDSLITRLLRVPHLLKDENPTDGVEMSSMVASRGRGSGRNSRGDRSGRGGRPHCTYCKRIGHTQETCYSLHGFPDKVAQVSKLEKAETRFSDEEYQEYLKLKSEKPSNQAQPSSVPCFSAACISQSIKGHSPWILDSGASDHISGTCDRATDWRRT

SEQ ID NO: 137575 - protein, 109 aa, Glycine max
  Coding DNA Sequence Number=SeqID_45890
MAPYEALYARRCRTPLCWFKTRETFDAILPRKGPVTRAMSKRLQKDWARATEEGPRVLMNLRWRLQSSFSFSIPLPLIFKKQRTPLMKKIPGLQAPQGATSCGIKSIFI

SEQ ID NO: 137576 - protein, 183 aa, Glycine max
  Coding DNA Sequence Number=SeqID_45891
  Pfam annotation: Domain name=zf-CCHC; Domain location=80-97; Score =14.0; E_value=0.012; Accession=PF00098.14; Description=Zinc knuckle
MTLATLFGKLQEHEIELMRLNQHEENDKKKKGTALQASSSIQEESDKEDLNEIEEDEKQRKLKEIKLQSKKKGEDSSLVLKCNECDQPGHLRFNCLVFKRRMEKSDKKNFKDKKENKAYITWEDNDMDSSSDSENEIINLGLMTKDYESEEEVMSSNYDLSISFDELQVHSVSCIKNLSNLPN

SEQ ID NO: 137577 - protein, 199 aa, Glycine max
  Coding DNA Sequence Number=SeqID_45892
  Gene Ontology: Mol. function=catalytic activity; Cellular component =peroxisome; Biological process=metabolic process
  Homolog annotation: Hit_ID=A7PLT1; Match level="QueryCoverage=67%, HitCoverage=25%, E-value=1e-39, Identity=65%"; Hit description =Chromosome chr14 scaffold_21, whole genome shotgun sequence
  Pfam annotation: Domain name=AMP-binding; Domain location=1-197; Score=-89.1; E_value=0.0012; Accession=PF00501.19; Description=AMP -binding enzyme
MTEVLTSTKVMPGATMAEDATMVGGVDANTAGNMKGVMLTHRNLTTLATRYDVVRGGGYVEHDGAQREGYGLTESAVTRTTPEEANQVGATGKLIPNIEAKIVNPETGEAMFPGEQGELWIRGPYVMKGYSGDPKATSATLVDGWLRTGDLCYFDSKGFLYVVDRLKELIKYKGYQVAPAELEELLLSHSEINDAAVIP

SEQ ID NO: 137578 - protein, 70 aa, Glycine max
  Coding DNA Sequence Number=SeqID_45893
AHENPRVFSCISGTIQEEKLKNTSRFKKKDEFKNQDSRIKIQGSRFKNQDQDSRIKIKIQDSRLKNQEKT

SEQ ID NO: 137579 - protein, 80 aa, Glycine max
  Coding DNA Sequence Number=SeqID_45894
MNCIFYVLSGKCDELAKRACCAMRMASRKCKSMGARPTAQYDTRRFHSLDAWNRYTDNVLGRSILPERKVDIYHTEFDDF

SEQ ID NO: 137580 - protein, 271 aa, Glycine max
  Coding DNA Sequence Number=SeqID_45895
  Gene Ontology: Mol. function=protein binding; Cellular component =signalosome; Biological process=red or far red light signaling pathway
  Homolog annotation: Hit_ID=Q40112; Match level="QueryCoverage=59%, HitCoverage=63%, E-value=4e-64, Identity=76%"; Hit description =Putative uncharacterized protein LC15
  Pfam annotation: Domain name=PCI; Domain location=90-195; Score=84.7; E_value=2.9e-22; Accession=PF01399.18; Description=PCI domain
  Pfam annotation: Domain name=Toxin_19; Domain location=38-75; Score =8.1; E_value=0.027; Accession=PF08088.3; Description=Conotoxin I -superfamily
  Pfam module annotation: Pfam domain module=PCI::Toxin_19; Domain location=90-195::38-75
  Subcellular localization annotation: CTP_CleavageSite=30; ConfidenceScore=5.08e-01
MAAIQMTSLVSMTCWACLSLPLIQVLYAPSCQSIFCSNWSRGLSTSNLEGQCPTCCFRGHYCKTASNLPYCWASSSLTIVEEGSFSTICNPYVELANSYGTGKIAELEAYVKANAEKFESDNNLGLVKQVVSSMYKRNIQRLTQTYLTLSLQDIANTVQLNSPKEAEMHVLQMVIQDGEIYATINQKDGMVRFLEDPEQYKTCEMIEHIDSSIQRIMALSRKLTATDEQISCDQLYLSKGVNLAALAIDGTFVKGGEGEIAISSCGVLDNH

SEQ ID NO: 137581 - protein, 157 aa, Glycine max
  Coding DNA Sequence Number=SeqID_45896
MVLNDPSSTIVKELDAQQTRQLLRKVVLITIWIQLPYQTKIHLAQWLPKLGDEDTTKGKDHEALEGPMTRDRLKKVQHSDEDTTKGKDHKALESEADLNRPNTVPVEPNSDLSRLIPCGVTVTYLPSLEVASLSVNIPVSNVLSRKVHVIWYQSFGS

SEQ ID NO: 137582 - protein, 108 aa, Glycine max
  Coding DNA Sequence Number=SeqID_45897
MTRDRLKKAQHSDEDITKGKDHEALEEPMTRGRLKQAQHVIETRLKAYLRVPVEPNSDLSRLIPCGVTVTYLPSLEVASLSVNISVSNVLPRKVHVRRGYRRGVGSRS

SEQ ID NO: 137583 - protein, 122 aa, Glycine max
  Coding DNA Sequence Number=SeqID_45898
MTESLTILVMMLGVWFSLPVVRSTGLTWLVTSFGYHKDHDGQWLKKDVLPPQDERTPSPPPQQDDSSALMNEVLSELRGLRTYVGERFVSLDGHFEGMDTRITQLEEDVSYLRRCFDLPPPS

SEQ ID NO: 137584 - protein, 109 aa, Glycine max
  Coding DNA Sequence Number=SeqID_45899
MDKRSRVWGQWIPYDTDAINQFLGHPLILEEEQHCTSYKLSALRKVPQSTRISYIDYRHFRAIVAWPRDRPNFQDEVGPVDAQGATQGDEGGAEDDGEMVDLLDYFIGG

SEQ ID NO: 137585 - protein, 165 aa, Glycine max
  Coding DNA Sequence Number=SeqID_45900
MALQHSSSVEVLDIQVLAAHVSTKGSCNEATANPLGEEPSTVDVATMGLYIVGDQCTCLVALGKVYDSATTIHNVPYADDVVRVNVTIVYDGDAQALHTFTHPVEPTFDEDSHNCVPKPVATVERSNAVAGVDPLGELIKNLFDVCQKLIELSWDGMKFWILNLQ

SEQ ID NO: 137586 - protein, 75 aa, Glycine max
  Coding DNA Sequence Number=SeqID_45901
MTGVGHGAMYGFFESQSIHNAKDRHHECQPYIETWVKESERELWTSGHIGNFLLCIHGTMLLFGFALCCKEDLNH

SEQ ID NO: 137587 - protein, 213 aa, Glycine max
  Coding DNA Sequence Number=SeqID_45902
  Pfam annotation: Domain name=zf-CCHC; Domain location=141-158; Score =16.6; E_value=0.0047; Accession=PF00098.14; Description=Zinc knuckle
MPRRCGILSNLHMKAPLMMNPNENIHSMQKRFTHIVNHLVSLGRIFPNEDLINKVLRCLSREWKPKEHEMELQRLNQNEETDKKKRNSDDEEDFSLFVKKFQKFVKRRRIKRRKNFNNGRRIKRRKNFNNGRRSQEDSQVFRCYKCNQLCHIKANCPSKEEWPEKSDKKRYDERRTKKAYIAWDDNDSSDGSEKEINLLTKNYESEENISQEG

SEQ ID NO: 137588 - protein, 84 aa, Glycine max
  Coding DNA Sequence Number=SeqID_45903
MVFCENAPTIWDQHRLKGALKPGDPQGLHSEESVRASPSRFSINSSPLKGLNINSLPLKGLSINSSPLKGLSINSSPLKGLTIV

SEQ ID NO: 137589 - protein, 105 aa, Glycine max
  Coding DNA Sequence Number=SeqID_45904
  Gene Ontology: Mol. function=protein dimerization activity
  Homolog annotation: Hit_ID=A3BRV8; Match level="QueryCoverage=87%, HitCoverage=13%, E-value=5e-09, Identity=37%"; Hit description =Putative uncharacterized protein
MNASSPSQAKEQDDDTKPLWTYVTKIKSVSGGGNYEIKYNICDFTFNGPYTRVRAHLLKMTGKGVRVCQKVTIDRLIDLKKIDNDATLRVEKSKTKSMSLPPVST

SEQ ID NO: 137590 - protein, 136 aa, Glycine max
  Coding DNA Sequence Number=SeqID_45905
  Subcellular localization annotation: CTP_CleavageSite=68; ConfidenceScore=5.67e-01
MTTRDFDDANSQVFFVDNSTPFAAINRFFFRNSANFSVLKALGLFGFRRLSQRAWLAERELVNFRLARMGALSARRDHDLAGRAGCGLDVQISELSSSRISYPLSELDVSLSGCISLSGSASLSESSTALTFSSLA

SEQ ID NO: 137591 - protein, 177 aa, Glycine max
  Coding DNA Sequence Number=SeqID_45906
MNDKVAPDLHWAWCQDRRCWDVKGCGSKTTRDFDDANSQLTQLSSQGVPFEGTIVDDWKFDFSSHDARRMVCTNQAEMTDRLLAGSLNFECRIMHYLIVHILLPRSSNLAQVFEEDLIVMWTFLTGRQLDWAHLLVTLFHHHFNVPLESEPFIQVKHSFAIGAGVVTYFGYRQDRDG

SEQ ID NO: 137592 - protein, 142 aa, Glycine max
  Coding DNA Sequence Number=SeqID_45907
  Gene Ontology: Mol. function=endonuclease activity
  Homolog annotation: Hit_ID=Q2HUP4; Match level="QueryCoverage=40%, HitCoverage=19%, E-value=1e-16, Identity=68%"; Hit description =Endonuclease/exonuclease/phosphatase
MTGGGVGRIRKLQEMAITEMGASPGAAVKLCLGDLLVMGSNPETASLHMQGGYAPQVGLAEHFKVKFWEDLEGVLQDIPQGEKVFLGGDLNGHVGSVARGFEGVHGGFGLGEMNGEGKSILEFSEALDLGEEHLITYKSGGT

SEQ ID NO: 137593 - protein, 218 aa, Glycine max
  Coding DNA Sequence Number=SeqID_45908
  Gene Ontology: Mol. function=hydrolase activity, hydrolyzing O -glycosyl compounds; Biological process=carbohydrate metabolic process
  Homolog annotation: Hit_ID=A9PF62; Match level="QueryCoverage=29%, HitCoverage=9%, E-value=8e-16, Identity=69%"; Hit description =Putative uncharacterized protein
MEPNCHDIQMPDRSSLNKENDLTTYGTFVDVDPLHNIENLVNWVWVRVQVFPDNQKSATGTVSAKRNTHGLSARKTLEEDELYSGNWSDSKVLESTGLSCHTIMRNRGRGRGYPIPYGYGDGIINFNPSSIGYGYRDMLGSQGSVLSGGGSVPEINASAETWIQMVNGIQMVNGIQNGSLSTCLGIRMICGIDVVHGHNNVYKATIFPHNVWLGVTRQ

SEQ ID NO: 137594 - protein, 233 aa, Glycine max
  Coding DNA Sequence Number=SeqID_45909
  Homolog annotation: Hit_ID=Q5XM22; Match level="QueryCoverage=49%, HitCoverage=63%, E-value=3e-23, Identity=50%"; Hit description =Resistance-like protein HAAS-2
MITLDDVASLLHVPITGALHKFEPLVTSDTIGLLIELLEVSHEEATFETRQAGGPHVRLGWLRDLYESQCRARRWVATVRTYLLHLVGCTLFAKSSTHVHVVHLEAFRDLAQVGGFAWEATALVHMYEHLNDASHASTRAGYTSTFLQCIHVSFMMLMMRRAHGPTGGLRVAPDYIEWVFGFRTRSSPGPRRLLSQDIRLPLMMRSSLSHPSLRFQSRPISLRIQWLTAKDVR

SEQ ID NO: 137595 - protein, 304 aa, Glycine max
  Coding DNA Sequence Number=SeqID_45910
  Homolog annotation: Hit_ID=A7PLR8; Match level="QueryCoverage=18%, HitCoverage=8%, E-value=1e-10, Identity=50%"; Hit description =Chromosome chr14 scaffold_21, whole genome shotgun sequence
MYHAEEASASSSAITKYSLWKKITRKILQNLLPLDHAEDPVEASSVGIRGRTFHTSSAEEHLLPLQFPEAPFIREEECSSCGRTFVFNLQHHRTRTTASMEDVNFRRKQQLQMKGTKFQMEKEMRARRKKGNIGEEEARMEIAGCMGKKQARKQGEEERERLQASVVSPSQTPPAHENNEEEATVGNEEESVADHCNQFSGEILASLRFEQHYLEKQKEGCYTLSDLLMLPKDMLLSASIRNEKILDNIVSDELCPDPVPSNVFEALDSEPYPCICKEAVSGFKPMTNKSPRHNFTTAPGLGLI

SEQ ID NO: 137596 - protein, 197 aa, Glycine max
  Coding DNA Sequence Number=SeqID_45911
  Gene Ontology: Mol. function=aspartic-type endopeptidase activity; Biological process=RNA-dependent DNA replication
  Homolog annotation: Hit_ID=A5C070; Match level="QueryCoverage=82%, HitCoverage=19%, E-value=9e-21, Identity=34%"; Hit description =Putative uncharacterized protein
MDFVLGLPWTRNGKDSIFVVVDRKWSVSMDYQEASFQIETPSFLVTFGEHCGGKVGIKLLFSTTCHPQTDGQTKVKAQIAKKNESYPKKANKNRKKVILEPGEYRVSSSFNVANLTPFVACDDSEHLRANAFQEGRNDENPETTQIQEPMTRSRTKQLVDTLQQMVADVLNKAQVEKDEGPEVEILLSILIVAEDLD

SEQ ID NO: 137597 - protein, 173 aa, Glycine max
  Coding DNA Sequence Number=SeqID_45912
MSHFIVSDIIATRRVITTTNHKKTKFVGLHCKVGRSLDQTHRSGHHQPQKHRSYDQKHGDSNRAILAKQFKLIIHKQGDNERMTKFEKYMEMLQGKKEEPPIEKLTWDVLHQVRPTRHLEDKGCFTIPISLGNLSIDHALLDLEKIGRLNLKFTNMTLQFAHGSKKKALWKAI

SEQ ID NO: 137598 - protein, 213 aa, Glycine max
  Coding DNA Sequence Number=SeqID_45913
  Subcellular localization annotation: CTP_CleavageSite=19; ConfidenceScore=5.62e-01
MVSYLSLSSSLSMRKKGVRCMFYVSHQTSSKLLRWTSLRVGKRASQPSSHLFNPSLAGNLKRQSLKNAISNPIPHRRPPPRIPLVQALSSISKGEGGKSGGAKAFTAREKEVLEGGEGVGEEVEVMVSEGHVFEVEVGEAWLAINGHRPNAGELGAGAMRGHDVAVFDEELGAGEGLGMGKGFDHRQFGSSLASEIEKMRVSEEGGARVAFAL

SEQ ID NO: 137599 - protein, 59 aa, Glycine max
  Coding DNA Sequence Number=SeqID_45914
MEAYQNSTSLTLHQGGMMFSVSDTVVHANDGDPFVSGERPAQGGPFVSDALVLQGLRES

SEQ ID NO: 137600 - protein, 235 aa, Glycine max
  Coding DNA Sequence Number=SeqID_45915
  Pfam annotation: Domain name=Transposase_23; Domain location=88-158; Score=-1.2; E_value=0.0016; Accession=PF03017.5; Description =TNP1ENSPM transposase
MARTKKTGQIMFEAAKEIVDKIGSAGGSIIEKVTQQLMLSFNQMQSQLQSQIQSQGLALPPEPEVGPSATRVSTKGSCVDPSPTDLETGDLDKCGLYIKDNPSHLVALGRVYEGSIVVHNIPLLHGQVKVGVEQVKDAEAPVPVPTDEVNLVGQTLKTFLAWPTHLMKRVSEQAAVSPAKSHDRPDHEENKVDDHGDDKEGGTGAVGASDGPWHRWPAAAMVVEEPFCFFIDSAI

SEQ ID NO: 137601 - protein, 224 aa, Glycine max
  Coding DNA Sequence Number=SeqID_45916
  Gene Ontology: Mol. function=sequence-specific DNA binding; Cellular component=nucleus; Biological process=regulation of transcription, DNA-dependent
  Homolog annotation: Hit_ID=A7Q4V5; Match level="QueryCoverage=59%, HitCoverage=33%, E-value=6e-27, Identity=50%"; Hit description =Chromosome chr10 scaffold_50, whole genome shotgun sequence
  Pfam annotation: Domain name=WRKY; Domain location=65-117; Score =26.5; E_value=4.2e-07; Accession=PF03106.6; Description=WRKY DNA -binding domain
MDGWKYFDSIKTDYNINPTIEHYSCMVDLLGKVGFLDEALDFIHTVPQKVDASISGVVLAACKLHKDIKIAEIVARNLLRIHCSSSKGCSARKQLERSKNDPNMLVITYTSEHNHSWPTQRNALPGSTTSQSSKHNNNGTTTRTKDEQESNNNNNSEGNVSPVMAGNSSNSMKEDNMEDKERHHIEMDEGEFSDGLPYKPSLINHSANNQESEDFFVGYLMSWA

SEQ ID NO: 137602 - protein, 281 aa, Glycine max
  Coding DNA Sequence Number=SeqID_45917
  Homolog annotation: Hit_ID=A5AY05; Match level="QueryCoverage=46%, HitCoverage=33%, E-value=3e-08, Identity=30%"; Hit description =Putative uncharacterized protein
  Pfam annotation: Domain name=zf-CCHC; Domain location=113-130; Score =22.6; E_value=0.00057; Accession=PF00098.14; Description=Zinc knuckle
EELRDYYEGRHRSHLRPHSHMREKERNPQEANINLPYFHGKDNVEANLDWEIRVEQQLKRKSTSKSYGSHSYPKKDHGQGILGVTPSKPKDDKGKTIERQPLKASMQEKTRFIKCFKCLGRGHFTSQCPTKKTMIMRGQDIYSSQDEATTFPSYSERGKCLLQETLVSIATPLRLEFIPQVKELLDEGLVRKSLNPCALLVPKIGIIRHQIPKIGGMMNVLSGATLFCKITHAPNTFMICVHMDSLGVEEKSPKFQEPRDLRSNPFQGGGNDAILPRKGIG

SEQ ID NO: 137603 - protein, 192 aa, Glycine max
  Coding DNA Sequence Number=SeqID_45918
MEHKRVLIGEAIMLHSLVELPRMCNKCFAYLGVIYITHLIVEAKLHDELRMIQRCFDDNKGDDKKLKGQSKNEFKMFKIESRKNEFKMFKIESRTLQDSRIKLPRIKIKIQDSRIKRRLNQDKYEKRVHLLGLLTENKRGYISCGSVLVEGTSTRFKENKGGYIPCGSLLVKGFLQGLKRNLKDRRSLGDWM

SEQ ID NO: 137604 - protein, 221 aa, Glycine max
  Coding DNA Sequence Number=SeqID_45919
MSDHLRFNFNQGSPRTDLGFGRAMEIRQGSPRTNLGCDEPWRFIKARQGRTLGMTSLEDSLRLTKGGRWVLVSLGDPSRLTKGRPWIRQGSPRADLVFDEPWRFVEAHQDWTLGSPRVNLGFDELWRSVEAHQGRTLGLTSLEDSSRLTKVDADGTVGIGVGGEEGGNSEDGGASNLSPLALHDPLKKAAIKAGNPSLEESCVRGRDRVRERKNAPCLSER

SEQ ID NO: 137605 - protein, 50 aa, Glycine max
  Coding DNA Sequence Number=SeqID_45920
MQGITWLPKLKGLSRKEAEIPEESEEVQALKVEVEKTRMVKVKLKVVVTR

SEQ ID NO: 137606 - protein, 48 aa, Glycine max
  Coding DNA Sequence Number=SeqID_45921
MVILCVILKFEWAMAPKKLSAKRARKATAGEGSSAAPQAEIEFDEHRF

SEQ ID NO: 137607 - protein, 81 aa, Glycine max
  Coding DNA Sequence Number=SeqID_45922
MEVGMAVCNNMDYVLQLLYPGTFHYDEWGNDLRYSLKPVRPIEVTEDQGDHSDMSSREIEEYSELMWQLEPPSEQENDDPS

SEQ ID NO: 137608 - protein, 313 aa, Glycine max
  Coding DNA Sequence Number=SeqID_45923
FRAPFEHKISCSSLPLPSFISFFLQALIHGLLWCGVSSLSSFSIPLPFIFQEAKESIDEEDPRPTSSNGACIRTHAHLVSPFNQNLIQSIGVQNSTDAVKVFVQRSLAILDENGQRHKEALSNITTLEVEVTKWRATAQILWKVKFPKVANAIVALVEAIRSNYQLLSRVDDVFAKLVSTRLDGNEVFKRYKYLLKEKNDFTGKVERAFKEKEVLKATVTKSAKLKEFELEVKKEKEANKELEEELLMFKKEVMEQHEKGFLKAIKQAGFFTDCLDIGLFDPFKDVKDGQLLDEEEIAAREDNDSEEEDKANV

SEQ ID NO: 137609 - protein, 286 aa, Glycine max
  Coding DNA Sequence Number=SeqID_45924
MTGEISAELGALFGFSHDPPGCLVNGQCLYWEFFNNAYELTIVATRGRMKLACYDFSRQDFKPLKCLPIEYVCGTALVDKNFRHHEVGNDHGDDHVVILFDEVDAFEIFVNECYGWKTSRWWCINVVNIDISNGMEMALPGLARYPSIGESTRNSVDHAFNLLSEFVFLLLLGLGRVIGGNCMGISALKASLRMVARFVISGIVGLTRMRFTLGVLIDRVSGVSIPFGESHTSLQLVMSSEEGLEFSGGGSCLRPNRVLTISVGGRGGSFTMAPWWVPNVLTETGS

SEQ ID NO: 137610 - protein, 42 aa, Glycine max
  Coding DNA Sequence Number=SeqID_45925
MGFVGGDLVEKRVRYKDWKFWEKEGTVTRGALSLLVINYRLL

SEQ ID NO: 137611 - protein, 108 aa, Glycine max
  Coding DNA Sequence Number=SeqID_45926
MPMVVPEILGIYLLVVKIAVLGLFWNDEDTTERETELHPRRKSNPHETTIVPSTNMDSQFRAWVGGVDMATNFELHEALNLEDVKWINEEVHGVHSALTPLVLAFFTP

SEQ ID NO: 137612 - protein, 141 aa, Glycine max
  Coding DNA Sequence Number=SeqID_45927
MTIGKFLVDKSPFDPEITKIERKNRKKKKQANTITPAESSSSDYLSTNKTLVENNMDGQGGEGNRPPRRTLGDYAYQQGPKHYNNIVIPLFSNKVVELKPAPLSLIGSDSFDGMDHEDPYTHFSTSMELFSTIKAIDKDDP

SEQ ID NO: 137613 - protein, 507 aa, Glycine max
  Coding DNA Sequence Number=SeqID_45928
  Homolog annotation: Hit_ID=Q1RU73; Match level="QueryCoverage=99%, HitCoverage=98%, E-value=1e-84, Identity=37%"; Hit description =Putative uncharacterized protein
  Pfam annotation: Domain name=DUF247; Domain location=21-496; Score =171.4; E_value=2.4e-48; Accession=PF03140.6; Description=Plant protein of unknown function
MTDTQHLSLKFDQLEKAKQIAQNSAPKIQRVAHHLRDRKHFAKHYLPRLVSIGPIHHGAEKLQLGEKYKVMWAAMYLERTKQDAQTLYQKIASNIEQLKELFSEDVVRDFPDDEKLSWSWMLFVDGCSLLQILEKGKLHYPKEMNVKVDQLALVWQDVLLLENQLPYQVLKLLSDHGNDAKLVKSMNEFLKCHHLSPVRQEQKAKKQDMGNFKSKDEDRALTEEEYRSVCVKNEDTLKGEHRIEITQESPIHLLDQLRRYVLDDPHEKKDTGRDKRKKNTNEDLDMITYRNKKRENSTNEDLDMTTYRNKKKEQNTNEDLDMTTYRNIQELRAAGIKLKREKSRRLRDVSFSYRWMCLCAELMLPEITVDDTTAPTFLNLIAYEMCPDFGNNFEICSFVAFMDSLIDHPEDVKELRAAKVLHNALGSDEEVAKLFNTISTDLVPDTESYSHVRCQIEKHYRSKYRTWIALGYHTYFSNPWAIIAFHAALVALVLTFIQTWLAIHPVG

SEQ ID NO: 137614 - protein, 71 aa, Glycine max
  Coding DNA Sequence Number=SeqID_45929
  Homolog annotation: Hit_ID=A2Q1C9; Match level="QueryCoverage=69%, HitCoverage=52%, E-value=2e-12, Identity=67%"; Hit description =Polynucleotidyl transferase, Ribonuclease H fold
MELGRRRKWMPLLPRRTYARGEVKLFVNNKSRTDLGKHPVAHGRSKHIKTHFHFLRDQVNKGKLILEYYKA

SEQ ID NO: 137615 - protein, 84 aa, Glycine max
  Coding DNA Sequence Number=SeqID_45930
MTKGADDHKVPPHVIGLASLDDKSADNLRYPRMSSDLPSLDDKRCRRRHDDVSLYVNGLACLWLTKGADNHKVPPHVIGLAVSG

SEQ ID NO: 137616 - protein, 281 aa, Glycine max
  Coding DNA Sequence Number=SeqID_45931
  Gene Ontology: Mol. function=single-stranded DNA binding; Cellular component=late endosome membrane; Biological process=protein transport
  Homolog annotation: Hit_ID=Q2V3G8; Match level="QueryCoverage=33%, HitCoverage=26%, E-value=1e-27, Identity=64%"; Hit description =Uncharacterized protein At4g20010.2
MGWVAMLYLAFISPSFLHSTDDYLIKLLLIGDSSVGKSCLLLRFVREVEGDLLLGDMGQGLGICPGVLDGAISISAVQEKKYNKKCANAVIKSLGLNTEKIEKCMGDPDADTDNPVLKEEQDAQHVSEIALENLRIRLRGTTAQACGRMEVMARLLAAETFSHTVVVQVKPKHPDFKRKDRNSLWLGKDEKWVLPKLEGLQFDVPTAISKKGDGGEPCNDLVQNYANWWDNRLNKRNAKAPDFKHKETGKGLWLDSSSEWVLEKLPPPLKPKQSVDTERTL

SEQ ID NO: 137617 - protein, 306 aa, Glycine max
  Coding DNA Sequence Number=SeqID_45932
IHNGLTNDITLTHGSKKFKLVPLTLSLVVGDQVQIKLKWDEEKNRRRKEEQPLMVKEGCKEVSVSSKRTLVGTATPLGLEIIPQVKELLDEGLVHKSLNPCALLVPKLGIIRHQIPKIGSMMNVLSSATLFCKITHAPNIFMIHVHRVSLGRFDGAHMGHLSGVSNHLSSFSIQLSLILKKKRTPLMKKIQGLQALHGATLLPKTTLTDFEVYPGSTIEGHAFSSVPMSYASGAPQSTVVVENEKFDHIEERMRAIEGRGNYGFIDMSKLCLVPDVVIPLKFKVTDFDKYKSTTCPKNHQYGMHGT

SEQ ID NO: 137618 - protein, 35 aa, Glycine max
  Coding DNA Sequence Number=SeqID_45933
MAVAWYMSSHSLGNEEIPYQLKSSEVGENQNNNIY

SEQ ID NO: 137619 - protein, 122 aa, Glycine max
  Coding DNA Sequence Number=SeqID_45934
MTLVSYHWNSQNLVVLRNFSLNCREGTLCHGMMARLSPTGYALHLSGFPSWHCGKCDHKLSVISLINSKSVSVTEVPLYKVILTPRTYSSTTPHQGFTLSSLWGSTAQLWMPGIHTSQVFQM

SEQ ID NO: 137620 - protein, 242 aa, Glycine max
  Coding DNA Sequence Number=SeqID_45935
MSRGSGDLGDVRWGAIAQNQAWPIPAQPGHSQPVRTCDVPKQASSWQSTNKGTKVHEAGRLVWRLASYLSCVLSEKFPLGLKIETERSVATGNRLPFIAMAAQLIHDRVVMECLDGVWETLEGNERCRFRGTVRLTTTSLVHPKQPAHTLQQSVEWILPTPTPYRLVEPVQLIEVSSSDEDLEEDPEELPPEPAMDAPDLPEDDEDPLPDVDSPEDMMSASEADSTKQSDPGGTANSDDSSS

SEQ ID NO: 137621 - protein, 52 aa, Glycine max
  Coding DNA Sequence Number=SeqID_45936
MAIVSSKNYFWHICSDAILLRKGPVTRAMSKRLQEDWARAAEEGPRVLMNLR

SEQ ID NO: 137622 - protein, 136 aa, Glycine max
  Coding DNA Sequence Number=SeqID_45937
MASRKRKSIGTRTTSQYDTRRFHSFEAWTRYTYNVLGRHILPERKVEIYHTELDEFKAKLERRNFHKHLTNLVDRSIDLALVKEFYANLYSSEGPSPKQVRFRGHVAALCIQGWGFVLNAEGHPRKILRKDLTTLA

SEQ ID NO: 137623 - protein, 60 aa, Glycine max
  Coding DNA Sequence Number=SeqID_45938
MSRLQEDWAKAAEEGPKVLMNLRSTKFRALLFLSLHSSPSSKLLSMASYGAELLLDSSSP

SEQ ID NO: 137624 - protein, 181 aa, Glycine max
  Coding DNA Sequence Number=SeqID_45939
  Gene Ontology: Mol. function=binding; Cellular component=protein complex; Biological process=protein catabolic process
  Homolog annotation: Hit_ID=Q6XJG8; Match level="QueryCoverage=71%, HitCoverage=14%, E-value=8e-52, Identity=80%"; Hit description=26S proteasome subunit RPN1b
MILTTSTSFSGPTIASLIVDSVEATAEVSKTFNEKIRKYCDMTLLSCGYAGTENVLKVQNLLGHCSQHLDKGENHQGSAVLEIAMVAMAEELGLEMTIRSLEHLLQYGEQNICQAVPLALGLLCISNPKVNVMDTLSRLSHDTKLEVATPRMLLTMDENLKPLSVPARVGQAGRPKTITSF

SEQ ID NO: 137625 - protein, 394 aa, Glycine max
  Coding DNA Sequence Number=SeqID_45940
  Gene Ontology: Mol. function=protein binding; Cellular component =actin cytoskeleton; Biological process=cytoskeleton organization and biogenesis
  Homolog annotation: Hit_ID=A7P9T3; Match level="QueryCoverage=92%, HitCoverage=73%, E-value=1e-126, Identity=61%"; Hit description =Chromosome chr14 scaffold_9, whole genome shotgun sequence
  Pfam annotation: Domain name=Kelch_1; Domain location=133-175; Score =4.2; E_value=0.96; Accession=PF01344.16; Description=Kelch motif
  Pfam annotation: Domain name=Kelch_1; Domain location=177-224; Score =36.3; E_value=1.1e-07; Accession=PF01344.16; Description=Kelch motif
  Pfam annotation: Domain name=Kelch_1; Domain location=226-272; Score =39.8; E_value=9.7e-09; Accession=PF01344.16; Description=Kelch motif
  Pfam annotation: Domain name=Kelch_2; Domain location=133-175; Score =1.8; E_value=27; Accession=PF07646.6; Description=Kelch motif
  Pfam annotation: Domain name=Kelch_2; Domain location=177-224; Score =17.4; E_value=0.055; Accession=PF07646.6; Description=Kelch motif
  Pfam annotation: Domain name=Kelch_2; Domain location=226-272; Score =15.1; E_value=0.27; Accession=PF07646.6; Description=Kelch motif
  Pfam annotation: Domain name=Kelch_2; Domain location=280-320; Score =13.6; E_value=0.74; Accession=PF07646.6; Description=Kelch motif
  Pfam module annotation: Pfam domain module=Kelch_1::Kelch_1::Kelch _1::Kelch_2::Kelch_2::Kelch_2::Kelch_2; Domain location=133-175::177 -224::226-272::133-175::177-224::226-272::280-320
MWNFGGGSCRFSHNSSAEKMRILEESPSYAHGSSSAGQEPQDADYDVPCLSDELETMILARFPIPKHWKMCCLSKRFLTLLKSGEIYKIRRVIGFKEPSVFMLASGEKNWCAFDGHFRSCRKLPIIPSDYNFEWGNKESFSAGTYIFVSGKEVDGGVVWRYELATNEWFKGPSMLSQRCLFASASCGTMAFVAGGIETTTREVLSSAEKYNSESHIWEQLPRMIQKRKSCSGCYLDNKFYVLGGQNEQKKDLTCGEFYDEDTNTWNLVPAMFKDIPLSTPRSPPLIAVANNELYTLDASSNELKVYLKKSNSWKKLGPVPVRADARLGWGVAFKSLGNELLLIGDTSASYSQRAVMKIYTCFPDPHVEKLKWKQIVCSSTNLHPFIHNCAVMLA

SEQ ID NO: 137626 - protein, 283 aa, Glycine max
  Coding DNA Sequence Number=SeqID_45941
MTILVSACQWACLPLVEEGADNHEVVDDQILYMHVIKLACLWMTKARLPLVDEGEDNHEMTILICACQRARLPLYDEGVDNHEMTILICACQRARLHLFDEGVDDYETFLLWMIKACFPLVDKGGNNHEVSLRAIGLHCPWIAKALLPLVDKDNMVDTKVVSVCQRARLPLVDEDIESSTKGADDHIGLCGSTGSLASDLPSLDEKGVDNYEVSPCVRIICVSLDFPSLDDKGADNHEVSPHSTGLDCLWIAKTCLSLDDGVETKVVSVCQRARLALVDEGGG

SEQ ID NO: 137627 - protein, 143 aa, Glycine max
  Coding DNA Sequence Number=SeqID_45942
  Subcellular localization annotation: CTP_CleavageSite=37; ConfidenceScore=5.83e-01
IMGSPPASTPPPPPPSPPSPPPSDASASSSAVKRTLKASRLRSLSTRPPGAERPVVHVDPATGKANGGHHLRELEGVPTAQKDLIWEDIQAKFDIPEASDNLARKWALAANQDGVEDTVCEKYGISKEKWVQFCQTRRDPSWE

SEQ ID NO: 137628 - protein, 114 aa, Glycine max
  Coding DNA Sequence Number=SeqID_45943
MGAKHLTRTKEWSHVIKQRSPDEWVRITIRMNKLGLCLSSGPPPLDDKRVRITVRMTKLGLCLSSGLPPLDDKRVRITIRMTKLGLCLSSGPPPLDDKRGANNHKVSPRIMGAE

SEQ ID NO: 137629 - protein, 140 aa, Glycine max
  Coding DNA Sequence Number=SeqID_45944
VIQPPITRAFIEKYCMPRQAQGDAPQAADAPPPPHQADPVGSFGMERYLQHLVRQQVTNHRGQVQIHEYLYLLSISQQSQGFATFVCPTPDQFRAEVAWPGDWPEAQAGEAPTEALSDAEEARMDEEMTDLLSFLGGSGA

SEQ ID NO: 137630 - protein, 149 aa, Glycine max
  Coding DNA Sequence Number=SeqID_45945
MDPRRTACPPLQRATRPRHQRTVCPHLQRATRPRHQRTAWLHALTFRGLHVLANRGLHALTFRGLHILAFRGLHVLTLKGLHVLALRGLHVLALRGLHVLTIRGLHALTSRGLHVLALRGLPALALGTSYPHLQRTTCPHLRRATCPHL

SEQ ID NO: 137631 - protein, 60 aa, Glycine max
  Coding DNA Sequence Number=SeqID_45946
SSKGISPPTNRDVIKKYGIPRQAQGETPQQPGDGQQRAIDAPPSPLEFTSAHPQKGRKIP

SEQ ID NO: 137632 - protein, 96 aa, Glycine max
  Coding DNA Sequence Number=SeqID_45947
MKEGIGHILDLTPIGEKMKESLKRKDNVEANLDWEVRVEQQLKRKSTSKSHGSHSYPKKDQGQGILGVRPSKPKDDKGKTIEKQRLRLVCKRRLAP

SEQ ID NO: 137633 - protein, 214 aa, Glycine max
  Coding DNA Sequence Number=SeqID_45948
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNHAERGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137634 - protein, 182 aa, Glycine max
  Coding DNA Sequence Number=SeqID_45949
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=98%, E-value=2e-09, Identity=27%"; Hit description =UPI00006A17C9 related cluster
  Subcellular localization annotation: CTP_CleavageSite=79; ConfidenceScore=5.01e-01
MLVRMIRTRLFAAAWVKSCPGMHSSCVIASLSGCACTVGPPPISGGGPGTVWIWSPLKVRTRSPLKARACSPLKFRTCRLSKARECSPMMARTCNPLKVRTCSPLKVKARSPTKVKAHDPLTARTCSPLKLKVHDPLKARTCSPLKVKARTYSPLEVRACSPLVVRTCSPLKARTCSPLTVR

SEQ ID NO: 137635 - protein, 194 aa, Glycine max
  Coding DNA Sequence Number=SeqID_45950
HVRVRGHLIKFDADSLNTFLKTPVVLEQGESLPSYSRFYRLRPDPQELAARLCILGRGFVLNIEGLPWKLLSKDLTTLAQTWSVLSYSNLALTSHTSDLNLDRASSNSPSSSRSLHSELRAFHVYAAEPAPGPAPDYAELARCGPAVTSYECGGVSAEVTVEGTQQASPAGTPTLDLNKEAMDQDPPPPQDQDH

SEQ ID NO: 137636 - protein, 81 aa, Glycine max
  Coding DNA Sequence Number=SeqID_45951
YLSQPTLLRASEARLTNALSKGGKCAESPPTFICGKRRKNQRKPVIKDIPSSGVVFIFEEGQQKQGSCSYVPSIEEEIRPT

SEQ ID NO: 137637 - protein, 138 aa, Glycine max
  Coding DNA Sequence Number=SeqID_45952
MTGPLDESISYFLIRVDPWVLVPIAFRGMHALTFRGLHVLAFRGLHALTFRGLHALALRRLHALALRGLHALAFKGLHTLAFRGLHVLTFRGLHALAFRGLHVLTFRGLHVLAFRGVHVLPFRGLQVLTFKGVQVSCL

SEQ ID NO: 137638 - protein, 205 aa, Glycine max
  Coding DNA Sequence Number=SeqID_45953
  Gene Ontology: Mol. function=chitin binding; Cellular component =extracellular region; Biological process=chitin metabolic process
  Homolog annotation: Hit_ID=UPI000069F178; Match level="QueryCoverage =62%, HitCoverage=99%, E-value=1e-14, Identity=35%"; Hit description =Mitochondrial antiviral-signaling protein (Interferon-beta promoter stimulator ...
  Homolog annotation: Hit description=protein 1) (IPS-1) (Virus-induced- signaling adapter) (CARD adapter inducing interferon-beta) (Cardif) (Putative NF-kappa-B- activating protein 031N).
MLLSSNVIYIYVRVVMLVRMIRTRLFAAAQGKSCPGMHSSCMIAFISGCARTVGPPPISEGGPGTVWMPSTLKMRTRSPLKARMCSPLEVRACSPLLARTCSPLKVKARTYSPLEVRACSPLVVRTCSPLKVRTCSPLTVRVRACSPLKARTCSPLEVRACSPLMVRTCSPVKARTACSPLMVRTCSPLKARTCSPLNGEGNKYP

SEQ ID NO: 137639 - protein, 92 aa, Glycine max
  Coding DNA Sequence Number=SeqID_45954
MGSLNDEVRITVRCLRGLPALGSCISFLNDHLEETLGSTKIEENHSECINLAQICHDLTLRIISYQIKDYMRDHGSIGLPLEMGSFGGFFGF

SEQ ID NO: 137640 - protein, 257 aa, Glycine max
  Coding DNA Sequence Number=SeqID_45955
MANQEDWVPFMDVLALLIFGVVLFPNVDGLVDLAAIDAFLAYHHSKESPVVAVLADLFDTFDRRGIRNGIIGGYHEWLKVRTRGLDWLSKLKIIDKESFEALEEDEEVRALKTELGKARLAKEKFKLVATDVRKECVGLQEENTANAKALQQETKRARKEEHGRDKFRGALWGSNSELKLRREERDQSRAHNMVLKEESAACSRSKRSLSQRLCETETNMLAIISKYQEELNLATAHEHKVADEYAQVYAEKEARGR

SEQ ID NO: 137641 - protein, 56 aa, Glycine max
  Coding DNA Sequence Number=SeqID_45956
MPERGEAREILNWRCGMNRKLGYGAQLRANLDPTKGVGRLRQQDGGHGSRNPLRSV

SEQ ID NO: 137642 - protein, 36 aa, Glycine max
  Coding DNA Sequence Number=SeqID_45957
MKIIPGTPSGKIVNQLKKGKVKSPHKIYPPISQGSR

SEQ ID NO: 137643 - protein, 79 aa, Glycine max
  Coding DNA Sequence Number=SeqID_45958
MVAYGGSNPARLGELGGNLLPPFPINRRREAVPNIPNPLGYAFQLFWVKKIVSVKKIQAKLSSSFRSFFVFLSSVFNEL

SEQ ID NO: 137644 - protein, 77 aa, Glycine max
  Coding DNA Sequence Number=SeqID_45959
MTRVRGPKLLMLRQPLRKDDDLLVVTLASFCVRPQVSESRKQRGVANLDRVVVSPRLVSAVLTLSLPQNVARDDPAP

SEQ ID NO: 137645 - protein, 74 aa, Glycine max
  Coding DNA Sequence Number=SeqID_45960
MIANKRCFDDNKDDDKKPKKMISRLSQEQFKNQEKDSRESFIKKIQDSRFKNNQDQDSRLKDSRIKIILNQDKY

SEQ ID NO: 137646 - protein, 181 aa, Glycine max
  Coding DNA Sequence Number=SeqID_45961
  Subcellular localization annotation: CTP_CleavageSite=51; ConfidenceScore=5.82e-01
MGSPPASTPPLPSPPPSPPHLPPPSDASASPSAVKRTRKASRLRSLSTRPPSAERQVVHVDPATGKADGPHRKKLRTYLGIVARDKAEFDILEASDSRTKRKLLQTVGERWRQFKSDLTRKGALAADQDGVEDTVYEKYGISKEKWAQFCQTRRDPSWEDVCKKAQDIQKQNTGPHVLSRG

SEQ ID NO: 137647 - protein, 175 aa, Glycine max
  Coding DNA Sequence Number=SeqID_45962
MGSVPIILGKPFMKTAQTKIDVYAGTLSMEFVDIIVHFNILNAMKHPSEDHSVFRAEIIDQIVDDYMFDFDSVLHGRKHPFLSDLHTCHSLCIESESEFEFDPVSDFYAESEFEFEFGSNFLGVVPLDVDFLESECTNRVARSSYTSDLLYEDKEKFPVIISASLAAEQEEKLLL

SEQ ID NO: 137648 - protein, 89 aa, Glycine max
  Coding DNA Sequence Number=SeqID_45963
  Homolog annotation: Hit_ID=UPI0000ECBAF8; Match level="QueryCoverage =46%, HitCoverage=48%, E-value=1e-16, Identity=100%"; Hit description= UPI0000ECBAF8 related cluster
EANGNAANPREGSMSIIRVMGLAHQTKKSEADVEEGGMQAWHWPSFYNVVTGKTLALPNLIALQHIPLSPAGVIAKRPAPIALPNSCAA

SEQ ID NO: 137649 - protein, 27 aa, Glycine max
  Coding DNA Sequence Number=SeqID_45964
MEGKQGGANSNQAHLGLPGSSPEGGAF

SEQ ID NO: 137650 - protein, 156 aa, Glycine max
  Coding DNA Sequence Number=SeqID_45965
MAPRKLASKRSRKDKAAEGTSSAPEYDSHRFRSAEHQQRFKAIKGWSFLREQRVQLRDNEYTDFQEEIVRRRWASLVTPMAKGGRARYAILDALSQFLGYPLVLEEGQECEYGQRRNRSDGFDEEAIAQLLCMPGHDFARITAGRWVRIMRTNMTT

SEQ ID NO: 137651 - protein, 73 aa, Glycine max
  Coding DNA Sequence Number=SeqID_45966
MSIPQFMVLFVGEKMKNTKVVVAGVSLSEACVLSENHSLSEASTRLASWENLEENLSSISASSARSTSHLSLR

SEQ ID NO: 137652 - protein, 76 aa, Glycine max
  Coding DNA Sequence Number=SeqID_45967
MKSGDMRGYRMVIHTFRQPGANEPVHMQRLTSSYAPFVIQGQRVRWQAEIPYGHPHLSSIEANEFDNIRMMLVVRF

SEQ ID NO: 137653 - protein, 101 aa, Glycine max
  Coding DNA Sequence Number=SeqID_45968
  Subcellular localization annotation: CTP_CleavageSite=30; ConfidenceScore=5.37e-01
MYPLLFSVTTTQVDVTSTCTTKDVPSNVLRQSSQAVSPLKLCEWGNKRILRREKGDTKEFRRLALRSFGKGRRETKRIQAVSPWRILFGKGRRETQKNSGG

SEQ ID NO: 137654 - protein, 201 aa, Glycine max
  Coding DNA Sequence Number=SeqID_45969
  Pfam annotation: Domain name=G-patch; Domain location=1-38; Score =5.6; E_value=0.039; Accession=PF01585.14; Description=G-patch domain
VMLGNGYEPEMGLGKNNGGRTSLVSTRGNRGKFGLCYKPTQADIRKSVAGRKSRSQGSQLGRQVEGGPPCHISRSFISAGLGHEGQVVAICEDDSLSGSDLDPTIDFKQEAGQTESEEGEDVGLPSKLEKIVAHEDQEMGPRHEETELVDLGTDSGKKEVKIGTMVVRDGLRPRLCYEMMGQATLPPFPCCWYPKVRPPSA

SEQ ID NO: 137655 - protein, 205 aa, Glycine max
  Coding DNA Sequence Number=SeqID_45970
  Gene Ontology: Mol. function=ATP binding; Cellular component =cytoplasm; Biological process=cellular response to phosphate starvation
  Homolog annotation: Hit_ID=A4W947; Match level="QueryCoverage=100%, HitCoverage=57%, E-value=1e-108, Identity=98%"; Hit description=PhoH family protein
  Pfam annotation: Domain name=PhoH; Domain location=56-205; Score =271.2; E_value=2.1e-78; Accession=PF02562.7; Description=PhoH-like protein
MGRQKAVIKARREAKRVLRRDSRSHKQREEESVTSLVQMSGVEAIGMARDSRDLSPIEARNEAQAHYLNAIDNKQLIFATGEAGCGKTWISAAKAAEALIHKDVDRIIVTRPVLQADEDLGFLPGDIAEKFAPYFRPVYDVLVKRLGASFMQYCLRPEIGKVEIAPFAYMRGRTFENAVVILDEAQNVTAAQMKMFLTRLGENVT

SEQ ID NO: 137656 - protein, 273 aa, Glycine max
  Coding DNA Sequence Number=SeqID_45971
  Gene Ontology: Biological process=transposition, DNA-mediated
  Homolog annotation: Hit_ID=Q6UUU1; Match level="QueryCoverage=26%, HitCoverage=46%, E-value=2e-18, Identity=71%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFAFIILFPSYTHSTFFHGWLLVATTIIVATKTIVVATIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGRRFPGRCQEDT

SEQ ID NO: 137657 - protein, 106 aa, Glycine max
  Coding DNA Sequence Number=SeqID_45972
  Homolog annotation: Hit_ID=A5ZYK8; Match level="QueryCoverage=23%, HitCoverage=23%, E-value=1e-07, Identity=96%"; Hit description =Putative uncharacterized protein
  Subcellular localization annotation: CTP_CleavageSite=42; ConfidenceScore=5.05e-01
GWAVRPLKRYVSWVQNVVRQFGPYPDREGRTSGVPVIVPTVNAGASGSTAETAMGSLPQRGWSERSFENSREGVEEPHQSIPNLVVKLYCGDDTVGSPAENSSAPG

SEQ ID NO: 137658 - protein, 240 aa, Glycine max
  Coding DNA Sequence Number=SeqID_45973
  Homolog annotation: Hit_ID=Q6L477; Match level="QueryCoverage=45%, HitCoverage=21%, E-value=9e-07, Identity=24%"; Hit description =Putative uncharacterized protein OSJNBa0009L15.8
  Subcellular localization annotation: CTP_CleavageSite=59; ConfidenceScore=5.73e-01
MTTPLSSPPHPPPPTNAASHSPSTLKRTRKATRLRSLATRPVRVKRPLAHVDPVTGKVDGPHKKKLRTYLGIVARDKVDVTYENWKQVPTAQKDLIWEAIQVEFDIPKASDPRTKNKILQTMGVKKNSFNDTVCEKYGISKEKWTQFCQSHRDPSWEAQAIQKQNIALHMLSYGDYEFLENKLMEEKKKKQLEEAAKSESTNTVIDPPSPIRRHVKWKMARTKKIGQMTSEAVKEIADKI

SEQ ID NO: 137659 - protein, 279 aa, Glycine max
  Coding DNA Sequence Number=SeqID_45974
  Gene Ontology: Mol. function=motor activity; Cellular component=cell projection
  Homolog annotation: Hit_ID=UPI00016621D1; Match level="QueryCoverage =80%, HitCoverage=40%, E-value=1e-21, Identity=36%"; Hit description =UPI00016621D1 related cluster
GLHTFAFRGVYVLTFRGLHVLTFRGLHVLTYRGLHALAFSGLYVLTFRGLHALTFIGLHALAFRGLCVLTFRGLHVLAFRGLNAIAFRGLHVHTIKGLHVLTIRGLHDLTFKGLDVLAIRGLHVLTFRGLHVLAIRGLHALTFKGLHVLAFRGLHVLAFRGLHVLAFRGLHVLAFKGLHVLTFRGLHALAFRGLHTLTFRGLHVLAIRGLHALAFRGLHVLSFRGLDVLLFRGLHVLSFRGLGVLLFRGLHVLAFRGLRVLAFSGLHSHTLREFKVLYP

SEQ ID NO: 137660 - protein, 106 aa, Glycine max
  Coding DNA Sequence Number=SeqID_45975
MMSICSFWLYGSSYIYSPHGKGPRRGHDIQRMWRIIDIVRECLTLVAFPYMDAAVTFHGELVITCPQDFLGHNMPIGVRSKRTLVDFLNHVVRLFGIHASQENHVV

SEQ ID NO: 137661 - protein, 80 aa, Glycine max
  Coding DNA Sequence Number=SeqID_45976
AHVQTHDCLYQFSLSLHSQGFLPFPCPTPDQFKAEVAWPGDWPEAQAREAPAEAPDDADEARMDEEMTDLLNFLGGSGAT

SEQ ID NO: 137662 - protein, 134 aa, Glycine max
  Coding DNA Sequence Number=SeqID_45977
MEREMITMIVDTLLVFNYEKIVGYTPSNIVDLVFAGERIEVGLRRGKFDYPALINGKTRENRENEKEEGTHAVTVVPTRPNFPPAQQCHYSANTCLSYYPPPNHPQRSSLNQPQSLPVTHPMPNTTLNTNQNTN

SEQ ID NO: 137663 - protein, 137 aa, Glycine max
  Coding DNA Sequence Number=SeqID_45978
MRCFTFGNLQLSPMVEEFEEILGCPLGGRKPYLFTSFTPFSPRGEACLPARKSSFMHRERRGKLGPTLSKQRRSICQLVPSMEGRKNRSSYFMRRISKCSLDVMRGCISYNPILAIRQLGYPMRGAPLEDGLAPVIS

SEQ ID NO: 137664 - protein, 160 aa, Glycine max
  Coding DNA Sequence Number=SeqID_45979
MKEDIGHILDPTPIGEKRKESLKRLTLTSHTSTRRIIGHITSQCPTKKNMILRGQDIHSSQDEATTSPFSSESEEAKGEESSEEIYPQEEGQPLMVKEEYKEVSVSSKRLAKKDSHFEIKTNIKETSPLRQPPHLLLCKKILVSTATPLGLEVIPQVKNL

SEQ ID NO: 137665 - protein, 159 aa, Glycine max
  Coding DNA Sequence Number=SeqID_45980
MTGRLLVGSSTFDNRIMHYIIVRILLPRSSNLAQASKEDLILMWAFLTGRQIDWAHLVWYRMHEALRHSFAIGAGAVTSFGYRKDRNGQWLKKDALPPQDERIPSPPPQRDDSALMTEVLSELWGLRTYVGEHFDSLDTRFAGMDIRLTQLEKDVGYIC

SEQ ID NO: 137666 - protein, 268 aa, Glycine max
  Coding DNA Sequence Number=SeqID_45981
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=71%, E-value=4e-24, Identity=69%"; Hit description=LacZ protein
  Subcellular localization annotation: CTP_CleavageSite=59; ConfidenceScore=5.52e-01
MEKRLCRGPLTSLLSIFLASSRKSPPRFAQYANRLSPRVGRFINAAGTTGFPTGKRAVSATQLMEQKLVPGPPSRSTVSISLIGQDLLEAITPGANLAPGGSALIGQLLDLATASLAPAAPEAALAPVLAEIALLHQRAASGDTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137667 - protein, 71 aa, Glycine max
  Coding DNA Sequence Number=SeqID_45982
GKDGHSHPGSRFMVSWDFGSRLVERLDMIYARAIPRLSWCLALCLPGGAVLLDESSVSRAPDDLAGEIGTP

SEQ ID NO: 137668 - protein, 352 aa, Glycine max
  Coding DNA Sequence Number=SeqID_45983
  Gene Ontology: Mol. function=signal transducer activity; Cellular component=membrane; Biological process=signal transduction
  Homolog annotation: Hit_ID=Q1H3K2; Match level="QueryCoverage=100%, HitCoverage=48%, E-value=1e-108, Identity=56%"; Hit description =Diguanylate cyclase/phosphodiesterase with PAS/PAC and GAF sensor
  Pfam annotation: Domain name=GAF; Domain location=26-159; Score=59.0; E_value=1.7e-14; Accession=PF01590.17; Description=GAF domain
  Pfam annotation: Domain name=PAS_3; Domain location=195-289; Score =2.0; E_value=0.063; Accession=PF08447.2; Description=PAS fold
  Pfam module annotation: Pfam domain module=GAF::PAS_3; Domain location=26-159::195-289
MKCPAILANEQERLAALYEHGLDDEGLIPSLDPIVQIAARMFDMPVAAVNMIGSDHVFFAASVGIGETDMRRDVSFCGHAINQLEIMVVPDAAQDERFHDNPLVTGDANVRFYAGVPLRSPGGLALGALCVLDNKPHLNFSEEDQRRLLELARIVSDRLELRRIETSSNRHRPTFEKYAGNSTTPIVWFDERLNIIAWNAAAALSHGYSMPEGAGMGVDRLVLERDRPILQETIAKAVAADTVGHLDTFSEIFGLRKDGTKFLVGFSLFAWKEAGKMRFEASMKDITEQRMEEAELRLRANVDLLTGLANRGRFYRVVEDTLTVPKTAAVFMIDLDGFKDVNDTLGHTLGDN

SEQ ID NO: 137669 - protein, 270 aa, Glycine max
  Coding DNA Sequence Number=SeqID_45984
  Homolog annotation: Hit_ID=Q2RWD1; Match level="QueryCoverage=92%, HitCoverage=73%, E-value=8e-21, Identity=30%"; Hit description =Putative uncharacterized protein
MDLGMTGPLDESISCFLIRVDPLGLHVLANRGLHALAIRGLHVLTFVGLHALTFRGPHVLTFRGLHALAIRGPHVLTFRGPHVLTFRGLHALAIRGPHVLTFRGLHALAIRGLHVLTFRGLHALAIRGLHVLTFRGLHALAIRGKHVLTFRGLYALAIRGLHVLTFRGLHALAIRGLHVLTFVGLHALTFRGPHVLTFRGLHALAIRGLHVLTFRGPHVLTFVGLHALTFRGPHVLTFRGLHALAIRGPHVLTFRGLHALANRGPHVLTF

SEQ ID NO: 137670 - protein, 208 aa, Glycine max
  Coding DNA Sequence Number=SeqID_45985
  Gene Ontology: Mol. function=catalytic activity; Biological process =metabolic process
  Homolog annotation: Hit_ID=A6TD52; Match level="QueryCoverage=96%, HitCoverage=54%, E-value=2e-90, Identity=81%"; Hit description =Hemolysin F
  Pfam annotation: Domain name=Epimerase; Domain location=9-208; Score=- 71.9; E_value=0.081; Accession=PF01370.12; Description=NAD dependent epimerasedehydratase family
  Pfam annotation: Domain name=NAD_binding_4; Domain location=1-189; Score=88.0; E_value=3e-23; Accession=PF07993.3; Description=Male sterility protein
  Pfam module annotation: Pfam domain module=Epimerase::NAD_binding_4; Domain location=9-208::1-189
MRKFNVPEDKLASLSVENILIGDLSQPEAFLNDPRLDQVTHVVNCAAVASFGNNPLIWKVNVEGTLALARRMEQVSTLQRFLHVGTAMSCTPEQDSLVAESAEFRENAEHLVEYTWSKSTIEQLMRQACPDLPLLIARPSIVVGHTRHGCTPSSSIFWVFSMGLMLQKFMCSMEDRIDVVPVDYCADALLMLLHSNCSSGGSGAYFGG

SEQ ID NO: 137671 - protein, 56 aa, Glycine max
  Coding DNA Sequence Number=SeqID_45986
MFSRLDLNQKGEALTHSSECRPWGRLTRFFTNMMVRWMTMKNIMLEDTKTQCSDRM

SEQ ID NO: 137672 - protein, 137 aa, Glycine max
  Coding DNA Sequence Number=SeqID_45987
  Homolog annotation: Hit_ID=Q6WAY4; Match level="QueryCoverage=86%, HitCoverage=21%, E-value=5e-10, Identity=35%"; Hit description =Putative uncharacterized protein
MGTNQTGKRFYQVKIKGLDVTSLKELGWLMGPLQMQAFHKAYGKILDLTIAEIFMEVVVSLTQYYDQPLRCFTFGDFQLVPTVEEFEEILGCPLGGRKSYLFSGFLPSLSKIAVEVRNSARELDRVKQTRNGVVGIP

SEQ ID NO: 137673 - protein, 233 aa, Glycine max
  Coding DNA Sequence Number=SeqID_45988
MTTFTWIWMTLLFSNILSGDHNANLPLQMYRLGSRPQDAQWARRSPTGPWGFQLCLRASVSPTGCPFPQQGIAPTKTPSGPGEVQQGPGVSSSGYGPLNRPHKDTQWTRRSPTGPWGFQLWLRASVVLQGARSLRQGHVIIGSRLQDTQWTRRSPAGSWSCQALITGLCQFYGVLVTSSKGIRPPTNRAFIKKYCVPRQAQGETPQQPVDGQQRATDAPPSPLEFASAHPQKG

SEQ ID NO: 137674 - protein, 254 aa, Glycine max
  Coding DNA Sequence Number=SeqID_45989
  Homolog annotation: Hit_ID=Q2HW90; Match level="QueryCoverage=29%, HitCoverage=14%, E-value=3e-09, Identity=44%"; Hit description =Putative uncharacterized protein
MANQGDWVPFMDVLALLIFGVVLFPNVDGLVDLAAIDAFLAYHHSKESPVVAVLADLFDTFNRKCEKSSARIICCLPALCVWLVSHLLQQDTRHPCPLQSHRSCTEKRRIDWDQLLTGIGGRTINWFPPMEGRKGGSPFLMWRVPGHSANRNEGLYELQSRARYKTTRVPHEGSSDGRKHVSSSFEESIEAPEEDEEVQALKSELGKAKLAKEKFKLAATHIRKECAGLREENATTARALVQETKRARIGRVWP

SEQ ID NO: 137675 - protein, 191 aa, Glycine max
  Coding DNA Sequence Number=SeqID_45990
MSHHSSSVNGEGTSHKDPLSRILDELSSLKLWKEKQERKEKGKKRVEEISQDERKKIREEERRKIMKEMKREKHASYSSHNSCKSLSEELRDYYEGRHRSHLRPHSHRREKERKPQEANINLSYFHGKDNVEANLDWEIRVEQQLKKKSTSKSYGSHSYPKKDQGQGILGVTPSKPKDDKGKAIEKQAHKT

SEQ ID NO: 137676 - protein, 298 aa, Glycine max
  Coding DNA Sequence Number=SeqID_45991
  Homolog annotation: Hit_ID=Q1B6D3; Match level="QueryCoverage=99%, HitCoverage=44%, E-value=9e-55, Identity=43%"; Hit description =Putative uncharacterized protein precursor
VRKQLDDAIPETPLEQRRLLIDVITTAARADRTLEDQSSAFDALRNLVINAPAKLDTLTQQVVAVTARLPESERILGQLRTEFDAAALASIGDNVAEATERVRFADSRITHGRELAARALEGQQMSLVDAIRGAESALTQANALLDAIDNAANNIRHATDSLAASIADTKSDIAQAEEFQQQGRLPSSEELAKAHDAAVAAVADAERIGATDPLTAFTHLAAADAQLDKLLATAQEDRAAAERRARVLDQALVAARQRLDAVNQYIGLHRGAVGARTRWNLDEAQRRLAAAEQSRAST

SEQ ID NO: 137677 - protein, 86 aa, Glycine max
  Coding DNA Sequence Number=SeqID_45992
STLEDPQLGLAMAHEHRIADEYAQVYAEKEARGRVIDSLHQEATMWMDRFALTLNGSQELPRLLAKAKAMADTYSTPEEIHGLLGY

SEQ ID NO: 137678 - protein, 60 aa, Glycine max
  Coding DNA Sequence Number=SeqID_45993
MEVDEPWLGLWLPLNYQVDMGASFVVDLGMAFVDNWVVGKEKVGYWLSNDIVGLVGNLAV

SEQ ID NO: 137679 - protein, 340 aa, Glycine max
  Coding DNA Sequence Number=SeqID_45994
  Homolog annotation: Hit_ID=Q84VI1; Match level="QueryCoverage=92%, HitCoverage=50%, E-value=1e-154, Identity=82%"; Hit description =Envelope-like protein
VPEADEDVPTSSTPNVSVPDVEKDVPTSSGPNAEVLSSPSKERSTEEDDQATEETPAPRAPELAPGDLIDLEEVESDEEPIANRLAPGIAERLQSRKGKTPLKRSGRIKTMAQKKSTPITPTASRRSKVAIPSKKRKEISSFDSDDDVELDVSTSKRAKTSGKKTCCERELGRTALDCKEIMELIKAAGLLKTVTKLRDCYEGLVREFIVNIPSDISNRKSDDYQRVFVRGKCVRFSPAVINKYLGRPTDGVIDIDVSEHQIAKEITAKRVQHWPKKGKLSAGKLSVKYAILHRIGAANWVPTNHTSTVATDIVSTSGKAAASGAVSKDALIAELKDTCK

SEQ ID NO: 137680 - protein, 162 aa, Glycine max
  Coding DNA Sequence Number=SeqID_45995
VDPWVLEPVAFRGLHVLTFRGLHALAIRGLHALTLRGLRVLAFRGLHALAFIPGPPPDIGGGPIVRAQPGREAITQLLCIPGQDFTRAAVKRQVWIMRINMTTVATCPSAGERGRGSRVRFPKEERCAESPPTFICGKRRKNRRKLVEMKIQSSGVVFTFEE

SEQ ID NO: 137681 - protein, 103 aa, Glycine max
  Coding DNA Sequence Number=SeqID_45996
MDILTLGQEEGTVGSPKEEESLTDEPPMHFKRKRKVPDQRSEESKKKKNSQFKDWKKAKKERKFLIKDWKKTKEDIQKGLWTRQYLNNTELSQANKKRKETTT

SEQ ID NO: 137682 - protein, 48 aa, Glycine max
  Coding DNA Sequence Number=SeqID_45997
ISDVPQMKTMIQREWRKESAFPVTRNVIDSDSKCPFASLMVSPFEEII

SEQ ID NO: 137683 - protein, 259 aa, Glycine max
  Coding DNA Sequence Number=SeqID_45998
MAKFDPEVVLEFYANAWPTEEGVRDMRSWVRGQWIPFDADAIGQLLGYPLVLKEGQECEYGQRRNRSDGFDEEAIAQLLCMVPTRHPLDPDKSNRALGFPALITGLCQSFGVPVTPTKVIRPPITRAFIEKYCTQRQAQGDAPQAAGAPPPPHQAGPAGSFDMEQYLRHLVRQQAANHRAHVQTHDCLYQPSLSMQSQGFASFSCPTPDQFRAEVAWPRDWPEAQAGEAPPEAPGDGEEAHEDEEMADLLDFLGGSGAT

SEQ ID NO: 137684 - protein, 127 aa, Glycine max
  Coding DNA Sequence Number=SeqID_45999
  Homolog annotation: Hit_ID=Q6UUU1; Match level="QueryCoverage=76%, HitCoverage=89%, E-value=2e-28, Identity=54%"; Hit description =Putative uncharacterized protein
GKPVVPAALMNRPTRGERRFAYWALAECILAYYVGTDEGVSEVLHVAREKRLHRCVSKICDTRYIPLPRSLTRYARSFDCGSAPLTNITKSDAQINGGETRQDYQDTKHLPLAAPSCALQFQLFGLQ

SEQ ID NO: 137685 - protein, 193 aa, Glycine max
  Coding DNA Sequence Number=SeqID_46000
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=1e-22, Identity=94%"; Hit description=LacZ protein
MCPGRMWNGESRSADRLGTLTDADCDGGPSPGLLICSWKTSSSRLWMDARPWRASAPARCHPSNSCSPGDPLVLERPPPRWSSNSPYSESYYNSLAVVLQRRDWENPGVTQLNRLATHPPFASWRNTEEARTDRPSQQLRTLNGEWDAPCSGALSAAGVVVTRSVTATLASADVRRCFCRYSPPRQYLNRRDS

SEQ ID NO: 137686 - protein, 117 aa, Glycine max
  Coding DNA Sequence Number=SeqID_46001
  Subcellular localization annotation: CTP_CleavageSite=47; ConfidenceScore=5.52e-01
MTVLQIQISTWMPSPFTTQVFPTSLKGPTLTWYKGLPPWSIDSFSTLAQHFRSAPLSETTQGFGRASSTSGGIHPNGVVYFLQPDALYGVEKGRPHETYLIEAVPESNKNENAVTRK

SEQ ID NO: 137687 - protein, 66 aa, Glycine max
  Coding DNA Sequence Number=SeqID_46002
MVIRTFRQPGENEPIDAQRLKSSSAPFVIQGQRVKWQAKIPYGHPHLSSTEANEFDGIRMMLVVRF

SEQ ID NO: 137688 - protein, 140 aa, Glycine max
  Coding DNA Sequence Number=SeqID_46003
HALRRPYRTRARARVMGEAEEVQEKMKADMGAMKEQMATIMEAIISMKKTMEANAVAIAATSVVAKETHEIPHHNLADFEPWLGYATEGQAVGGIPFGNTLEGPQFRPQPQPLHFCGGKNPHDYGRNGKVGSSRGKAQGH

SEQ ID NO: 137689 - protein, 19 aa, Glycine max
  Coding DNA Sequence Number=SeqID_46004
SSHSTSLEPKSKLTINLDP

SEQ ID NO: 137690 - protein, 95 aa, Glycine max
  Coding DNA Sequence Number=SeqID_46005
  Gene Ontology: Mol. function=RNA-directed DNA polymerase activity; Biological process=RNA-dependent DNA replication
  Homolog annotation: Hit_ID=A3BZ28; Match level="QueryCoverage=49%, HitCoverage=20%, E-value=5e-09, Identity=57%"; Hit description =Putative uncharacterized protein
MEDLERSRHHQPPYSSQGSDDDYEEGKRHMHRRNKDGMDDVKVKIPTFLEFEGYALVWWNQIQVDRERLRRHRVDTWVVMKRIMRKRFVPLHYVR

SEQ ID NO: 137691 - protein, 100 aa, Glycine max
  Coding DNA Sequence Number=SeqID_46006
  Subcellular localization annotation: CTP_CleavageSite=50; ConfidenceScore=5.37e-01
TYQGNPCGVYPDLSSFTGSGVYPDLSSFTGSGVYPDLSSFTGSGVYPDLSSFTGSSVYPDLSSFTGSGVIQTSVACIKRSAPKIHIITYDHLNFSKDSIV

SEQ ID NO: 137692 - protein, 154 aa, Glycine max
  Coding DNA Sequence Number=SeqID_46007
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MRQNLHLRSPIVNNQTTTLSEKEKMRIFFIYSVISPGDPLVLERPPPRWSSNSPYSESYYNSLAVVLQRRDWENPGVTQLNRLAAHPPFASWRNSEEARTDRPSQQLRSLNGEWDALCSGALSAAGVVVTRSVTATLASADVRRCFCRYAPPRQ

SEQ ID NO: 137693 - protein, 178 aa, Glycine max
  Coding DNA Sequence Number=SeqID_46008
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=75%, E-value=2e-24, Identity=68%"; Hit description=LacZ protein
  Subcellular localization annotation: CTP_CleavageSite=32; ConfidenceScore=5.14e-01
MTMITPSSKLTLTKGNKSWYRAPPRGRRLLLLQSRRWQVMYLLLHPSSVHLLQISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137694 - protein, 139 aa, Glycine max
  Coding DNA Sequence Number=SeqID_46009
MRPKLMSSAKERLWPGGCEHATAAGHAAQPRDIGYLGRQRADVGGFFLPFAWRRIPPWNCVVVLVWKRNRSNYRGGLVDKPSRGRHVLQRFGPARPTRLDGINRSPSMIGKRVGFYVGSVLLKGQPSGFYQTLDLVLKG

SEQ ID NO: 137695 - protein, 288 aa, Glycine max
  Coding DNA Sequence Number=SeqID_46010
MAKFDPDIVLEFYANAWPTEEGVRDMRSWVRGQWISFDADAISQLLGYPLVLEEGEECEYGQRRNQSDGFDKEAIAHLLCIPGQDFARTAAGRRVRIMRTNMTTLTQIWMTLLLSNIQSSDHNSDLPLLKCQLVYAILTRMSIHVAQLIADAIYLFAGMAPTRHPLDPDKSNRALGFPALITGLCQSFGVPVAPSKSSICGIWFASRRPTTGLMYKLMIIFYQMSLSLQSQGFTYFPCLTPDQFRAEVAWPEARAGEAPAEAPDEADEALEDEEMTDLLDFLGGSGAT

SEQ ID NO: 137696 - protein, 317 aa, Glycine max
  Coding DNA Sequence Number=SeqID_46011
  Homolog annotation: Hit_ID=Q2HW90; Match level="QueryCoverage=67%, HitCoverage=40%, E-value=2e-24, Identity=35%"; Hit description =Putative uncharacterized protein
MASQEKWVPFADILALLIFGVVLFPNVDGLVDLAAIDAFLAYHHSKESPVVAILADLFDTFDRRCEKNSARIVCCLPALCVWLVSHLFQQDIRRPCPLQSYRSCVEKRRVDWDQHLAGIGGSTINWFPRWKEGKEGVLFSCGDYPNVPLIGMRGCINYNPALATRQLGYPMRGAPMEESLSPFLVRDFGAQSLKVIQRVHKAWRSPLRKDKELRGIRNGVIGGYHGWLRVHTRGLDWLSKLKVINEENFETPEEDEEVQALKLELGKARLAKEKFKSAATNIRKECTELREENAATARALEQETKRARKEEHGREKF

SEQ ID NO: 137697 - protein, 130 aa, Glycine max
  Coding DNA Sequence Number=SeqID_46012
MWIVCQRKSPRLVAIGRLYKGSATVHNISLCNDQVKVGVEEVRDVDAPILGAMEPVKPAVRSDHDVNDTLYLMTLTIPQLFLKLLHVMWDATVFGVFNDNFSLYIKHEDLSKIAHSGQCLSIYVIQLWIL

SEQ ID NO: 137698 - protein, 35 aa, Glycine max
  Coding DNA Sequence Number=SeqID_46013
MAGSTTTSSIEYNRANDGFIFVDRIEHIGCEPEVN

SEQ ID NO: 137699 - protein, 117 aa, Glycine max
  Coding DNA Sequence Number=SeqID_46014
  Gene Ontology: Mol. function=hydrogen ion transmembrane transporter activity; Cellular component=proton-transporting two-sector ATPase complex; Biological process=transcription termination
  Homolog annotation: Hit_ID=P0AG32; Match level="QueryCoverage=79%, HitCoverage=22%, E-value=4e-45, Identity=98%"; Hit description =Transcription termination factor rho
  Pfam annotation: Domain name=Rho_N; Domain location=29-71; Score =75.9; E_value=1.3e-19; Accession=PF07498.3; Description=Rho termination factor, N-terminal domai
  Pfam annotation: Domain name=Rho_RNA_bind; Domain location=73-117; Score=70.0; E_value=7.7e-18; Accession=PF07497.3; Description=Rho termination factor, RNA-binding doma
  Pfam module annotation: Pfam domain module=Rho_N::Rho_RNA_bind; Domain location=29-71::73-117
MDDPAIPFTTLSSRITPSLRTHTIMNLTELKNTPVSELITLGENMGLENQARMRKQDIIFAILKQHAKSGEDIFGDGVLEILQDGFGFLRSADSSYLAGPDDIYVSPSQIRRFNLRT

SEQ ID NO: 137700 - protein, 76 aa, Glycine max
  Coding DNA Sequence Number=SeqID_46015
MQGAGSTHQSHHREDGAGTADQKALRSGIDDGEAAEQEDEAAEEEVEAAEEEEEAAEEEEDAAEDTESDDDSEATP

SEQ ID NO: 137701 - protein, 145 aa, Glycine max
  Coding DNA Sequence Number=SeqID_46016
MVKVGTSYVPINVSFSPKVGPGNFPVSSGSSQDYSPFIAERLASQYLIDTVDLEGGKCKAGVPRAELTHLTPLPLRSTAPLYGKRCRHSLHSRAAQLARRDDRAGFAYYASGERAECATAINVGVTPGCSVRSVMWQKKRRPVNM

SEQ ID NO: 137702 - protein, 285 aa, Glycine max
  Coding DNA Sequence Number=SeqID_46017
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDLLYLLPWSLDEGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137703 - protein, 53 aa, Glycine max
  Coding DNA Sequence Number=SeqID_46018
  Homolog annotation: Hit_ID=A5BEG7; Match level="QueryCoverage=96%, HitCoverage=7%, E-value=3e-07, Identity=50%"; Hit description =Putative uncharacterized protein
AKLLAMRAEFPQVANWLDQIPKSKWTQTYDEGKRYDHMTTNLVECMNSVLKGA

SEQ ID NO: 137704 - protein, 432 aa, Glycine max
  Coding DNA Sequence Number=SeqID_46019
  Homolog annotation: Hit_ID=Q6WAY4; Match level="QueryCoverage=91%, HitCoverage=70%, E-value=7e-23, Identity=27%"; Hit description =Putative uncharacterized protein
MDRMKQTRNGVVGLPRKYLEGKARDMASQEKWGPFADILALLIFGVVLFPSVDGLVDLAAIDAFLAYHHSKESPVVAILADLFDTFDRRCEKNSARIVCCLPVLCVWLFSHLFQQDIRHPCPLQSYRSCAEKGRVDWDQHLAGIRGNTINWFPHWKEGKEGVLFSCGDYPNVPLMGTRGCINYNPALAHKTARVPHEGSANRRMSLAFPCEGSRRAKSQGDTKSPQGVEKSVRKDKELRGIRNGAIGGYHGWLRVHTRGLDWLSKLKVINEENFEAPEEDEEVQALKLELGKARLAKEKFKSSATHIRKECTELQEENAATARALEQETKKARKEEHGREKFRGALWGSNNELKLRREERDRSRVHGMILKEELAACARSKRSLAQHLEATEQSMLAIIGQYKEELNQSVTHEQKLAKDFAQVYAEKEARGR

SEQ ID NO: 137705 - protein, 135 aa, Glycine max
  Coding DNA Sequence Number=SeqID_46020
GPLDESISCFLIRVDPWVLVPITLRGLHVLAIRGLHVLNLRGLHVLAIRGPHVLALRGLHALTSRGLHVLALRGLHALTLVTLTVERTTRPRLERTTRPRLERTTRPHHQRVARPHLQRTTCPRLERATRPHLGH

SEQ ID NO: 137706 - protein, 147 aa, Glycine max
  Coding DNA Sequence Number=SeqID_46021
  Gene Ontology: Mol. function=protein dimerization activity
  Homolog annotation: Hit_ID=A5C1A1; Match level="QueryCoverage=87%, HitCoverage=27%, E-value=3e-27, Identity=46%"; Hit description =Putative uncharacterized protein
MKILAKLHLYKISVEHFGSDFAMAQRKTHSPRCERNWSVFEQIHSKKRNRLEHKRLHDLVFVKYNQQLKQRYNARDEIDPISLNDIDVCNEWLVGEMDEDDDNDAGNDLVFEDDDALNWTTVYQASGVGEPQPSLSTLHYVFILFLF

SEQ ID NO: 137707 - protein, 269 aa, Glycine max
  Coding DNA Sequence Number=SeqID_46022
  Homolog annotation: Hit_ID=Q84VH5; Match level="QueryCoverage=59%, HitCoverage=27%, E-value=5e-78, Identity=81%"; Hit description =Envelope-like protein
HQIAKEITAKRVQHWPKKGKLSAGKLSVKYAILHRIGAANWVPTNHTSTVATESFAIKLPIAFPTVLCGIMLSQHPNMLNYTDSVMKRESPLSLHYKLFEGTHVPDIVSTSGKAASGAVSKDALIAELKDTCKVLEATIKATTEKKMELERLIERLTDSGIDDGEAAEEEEDPAEQEEAAEEEGEAAEEEEEAAEEEEDAAEETESDDDSEVECMMYSSRIVGYDVCMIHDLEGELYEYDFEGETAADDDCCKLLEDAAGEQKQKADVM

SEQ ID NO: 137708 - protein, 104 aa, Glycine max
  Coding DNA Sequence Number=SeqID_46023
MTVHPEEPACTLQQPVEWILHTPSPYRLVEPVQVIEVSSSQEDPEEDPEELPPEPVVDALDLPEDDEDPLLNVDFPEDIMSTSEADSTEENGPGGTANSDDSSS

SEQ ID NO: 137709 - protein, 327 aa, Glycine max
  Coding DNA Sequence Number=SeqID_46024
MRIFLSFDKFLPQHAPFISREVGPAWFTDYFPAVDPDNEEEVNEIWSFYLNPQILSCRTGVQSNYLGLVGYQPNLVSRQFGLSQIRPKSLFEDPRDVIRGANLSEKTFKKFLKISLDENYNLHPFEFNHSHFCTMGFVTWWEKYYSTRSIGDTTIMISRLESGFTQPTVENIRSNLQAQGKTIMTKKSTETSRADVRPKKPTGVKIQEGKQEEKEEEERPLIRKRKLPSTSTKSAEQAETGNSQAQMPKKKKKVKQVESEPSVAVEGGEPIKKKKKKIRPSKNQGDNQTVDVQPPSTNIDGTEVEATPSVAEMGNPVDQSDSRGSSR

SEQ ID NO: 137710 - protein, 88 aa, Glycine max
  Coding DNA Sequence Number=SeqID_46025
MTHRGLKKKHDRMTPIEHFPIAVSDEDMTKSKGKDPLEGLGGPMTRARARKAKEALQQVLSILFEYKPKFQGEKSKVVSCIMAQMEED

SEQ ID NO: 137711 - protein, 209 aa, Glycine max
  Coding DNA Sequence Number=SeqID_46026
  Homolog annotation: Hit_ID=Q2HW90; Match level="QueryCoverage=92%, HitCoverage=39%, E-value=1e-22, Identity=34%"; Hit description =Putative uncharacterized protein
MGHLQMQAFRKAYEKILDLAIAEISIEAVVSLTQYYDQPLRCFMFGDFQLVPTVEEFEEILGCPLGGRKPYLFSGFLPSLSKIADVVRDSARGLDRVKQTRNAVVGLPQKYLEGKARDMENQEEWVPFMDVLALLIFGVVLFPNMDGLVDLDAIDAFLAYHHSKESPVVVILADLFDTFDRRCEKSSAQIICCLPTFVYGWFRTYSNKT

SEQ ID NO: 137712 - protein, 69 aa, Glycine max
  Coding DNA Sequence Number=SeqID_46027
MTPVNRKAGTGERTREPPGGNAWGAEPMEKRLCRGPVLFPRDLRLFQVPEWRNAGSPVAQAQLTGGVSG

SEQ ID NO: 137713 - protein, 89 aa, Glycine max
  Coding DNA Sequence Number=SeqID_46028
MLTLPFISNSFHKQFQHINITSIIIKTLKLNGNLARLPIISPKAPYPRKSKEKEVHPNLKFRSPTRRHALHDSGNALLLRFGAEMGTKG

SEQ ID NO: 137714 - protein, 142 aa, Glycine max
  Coding DNA Sequence Number=SeqID_46029
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MYHVIAEEFHFFKHIMLIVSCIYPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137715 - protein, 91 aa, Glycine max
  Coding DNA Sequence Number=SeqID_46030
  Homolog annotation: Hit_ID=A5B6M5; Match level="QueryCoverage=90%, HitCoverage=9%, E-value=5e-14, Identity=44%"; Hit description =Putative uncharacterized protein
MDIAQCQTYSCLKEKFISIGQLGDERHHTTFRDGAWKVTKDNLVVARGKKQGSLYMIADEDMVAVTEGKLSSLKHVDVGACEHCILGKQKK

SEQ ID NO: 137716 - protein, 48 aa, Glycine max
  Coding DNA Sequence Number=SeqID_46031
MTQVGRKISIQKKKRELEGGLVSSLEESESRRKGPKTLRAIGLRSTPN

SEQ ID NO: 137717 - protein, 256 aa, Glycine max
  Coding DNA Sequence Number=SeqID_46032
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSITVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137718 - protein, 172 aa, Glycine max
  Coding DNA Sequence Number=SeqID_46033
  Homolog annotation: Hit_ID=A5AZ88; Match level="QueryCoverage=59%, HitCoverage=9%, E-value=7e-07, Identity=36%"; Hit description =Putative uncharacterized protein
MEKGLSHGSVPIILGRPFMKIARTKIDVYVGTLSMEFGDIVVHFNILDAMKHPSEDHSVFRAEIIDQIVDDYMFDFDFILHESKFEFESGSNFLGVVPLDVDFLDSECTNHVARSTYTSDLLYEVQAEEPPSSPTLVPPTVQTPPTPELKPSKCLLGGQGKISSDHLCLPCC

SEQ ID NO: 137719 - protein, 54 aa, Glycine max
  Coding DNA Sequence Number=SeqID_46034
MACLDQQHSGRKGQAVVVVGDLSISDLDDSSNLDCICCLKDHNYSTVHKLQVAH

SEQ ID NO: 137720 - protein, 190 aa, Glycine max
  Coding DNA Sequence Number=SeqID_46035
MEFGDIVVHFNILDAMKHPSEDHSIFCVEIIDQIVDDYMFDFDSVLHGRKHPFLSNLYTYHSLCIESESEFEFDPVSDFYAENESEFESGSDFLGAVPLDVDFLELECTNHVAGSTYTSDLLYEVPPTVQPQPTPELKPLPATLKYAYLEDKEKFPVIISASHAAEKEEKLLLVLKKHKKAIGWTLANIL

SEQ ID NO: 137721 - protein, 181 aa, Glycine max
  Coding DNA Sequence Number=SeqID_46036
  Gene Ontology: Mol. function=aspartic-type endopeptidase activity; Cellular component=small subunit processome; Biological process=DNA integration
  Homolog annotation: Hit_ID=A5ARL5; Match level="QueryCoverage=99%, HitCoverage=12%, E-value=8e-20, Identity=32%"; Hit description =Putative uncharacterized protein
MGYTQENCYSLHGSPEKVAQVSKSEKPESGFSNEKYQEYLRLKSEKSSNQASSSSAPCFSTACVSQFIGSPSPWILDSNASDHISGNKSSFSSISFSKVPHLVTVANGSKVTSQGSGQEHETGRLIGKGRESQGFYYLESSFPVSCFASSKPKLLQDRLGHPSLPKLKMMIPSLKNLRVLD

SEQ ID NO: 137722 - protein, 46 aa, Glycine max
  Coding DNA Sequence Number=SeqID_46037
MGLKAETNQGTYGRMQVEARVTIIDRHLMPSTGPAGSATRRQPSNF

SEQ ID NO: 137723 - protein, 144 aa, Glycine max
  Coding DNA Sequence Number=SeqID_46038
GVAPPGCPLNPLALPPIELARGLPAIPEGNFGGNQLLDGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPYFDRDT

SEQ ID NO: 137724 - protein, 19 aa, Glycine max
  Coding DNA Sequence Number=SeqID_46039
STLEDPRMMSIRKCSIGVT

SEQ ID NO: 137725 - protein, 65 aa, Glycine max
  Coding DNA Sequence Number=SeqID_46040
MTLGAEFNVESLTCRDWNTSSKVSQKICVRFCARKKMTTYISTKFSRFKKLGLGFDMLMKDRDTG

SEQ ID NO: 137726 - protein, 46 aa, Glycine max
  Coding DNA Sequence Number=SeqID_46041
MAGILFLLKQQNSLEITSVIILGTPQDGPFQILERINNNAYRLDFP

SEQ ID NO: 137727 - protein, 115 aa, Glycine max
  Coding DNA Sequence Number=SeqID_46042
MAHENPRAFPWIFGPIFLESSIQCPCGVGLHHNPLEIFHSLCKIPFTKSEPHRDNPFLVFRNPLQQESHGLLIPFQKQEEEKKKSLLKEIDCTMKINQNSLLNMQVVDQGIFLRG

SEQ ID NO: 137728 - protein, 252 aa, Glycine max
  Coding DNA Sequence Number=SeqID_46043
  Gene Ontology: Mol. function=oxidoreductase activity; Cellular component=cytoplasm; Biological process=metabolic process
  Homolog annotation: Hit_ID=A7MKN5; Match level="QueryCoverage=100%, HitCoverage=100%, E-value=8e-91, Identity=67%"; Hit description =Putative uncharacterized protein
  Pfam annotation: Domain name=KR; Domain location=7-193; Score=-65.6; E_value=0.0016; Accession=PF08659.1; Description=KR domain
  Pfam annotation: Domain name=adh_short; Domain location=4-176; Score =79.2; E_value=1.3e-20; Accession=PF00106.16; Description=short chain dehydrogenase
  Pfam module annotation: Pfam domain module=KR::adh_short; Domain location=7-193::4-176
MSHKIALITGGNRGLGKNGALKLAAKGVDILFTWRGHAEEAQAVVKEIEALGARAVALQLDVGDSKQFDDFAARVKATLNETWQRHSFDYFVNNAGHGHYKLLAETSEDEFDALVNVHFKGPYFLTQKLLPLIADGGRILNISSGLTRMTLPGSGTYAAMKGAMEVLTRYQAKELGERHIRVNILAPGAIETDFGGGRVRDTKDLNAHIASVTALGRVGLPDDIGDAISAILSDETGWITAQRIEASGGQAL

SEQ ID NO: 137729 - protein, 293 aa, Glycine max
  Coding DNA Sequence Number=SeqID_46044
  Gene Ontology: Mol. function=transcription factor activity; Cellular component=cytoplasm; Biological process=branched chain family amino acid biosynthetic process
  Homolog annotation: Hit_ID=A8GL55; Match level="QueryCoverage=100%, HitCoverage=96%, E-value=1e-112, Identity=69%"; Hit description =Transcriptional regulator, LysR family
  Pfam annotation: Domain name=HTH_1; Domain location=3-62; Score=80.3; E_value=6.2e-21; Accession=PF00126.18; Description=Bacterial regulatory helix-turn-helix protein, lysR family
  Pfam annotation: Domain name=LysR_substrate; Domain location=86-293; Score=124.7; E_value=2.6e-34; Accession=PF03466.11; Description=LysR substrate binding domain
  Pfam module annotation: Pfam domain module=HTH_1::LysR_substrate; Domain location=3-62::86-293
MDLRDLKLFLHLAESCHFGRTARAMHVSPSTLSRQIQRLEEDVGHALFLRDNRTVTLTEAGERLRQFAQQTLLQYQQLRHVMDLNGPSLSGELRLFCSVTAAYSHLPPILDRFRAEHPQVEIKLTTGDAADAIEMVQSGEADLAIAGRPESLPASIDFTPLGLIPLVLIAPALPCPVRSQATQEQPDWSQIPFILPDQGPARRGIDVWFRRHRIANPQIYATVSGHEAIVSMVALGCGIALLPDVVLENSPEPVRNRVLTLENVESVAPLELGVCVQKKRLGEPLINAFWHLL

SEQ ID NO: 137730 - protein, 53 aa, Glycine max
  Coding DNA Sequence Number=SeqID_46045
MEVTSPRVLDTRLQEDWVRAAKQDRRVLMNLRESSQGSFSRKLLKEVSLVLRG

SEQ ID NO: 137731 - protein, 158 aa, Glycine max
  Coding DNA Sequence Number=SeqID_46046
  Homolog annotation: Hit_ID=Q6WAY6; Match level="QueryCoverage=54%, HitCoverage=15%, E-value=1e-07, Identity=37%"; Hit description =Putative uncharacterized protein
MGTRGCINYNLVLAIRQLGYPMRGAPLGEELAPIIAQGFNSTNAEALQKVRKAWEMVQKKDEELRGSSNGPIGGYRRWLKAYIQGLDWLPSLRTTKGVEVEALEEDEEVQALRAELENAQTVKEKFKSAALKIRKENAELRDVNIATTKALEQETKRA

SEQ ID NO: 137732 - protein, 104 aa, Glycine max
  Coding DNA Sequence Number=SeqID_46047
MAKFDPEVVLEFYANAWPTKEGVRDMRSWVRGQWIPFDADALSQFLGDPLVLEEGQECEFSQRRNRADGFDEEAIAQLLCTSGQDFTQTAAGRRVRIMRTSMTT

SEQ ID NO: 137733 - protein, 60 aa, Glycine max
  Coding DNA Sequence Number=SeqID_46048
MTKARQKGVRKGKDGGGYHPSRYGKMEVVTTQASWVASTRRHRLLLEGPSGPDCYLYPPV

SEQ ID NO: 137734 - protein, 110 aa, Glycine max
  Coding DNA Sequence Number=SeqID_46049
MNFATRKPVEFTPIPVSYADLLPCLLDNSMVAITPTKVHKPPFLREYDSNAMCACHGEAPGRSIEHCRALKRKVQGFSTFTGSGCKPLVSLLKRPMLLSLGLPRPLVGVP

SEQ ID NO: 137735 - protein, 155 aa, Glycine max
  Coding DNA Sequence Number=SeqID_46050
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
MSRRTPSGLQRHDRIGSDCIGGRAGCAVPDRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137736 - protein, 83 aa, Glycine max
  Coding DNA Sequence Number=SeqID_46051
MAYHGFYQLFPVQLLRELVIRVNRQQALQPEHQRAKKKATASEYVIRLTIGANCELHRSVDAAALKWPLHGLRNSILDARKTT

SEQ ID NO: 137737 - protein, 149 aa, Glycine max
  Coding DNA Sequence Number=SeqID_46052
MAKFDPEIVLEFYANAWPIEEGVQDMRSWVRGQWIPFDADALSQFLGDPLVLEEGQECEFNQRRNRADGFDEEAIAQLLCIPGQDFARPLQGGGDHNSDLPLPKCQLVYAILTRMSIHVAQLIADAIYLFAGMPPTRHPLDPDKSDRAL

SEQ ID NO: 137738 - protein, 157 aa, Glycine max
  Coding DNA Sequence Number=SeqID_46053
VLMDGHKERLGSRPIGRHPLPSPGQEENAAARQPISERRPIEGHAYVFPKKKVQVSSPGRAELAWASNPCTKMVSQHALLRASEARLTGALSKGGKMRGVATNEGISTSHVDKSGALAPTYPLSKRKSDLRSPSMVIFHHGDAAEGKGEEEKGGAIH

SEQ ID NO: 137739 - protein, 101 aa, Glycine max
  Coding DNA Sequence Number=SeqID_46054
  Subcellular localization annotation: CTP_CleavageSite=18; ConfidenceScore=5.06e-01
AKDHFGAVATRPGELKLSAKAMSSPRRVGFFTIKLFSGPGELEASLGEVGSRKTKKKTLLSPFFLVFFAFLVKTLNDHLFRTVIDIQHHKSTSKDQKINER

SEQ ID NO: 137740 - protein, 163 aa, Glycine max
  Coding DNA Sequence Number=SeqID_46055
  Subcellular localization annotation: CTP_CleavageSite=48; ConfidenceScore=5.18e-01
SHAFALKPYSIACNHPTNRFKGSSKNRPLCAHCEVKKHFSSSEPPHKVAQQVSVDMSHSPSSSGDSGSQFQLTAQQYSQLMNLLESHATNVVIPQGVSSASDSGASIYISCSLHLFDLTNLVSDKTVTLPNNDVIPIVAIGSKQACKRIGRGALIQGPLCLRS

SEQ ID NO: 137741 - protein, 254 aa, Glycine max
  Coding DNA Sequence Number=SeqID_46056
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSMSTQMSPNIVEEEEADDVHANLGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137742 - protein, 359 aa, Glycine max
  Coding DNA Sequence Number=SeqID_46057
  Pfam annotation: Domain name=Transposase_23; Domain location=139-209; Score=-4.2; E_value=0.0034; Accession=PF03017.5; Description =TNP1ENSPM transposase
DSFEEQATQGSFVPHRRQDVLAAAIGRPEHPGCVHAAGSGVTINQYFGSAPRTSHSASSLPPDELQQLTKQIRDQLEESIIQNVTRQVMASFSHLQSQLQSQMQSQGLAVPPEPLVGPSGPRVSTKGSCVDPSGNDPETGDSDRCGLYIEADPARLVAMGRFYEGSTVVHNAPLLLGQVKVSVEEVTDADASVPVPTDEVSLEGQALYTFLAWPTHLVKSLSQQVAVSPAKPPPKPDPEVDDPLYLMRLTIPELFLRPYQVRWDATVFGVFNPDFPLYIKHEDLYEIAHGGQCLSISVLQLWILNLTETCMRVGNSNIYGFLEPQSIQRSGQSQFESESYIKSWMQSSQRDVYLGAYLN

SEQ ID NO: 137743 - protein, 82 aa, Glycine max
  Coding DNA Sequence Number=SeqID_46058
MPLGGRIASVPLPTPTLETKKTDKGFEFVLIPGHKEECRKAWETQQLSNLGPSRGFWAFPCLRWKQPSSPGRAGRQPPPPFC

SEQ ID NO: 137744 - protein, 212 aa, Glycine max
  Coding DNA Sequence Number=SeqID_46059
MGEAEEVQEKMKAEMEAMKEKMATMMEAMMSMKKIMEANAVIVAATSVVAKVNPMLPSGLKQMNHPTSNMVGKDLGSTDDPMMCKFKTSTPSRHMACLPNYTPPNVAYIPNEDVNNSTPILIKSQQPQSDHAHVSRPMEETHGMPYHNLADFEPWLGYATEGQAVGGIPFETLWRALSFAHNHTIAFCGGKSPSCYGRKGKGGSSKGKAHGH

SEQ ID NO: 137745 - protein, 98 aa, Glycine max
  Coding DNA Sequence Number=SeqID_46060
  Subcellular localization annotation: CTP_CleavageSite=75; ConfidenceScore=5.26e-01
LSSCQYEIVIRVTIRHTSTTSRKHQRASVKPGVPKSERNSPLMPSALNCAALQGNAVAIAAFRMTPTVREGRSVRAFALLRQLALKGGCVQRRLLCWH

SEQ ID NO: 137746 - protein, 117 aa, Glycine max
  Coding DNA Sequence Number=SeqID_46061
MGNFMCLPHGLRDMYMMRLLALNEYGSGVIDILIGSVCHIGWCIVGRQAIWPDGGIGFTLATVMVAATATALASIIYFMLIMASNIVAICSFMASMSAFICSCASSTSPITLALAQV

SEQ ID NO: 137747 - protein, 206 aa, Glycine max
  Coding DNA Sequence Number=SeqID_46062
MGDQEETQEQMKANMSALKEQMASMMEAMLGIRQLMEKNVATAAAVSSAAETDPTLLATVHHPPSNIVGRGRDTLGHDGNPHLGYNRAAYPYGLPPNYSPPVLQDDAGHIASPVLEREPPQQPDEVHKDPQDYARRDVEFYPPIPEGPAPSTLPQPNITTQSIVLSTEGPPPTTEERRKLDLLEERLRAVEGFGDYPFADMTDLCL

SEQ ID NO: 137748 - protein, 140 aa, Glycine max
  Coding DNA Sequence Number=SeqID_46063
  Homolog annotation: Hit_ID=Q6UUU1; Match level="QueryCoverage=42%, HitCoverage=40%, E-value=1e-18, Identity=78%"; Hit description =Putative uncharacterized protein
MSLPLNFITELGITAGIEVSRTQIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137749 - protein, 138 aa, Glycine max
  Coding DNA Sequence Number=SeqID_46064
MEVNFKRIIYRDARNLTTEALEKFKLVITFHTDVRFRPHNMSTRSKFNNGGSRQIQMVITFTRRSDSGAYYMETLKIEQWKLSKNSNGYNFSHGCPIWTHNWSRRTKLNNGSSREIQMVITFNSEVGFKSILYRDTRN

SEQ ID NO: 137750 - protein, 24 aa, Glycine max
  Coding DNA Sequence Number=SeqID_46065
MEVGFVVDLGMAFVDKWVVGKEKG

SEQ ID NO: 137751 - protein, 70 aa, Glycine max
  Coding DNA Sequence Number=SeqID_46066
MVRVLLEILIPGDRCRTGCHDITLQNMQIRIVNPVRCNLTYIWGLPSQGGDPLSIVLVQGLTAPVYNLLT

SEQ ID NO: 137752 - protein, 131 aa, Glycine max
  Coding DNA Sequence Number=SeqID_46067
MVRSQDKLITEINQGKTMTGHDRPQILFPTGRNIGTNASGDRVTTDRSLPLPGVKQAENMVSSPGRAELAWASNPCTQIIKMREGNVLASKNFPPPPHSKERTRRLAVLAPSSHFRLPFAFIFGVIIHSNK

SEQ ID NO: 137753 - protein, 160 aa, Glycine max
  Coding DNA Sequence Number=SeqID_46068
  Pfam annotation: Domain name=Transposase_23; Domain location=37-107; Score=0.6; E_value=0.001; Accession=PF03017.5; Description=TNP1ENSPM transposase
MQSQGLALPLEPEVGPLAACVSTKGSCVDPSPTDPKTGDSDKCGLYIEENPSRLVVLGKVYEGSTVVHNIPLLHGHVKVGVEKVKDAEAPVPVPIDEVQLVGQALNTFLAWPTYLVKRVLEQATVSPSKPPDRPDPEVNDPLYVMTLTIPQLFLKPLYVM

SEQ ID NO: 137754 - protein, 297 aa, Glycine max
  Coding DNA Sequence Number=SeqID_46069
  Gene Ontology: Mol. function=transporter activity; Cellular component= outer membrane-bounded periplasmic space; Biological process=sulfur metabolic process
  Homolog annotation: Hit_ID=A6TD71; Match level="QueryCoverage=56%, HitCoverage=53%, E-value=6e-75, Identity=80%"; Hit description =Putative ABC-type transport protein
GSDVNYLLVKALEDAGLNYKDVTPVYLPPADARAAFQKGAIDAWVIWDPYLAEVEANAGAREVRNAEGLVPHYTFYLASRPFAENHPQTAKQVVDELSKLSDWANQHQDEAAAILAKSTGLDKSIWQTTLQRLPYGASRMSPQVFAEQQALADTFTRVGLLPVKVDVRSATSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137755 - protein, 41 aa, Glycine max
  Coding DNA Sequence Number=SeqID_46070
  Homolog annotation: Hit_ID=Q1S5K3; Match level="QueryCoverage=100%, HitCoverage=9%, E-value=9e-09, Identity=63%"; Hit description =Ribonuclease H
MAEYEECALGIQAAIDFKVKLLKVYGDSALVIHQLRGKWET

SEQ ID NO: 137756 - protein, 73 aa, Glycine max
  Coding DNA Sequence Number=SeqID_46071
MSVTHVHVVFLDALHDLSQSGSYAWGAAALVHMYDHLNDACVTTCMSVDCYEGDFEVHNYSDVEAASGSTQDF

SEQ ID NO: 137757 - protein, 85 aa, Glycine max
  Coding DNA Sequence Number=SeqID_46072
MVGYTPSSFTDLVFASERIKVGLKRGKFNHPAWTTEKTGANEEGENKGETHAVTVIPTWPNFPPAQQCRYSANNNPSPYPPPSYP

SEQ ID NO: 137758 - protein, 177 aa, Glycine max
  Coding DNA Sequence Number=SeqID_46073
VAHAWRITAAGAASGIVRCAGQQDRRVAGALGHHDHRIQLGAVTHRHHHHALVVIATDIRGNEGLAADVRGHRRGIGGQHGAGQAKGNGYSDGTHTHGQPLPAGKPQAYSCPEPTDGTCAARRARIHLAVVEPSPRSAGATATSPKSSRAWARLYNIRLPLLHATPANVHGRLPAAA

SEQ ID NO: 137759 - protein, 172 aa, Glycine max
  Coding DNA Sequence Number=SeqID_46074
  Homolog annotation: Hit_ID=A5BSR3; Match level="QueryCoverage=56%, HitCoverage=31%, E-value=2e-08, Identity=35%"; Hit description =Putative uncharacterized protein
MYATLQGIRKRAQSIQKHNNCPHLLSRGGYDLLEKKLLDEKRKRLEEEALLTENPASVNDPPSPIKRHVKWKVAWTRAYGNMTSESTQEIADKIDSLEEQVTQGSFVPHGRQDILNTAIGRPDHGGRVRAAGSGVTITQYYGRATRTCNNSSTSITQQQLDEVVARLREDMS

SEQ ID NO: 137760 - protein, 162 aa, Glycine max
  Coding DNA Sequence Number=SeqID_46075
  Pfam annotation: Domain name=G-patch; Domain location=39-83; Score =12.2; E_value=0.0063; Accession=PF01585.14; Description=G-patch domain
MLVSCPSSAPYVETVFQSFEVVICASVEMILLLPCLSNASLMVTRVMLRHCYEPRMGLGKDSHGNADVVDIRGNPYKYGLGYEPEKPGRRNAPSRLRADRAWPDHVSQCFTSAGIMFEEKVAAIGEESPQDPPSFVRPCHPNSQVGNWRVMSQSDAYTADSM

SEQ ID NO: 137761 - protein, 66 aa, Glycine max
  Coding DNA Sequence Number=SeqID_46076
MYGSAWASSILEGRSRLLLLLRAGPSEVRVIPPSRVVSVAGKVAAWKGKGLYGGQQRSTNHKPLRQ

SEQ ID NO: 137762 - protein, 68 aa, Glycine max
  Coding DNA Sequence Number=SeqID_46077
MEHTESGDLTVMWLRMPPVSWDTVTKSGVVDKSRAFAPTISFLNDHLEETPGPTKIGENHSKCINLTQ

SEQ ID NO: 137763 - protein, 88 aa, Glycine max
  Coding DNA Sequence Number=SeqID_46078
MEVDEPWLGLWLPLNYQVGFMVDLGMTFVDNWVVGKEKGCYWLSNDIVGLVGNLCWVGGKLGRIGMAVTAWVSPSSSPSSFTPVFSFV

SEQ ID NO: 137764 - protein, 44 aa, Glycine max
  Coding DNA Sequence Number=SeqID_46079
MTLGLQTRQSRGGGSPRRAQLAQASPARPGEPSSPRRAQLAQAS

SEQ ID NO: 137765 - protein, 107 aa, Glycine max
  Coding DNA Sequence Number=SeqID_46080
  Homolog annotation: Hit_ID=A5AIK9; Match level="QueryCoverage=95%, HitCoverage=6%, E-value=3e-11, Identity=37%"; Hit description =Putative uncharacterized protein
MAQSPPRERNLREMAAPDFTYESLCIQYPDEDVPYVLETGLIHLLPKFHGLAGEDPHKHLKEFHIVYSTMKPPGVQEDHIFLKAFSHSLEGVAKDWLHYLAPRSITS

SEQ ID NO: 137766 - protein, 48 aa, Glycine max
  Coding DNA Sequence Number=SeqID_46081
MKKILGLQAPMELTSLLFVVKEASQLWKAKLSVGSSLTSFFHAFALIT

SEQ ID NO: 137767 - protein, 154 aa, Glycine max
  Coding DNA Sequence Number=SeqID_46082
MLSEICLPKVFRNYGSITEAPENIFQKRGGACRPVASSLSNPTSKMLWKGLESNCYLHPNLDKFTPYFCIFGCFLSGMLRNFTDYATMLFLTSGMLRNFTDYLTMGVKYLEAVKRVNIVSTNKALIQDFFKIKPCLTMKGFKSFKAHVIDYQYM

SEQ ID NO: 137768 - protein, 105 aa, Glycine max
  Coding DNA Sequence Number=SeqID_46083
MFSRKEGMMRIMELTKYRLKAQTYQGNPCGVYPDLSSFIGSGVYPDLSSFTGSGVYPDLSSFIGSGVYPDLSSFTGSGVIQISVTCIKQSAPTQVHIIWYQSFGS

SEQ ID NO: 137769 - protein, 186 aa, Glycine max
  Coding DNA Sequence Number=SeqID_46084
MGDFISRLSFPACLHFSEENTETLSSLTSYPELRRSEFLIGGYVGARASLLSTIPPFVAMTQELVARGDTLRLFAPFCHPEAAGPMTSRDQVWSFCTLVSSRGGGPDDTRRYLTVIRTLLSSRGGGPDDKQRPKAAGPMTSRDQVWSFCTLVSSRGGGPDDTRRYLTVIRTLLSSRGGGPDDKQRP

SEQ ID NO: 137770 - protein, 27 aa, Glycine max
  Coding DNA Sequence Number=SeqID_46085
IPVGGDSARIPFVEHASRESRVALPPK

SEQ ID NO: 137771 - protein, 160 aa, Glycine max
  Coding DNA Sequence Number=SeqID_46086
EVAEMLQYMVSPQGRNTWTVDDLVPYVEKITILSEEQKRITEPLSHGLATEHEFPAQPLNILQSSVETKGIARRRETVEAEPYLYPQMTERGHGMYYTSPAFSQYPAQMYQYPFEAHQSDTSTSEHSLGSVVETYANFSWPTMTPSQQHDVLIETPNAPL

SEQ ID NO: 137772 - protein, 135 aa, Glycine max
  Coding DNA Sequence Number=SeqID_46087
MLGRHILAERKVEIYHTELDEFKGGLERRNFHKCLTNLADSSIDLALVKEFYTNLYSLEGPSPKQVRNRGHLIRIDADSLNSFLETPVVLAEGESLPTYLRYCRIPTDIREIEVSLCIPSRGFILNAEGSPREDP

SEQ ID NO: 137773 - protein, 146 aa, Glycine max
  Coding DNA Sequence Number=SeqID_46088
MQEVSYMGNQQRQGYNQGGFSGFQQGPYNQQGQWRSHPGNQFNKDHGGPSNRPPQQGPNIFQRTTKLEETLAQFMQVTMSNYKSTESALKNLETQVGQLAKQLAKKSSNSFGANTEKNPKEECNVVMTRNKKRLAVEDEDTVALKE

SEQ ID NO: 137774 - protein, 156 aa, Glycine max
  Coding DNA Sequence Number=SeqID_46089
  Homolog annotation: Hit_ID=Q6WAY4; Match level="QueryCoverage=87%, HitCoverage=24%, E-value=2e-14, Identity=34%"; Hit description =Putative uncharacterized protein
MGTNQTGKRFYQVKIKGIVISTEVVVSLTQYYDQPSRCFTFGDFQLVLTVEEFEEILGCPLGGRKLYLFSGFLPSLSKIAVVVRDSARELDHVKKTRNGIVGLPRKYLEGKARDMANQEEWVLFMDVLALLIFGAVLFPNMDGLVDLAASDVCISP

SEQ ID NO: 137775 - protein, 125 aa, Glycine max
  Coding DNA Sequence Number=SeqID_46090
MSNHKSTESTLKNLKVQVGQLAKQIADKSSNSFGANTENNPKEECKAVMTRSKRLVEAEDEESVVYKEQMGEKKGVEVKENDGKGKEKQEKGMKIMVQDKEMENQEKEKGNEKNEKEEKKDFREE

SEQ ID NO: 137776 - protein, 72 aa, Glycine max
  Coding DNA Sequence Number=SeqID_46091
MAERGEGSGPPRRTLGDYAYQQGPKHYNSIVIPPFSNKVVELKPTLLSLIGSHPFAGMDPWDPLESTCRHAS

SEQ ID NO: 137777 - protein, 108 aa, Glycine max
  Coding DNA Sequence Number=SeqID_46092
MEWFFQISHPFVTRTEEIAASRHPPPPHHGEFVEPPIPEVSVATDLPTHSVGMAQDLGAIAEDLERVINLRMVTEGTDLHDIMTRCLRRVRGDAADGSLRPRQRHRID

SEQ ID NO: 137778 - protein, 134 aa, Glycine max
  Coding DNA Sequence Number=SeqID_46093
VSLAKPPPKPDPEVDDPLYLMTLTIPELFLRPYQVTWDATVFGVFNPDFPLYMKTKTSPKSHTVVNVSAYQCYSCGFYKHFIETSMRAGNSDIYGFLEPQSIQRSGQSQFECESYIKIWMQSSKRDVYLGAYLN

SEQ ID NO: 137779 - protein, 90 aa, Glycine max
  Coding DNA Sequence Number=SeqID_46094
MSQTLSRHQGKLLLQVLEATIKANTEKKMELERLIKRLSESGIDDGEAAEEEDEAAEEEVEAAEEEEEAAEEEEDAAEDTESDDDSEATP

SEQ ID NO: 137780 - protein, 194 aa, Glycine max
  Coding DNA Sequence Number=SeqID_46095
  Pfam annotation: Domain name=Transposase_23; Domain location=110-180; Score=0.1; E_value=0.0012; Accession=PF03017.5; Description=TNP1ENSPM transposase
DSFKEQATQRYFIPHGRQDVLIAAIGRPEHPRHLFLPASRRIAVVDPTNQGQARGVHHRKSDTAAHDILQPDAVPDSVPAPPPDPLVGPFGPRVSTNGSCVDPSRNDPETGDSDRCGLYIEADPARLVAMGRVYEGSTVVHNTPLLFGQVKVSVEEVTDADAPVLVPTDEVSLVGQALYTFLAWPTHLVKSLSQ

SEQ ID NO: 137781 - protein, 115 aa, Glycine max
  Coding DNA Sequence Number=SeqID_46096
MSSRCSRRNQEEFKTQEEKLKNTSRFKKKDEFNGLQVVPSAVRLMKQANVLPLKKTLKKFIIWEINSDKGILDMNGSGMEKEEREETPLQGEDESRRSSPSQEAMDKSLEEEGDE

SEQ ID NO: 137782 - protein, 111 aa, Glycine max
  Coding DNA Sequence Number=SeqID_46097
  Homolog annotation: Hit_ID=A6FJQ2; Match level="QueryCoverage=34%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVSQSRRCKTTASAKLACLQVDSRGSPW

SEQ ID NO: 137783 - protein, 183 aa, Glycine max
  Coding DNA Sequence Number=SeqID_46098
MTTLTWIWMTLLFSNILPSDHNANLPLQMYQLGSRPQDAQWTRRSPTGPWGFQLWDRTHKTPSGPEEVQQGPGVSNSDYGPLSVLQGAHSPSEESHPQRHSVDPEKSNRGLGFPALVTGLRSPTGCLFPPARSHHHDIGIAPARHPVDPKKSNRVLELSSSNYGSLLVLRSACHLRQGHQAPY

SEQ ID NO: 137784 - protein, 81 aa, Glycine max
  Coding DNA Sequence Number=SeqID_46099
GVEFVHAHLSLIERADNHMSSGPPPLDDKSMTEIACTEDDVNLRVSMGLLATIDKGMTEIVCAEDDVNLRVSTALLAVINE

SEQ ID NO: 137785 - protein, 123 aa, Glycine max
  Coding DNA Sequence Number=SeqID_46100
  Homolog annotation: Hit_ID=A6FJQ2; Match level="QueryCoverage=30%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARGMKPLETIKRDITTLGIIAKSLALHMGSVLIPTVNKPTE

SEQ ID NO: 137786 - protein, 147 aa, Glycine max
  Coding DNA Sequence Number=SeqID_46101
VTGCTIYGEAHETGQCFQQGPYNQQGQWRTHPGNRFNKDQSRPSNRPIQQGPNIFQRTTKLEETLTQFMQIADKSSNSFVANTKQNPKEKCKTVMTRSKRFVEVEDEDNVVHEKKNADKKSTDGKKNEVIGESNQEKEEQIMVKNVD

SEQ ID NO: 137787 - protein, 27 aa, Glycine max
  Coding DNA Sequence Number=SeqID_46102
MAENSPNFPFTLRHRPSKGPPVTVWVP

SEQ ID NO: 137788 - protein, 96 aa, Glycine max
  Coding DNA Sequence Number=SeqID_46103
MDKVDIFVPHPLTNACLLIQLSPECGCKPLVCLLKLHALLSVDFQDCSIRDYSSCTLGQPFPCVQVSPTTRDPQSLNPFSEIRRREEEISLKRDGL

SEQ ID NO: 137789 - protein, 79 aa, Glycine max
  Coding DNA Sequence Number=SeqID_46104
  Subcellular localization annotation: CTP_CleavageSite=70; ConfidenceScore=5.15e-01
MSCIGSLSAPLHLFKRIASIHPLSEKGALSQKSVTCAKQSIQLCMSRVSRERKVQVLERFERFCCVKICRDQSSKQEPI

SEQ ID NO: 137790 - protein, 115 aa, Glycine max
  Coding DNA Sequence Number=SeqID_46105
AKKEGHFEVKTNIKEISPLRQPPHFLRCKKTLVSIATPLGLEFIPQVKELLDEGLVRKSLNPCALLVPKIGIIRHQIPKIGGVPMNPKRIKVIPEWPAPPSVLRKKAQRFKNLGI

SEQ ID NO: 137791 - protein, 209 aa, Glycine max
  Coding DNA Sequence Number=SeqID_46106
MVIDQSLFFSLTHLPSQGAPFEGTIVDDWKFDYSSHDARRMVCNDQAEMTGRLLAGSLTFDSRIMHYIIVRILLPRSSNLAQASEEDLILMWAFLTGRQIDWAHLRSFAIGAGAVTFFGYRKDRNGQWLKKDALPPQDVRTPSPPPQREDSALMNEVLSELRGLRSYVGDRFDSLDTRFSGMDIRLTQLEEDVGYIRQSFDLPPPPPSS

SEQ ID NO: 137792 - protein, 61 aa, Glycine max
  Coding DNA Sequence Number=SeqID_46107
MAASDIAILRDRAHISTKKSLLELTSQDALLAQNKLLSKQLETLTETLRCKIYGGAHEFGC

SEQ ID NO: 137793 - protein, 48 aa, Glycine max
  Coding DNA Sequence Number=SeqID_46108
MVIDYQWPVPLCNRLHRLVIDYQRPPQSSSPILSLELACLGTSQVLTD

SEQ ID NO: 137794 - protein, 109 aa, Glycine max
  Coding DNA Sequence Number=SeqID_46109
  Homolog annotation: Hit_ID=A9MRJ1; Match level="QueryCoverage=77%, HitCoverage=38%, E-value=7e-17, Identity=48%"; Hit description =Putative uncharacterized protein
MGSSSPVQNGDDSGYSVCARPRFRTGQPVSHNAVLTEYGKCGRHADFEDVGSRTPRKSKSRILFNNGAPLEHITNLLGQANPAASLFYIGFTQKTADTLSEEFSLGEEW

SEQ ID NO: 137795 - protein, 74 aa, Glycine max
  Coding DNA Sequence Number=SeqID_46110
  Subcellular localization annotation: CTP_CleavageSite=24; ConfidenceScore=5.03e-01
MKLPLRKGLRRNSPRRGLEGTSLEKALVSSQSLIVTISGVSSTSSASRPSGDGHSTGRGVSNSGKMSTRTSRRR

SEQ ID NO: 137796 - protein, 53 aa, Glycine max
  Coding DNA Sequence Number=SeqID_46111
MEVEEPWLGLWLPLNTRVDMGSSSAYDNGIWGEPYRLFAVVFVIGSAVDKLCG

SEQ ID NO: 137797 - protein, 132 aa, Glycine max
  Coding DNA Sequence Number=SeqID_46112
MHEQRLTINSWGYEYYLMMEDARTALGNQFVGLRTQWWRMHERQSIHGALNKLVEDARTTLGNQFVGLRTQWWRMHERKSIHGASNKLVEDALDAILPRKGPITTMSKRLQEDWARAAEEGPRVLINLRVDF

SEQ ID NO: 137798 - protein, 148 aa, Glycine max
  Coding DNA Sequence Number=SeqID_46113
SAERVVDRVAPAVRLVVDSDVGRGSGESHGGPVRARPADRPVRDRQTNARAFEHVTNSHRDRQVQAEELLECAADGLRARDRCSRRRDEDHVRGVQCHQAVEVPGIEAVGEREVQLVERSHRSAHEFSFPSVDPTPTFMEEDDAAPEV

SEQ ID NO: 137799 - protein, 71 aa, Glycine max
  Coding DNA Sequence Number=SeqID_46114
MSVKNLVGCLGVHDKTNHTLASQSGSQCFTRMLQPYVINIGLKEHSNRVTPKAYTPKSPLPPYSGPIQKIF

SEQ ID NO: 137800 - protein, 236 aa, Glycine max
  Coding DNA Sequence Number=SeqID_46115
MNLIIVIKRKEHVLRCPYQTRARARVMGEVEGVQEQMKVDMEAMKEQMATMIEAMMSMKKIMEVNAVAVTATSVVAKVNPTPPPSLNQMNCPTSYMVGKDLGSTGSPHDVQIQNEHAFLPYGWPPNYTPPNVAYTPNENVNNSTPILIKSQQPQSDHAYVSQPMGVCLDDNKGDDKKLKGQFKKFKMFKMFKIESRTLQGSRGNLISRIKNQDSRFKLSRIKIKIQDSRFKNQEKT

SEQ ID NO: 137801 - protein, 27 aa, Glycine max
  Coding DNA Sequence Number=SeqID_46116
MKADTEALKEKMATMMEAMMSIKEIIE

SEQ ID NO: 137802 - protein, 50 aa, Glycine max
  Coding DNA Sequence Number=SeqID_46117
MKLTLKVVGPDAILPRKGLVTRAMSKRLQEDQARAAEEGLRVLMNLRIDF

SEQ ID NO: 137803 - protein, 148 aa, Glycine max
  Coding DNA Sequence Number=SeqID_46118
MPISPCGSISWSVPSRHRDRAHKTPSGPGEVQQGPGVSSFGYGPLSILQGVCSPQQEIAPARHLVNLEKSNRVLGFPALITSLCQFYGVSVTPSKVIKPPINWAFIKKYCAPQAGARRDTTTAWGWPAAGNKIHRHHLQSPSAHPQKG

SEQ ID NO: 137804 - protein, 78 aa, Glycine max
  Coding DNA Sequence Number=SeqID_46119
MEKYCTQRQAQGDAPQAAGAPPPPHQAGPAGPFDMEQYLQHLLSLSMQSQGFASFSCLTPDQFRAEVAWPGDWPETQA

SEQ ID NO: 137805 - protein, 107 aa, Glycine max
  Coding DNA Sequence Number=SeqID_46120
  Subcellular localization annotation: CTP_CleavageSite=70; ConfidenceScore=5.51e-01
MPISPCKSISWSVSSRHGDRTHKTPSGPGIVQQGPRGSRLQDTQWTRRSPTRSWSCQALIMGLCQFYRVPVTSSKGIRPPTNRAFIKKYCVSRKAQGETPQQPGDGW

SEQ ID NO: 137806 - protein, 155 aa, Glycine max
  Coding DNA Sequence Number=SeqID_46121
MANNIIISRDNGGTTLEISSIEIKKSTESAIKNLEVQVGQLAKQLADRSSSSFTANIQKNPKEELATKPTLEPVSDFLELEEINEETEDDKEEETPIKEKEKERIKEGEKEKKLKNEKQKEKVVDDEMRKGKSEANIDKKKDTTPNEVKEVPYPL

SEQ ID NO: 137807 - protein, 53 aa, Glycine max
  Coding DNA Sequence Number=SeqID_46122
MRIRATWDYVSSVEEWYLEICRGGQETSGTSGGVLLPKAKLDQSQPNPGIVSQ

SEQ ID NO: 137808 - protein, 119 aa, Glycine max
  Coding DNA Sequence Number=SeqID_46123
GLHVLAIRGLHVLTFVGLHALTFRGLHVLANRGLHALTLRGLHVLALRGLSALALGTSYPHLQRTTRPHLQRTTRPRHQRTACTFTFVGLHALTFRGLHVLAIRGLHVPHFQRGTCPHL

SEQ ID NO: 137809 - protein, 206 aa, Glycine max
  Coding DNA Sequence Number=SeqID_46124
MVLKEELIACSRSQRSLSQRLCETETNMLAIIAKYQEELDLAAAHEHRIADEYAQVYAEKEARGRVIDSLHQEATMWMDRFALTLNGSQELPRLLAKAKAMADTYSAAEEIHGLLGYWKNTITKRAARDPYRTRSKSRTMGDQEETHEQMKANMSALKEQMASMMEAMLSMKQLIEKNAATAAVVSSAAEVDPTLLATTHHPPSNI

SEQ ID NO: 137810 - protein, 93 aa, Glycine max
  Coding DNA Sequence Number=SeqID_46125
  Homolog annotation: Hit_ID=A2Q2N3; Match level="QueryCoverage=48%, HitCoverage=10%, E-value=4e-15, Identity=84%"; Hit description =Regulator of chromosome condensation/beta-lactamase-inhibitor protein II
MEEQFKTLIVLSHYLEAAPCQSLLLAVGYEPFSETFQNHFSFKALRHLGYRGFGALGHSVYRRELFPRLVKGFYEGTIKHIATSGTHTAAITQ

SEQ ID NO: 137811 - protein, 156 aa, Glycine max
  Coding DNA Sequence Number=SeqID_46126
EAKRWLHSFKGNSLKTWDKVVEKFLKKYFPEFKTLKTPEEAMDLIENMAAKQVVVQGIGSIDRNTKLHGVPFVVELIILVVVSPMKNQFMKPIIWGISQDKISMQVDIPNFSMARHIIHSRDSRGITLETSSTKIRVVHLIGHNSKGLVSMIEQQS

SEQ ID NO: 137812 - protein, 118 aa, Glycine max
  Coding DNA Sequence Number=SeqID_46127
MTRGNPGDLQPFDPDIDRTFHRLVRHSVHTGHSVHFEHHDHSVHFVARDSEYSDFEHSTVNFHTENMAQTPPRERTLREMVAPDFTYESLCIQYPDEGVPYVLKTGLIHLLPKFHGLP

SEQ ID NO: 137813 - protein, 262 aa, Glycine max
  Coding DNA Sequence Number=SeqID_46128
MAKFDPEIVLDFYANAWPTEEGVWDMRSWVRGQWIPFDTDALSQFLGDPLILEEGQQSEFSQRRSRADGFDEEAIAQLLCIPGQDFARTAAGRRVRIMRTSMTTLTQTWMTCCLAMSYLAITTLTSLCLSASWCMASPEPSSRSTARLGRCSRVTHIRPQVHRHHLGRSILLGHWAWSAIYSIWSASRRPTTVGSLSQQGQGVAPFVCPTTEQFGAEVAWPGDWPDAQVGEEPAGSPGEADEPHMDEDMTDLLGFLGGSGAT

SEQ ID NO: 137814 - protein, 84 aa, Glycine max
  Coding DNA Sequence Number=SeqID_46129
MMLVSARQRARSPPVDERNCLCTDNTRGISIRHLTSWVRMTEAEDDVNLRVSTGSLARLTKGAEDDVSLACYRALVLRIAKECL

SEQ ID NO: 137815 - protein, 80 aa, Glycine max
  Coding DNA Sequence Number=SeqID_46130
MSSEELKLKDPRCRIQCPDILPENTGIAVQCKIKIFRKEIDLLQHQEVAAQKRTWLYKHEGCTSSVPSPGSKSYFVSFGT

SEQ ID NO: 137816 - protein, 77 aa, Glycine max
  Coding DNA Sequence Number=SeqID_46131
MEEAPAHAPSHVEQPRHAMEDCQSIAERLERLLNLRIVTEDTEAYNVMEYYLRIAKGVTADHNIYVRSRRRRRIEDT

SEQ ID NO: 137817 - protein, 76 aa, Glycine max
  Coding DNA Sequence Number=SeqID_46132
MTLYCLSSCFIYTHFNLEAMEGACDGQMKQRGHIVEGDSHLSYRKMETARFLVTPLRKSRYKSPIASVQGTCNQRT

SEQ ID NO: 137818 - protein, 108 aa, Glycine max
  Coding DNA Sequence Number=SeqID_46133
MTTVGYRDEILLRSRQADVMTLGIFWGESCVLLINSSIVVHDFFCWIKDGVMAGQNDRAIADALQALAQAMGNPNRREAGGAVEYQGLDRFQRNNPSSFTGGYNPDGA

SEQ ID NO: 137819 - protein, 60 aa, Glycine max
  Coding DNA Sequence Number=SeqID_46134
  Subcellular localization annotation: CTP_CleavageSite=69; ConfidenceScore=5.71e-01
MWSIPLGTLVSPTPINTSKLSPFSVNFKKPTTFPSQGSTPPREFSLSQSGRHDCKTESLT

SEQ ID NO: 137820 - protein, 76 aa, Glycine max
  Coding DNA Sequence Number=SeqID_46135
SFFHGLFPSGWRLLSPILLCLPLHLHGGKSPLKDLIEAQRSNLHRSSTSKLPSGLGCREQQQTTIVELPRLKTTGT

SEQ ID NO: 137821 - protein, 200 aa, Glycine max
  Coding DNA Sequence Number=SeqID_46136
  Gene Ontology: Biological process=ubiquitin cycle
  Homolog annotation: Hit_ID=Q2HTR2; Match level="QueryCoverage=38%, HitCoverage=14%, E-value=1e-20, Identity=67%"; Hit description =Cyclin-like F-box
MPQAQCMSQATDARKKAFAKNCKGWKKLYCGSCTFGSKGMNMVLDKCTTLEELFVKCLRGIIDAAVAELIGPDMVAASLKLCFKLSSHYRDPGTLDIRKNFVGFFNWKSFCRIKQGYLQGYFNKHSKVKHCFKINSKVKHCFTINSRSSKQDQEKVRPQTISSVDQAFSSKHIVSNIQGFANRLPGSVINYQKIILKQRI

SEQ ID NO: 137822 - protein, 66 aa, Glycine max
  Coding DNA Sequence Number=SeqID_46137
MKNVEERLKALRDSSRKTGGGCRPARPGELSSPRRAGLLPPEATAFWRNLLEGPNGPGCYLHPHFY

SEQ ID NO: 137823 - protein, 610 aa, Glycine max
  Coding DNA Sequence Number=SeqID_46138
  Gene Ontology: Cellular component=viral envelope
  Homolog annotation: Hit_ID=Q84VI1; Match level="QueryCoverage=93%, HitCoverage=84%, E-value=0.0, Identity=78%"; Hit description =Envelope-like protein
MATSPKETSASGSPAVPSSPHQEQPEFNIQPIQIIPGQASVPEKLVPRRQQGVKIAENPSLATSPREVDTEMDKKIRGIVSSILKDASVPDAEKDVPTSSTPDVSVPDVNKDVPTSSAPNAEALPSPSEEESTEEEDQASEETPAPRAPEPAPGDLIDLEEVESDEEPIANRLAPGIAERLQSRKAKTPIKRSGRIKTMAQKKSTPITPTTSRRSKVAIPSKKRKEISSSDSDDDVELDVSTSKRAKKSGRKVPGNVPDAPLDNISFHSIGNVEKWKYVYQRRLAVERELGRDALDCKETMDLIKAAGLLKTVTKLGDCYEGLVREFIVNIPSDISNRKSDDYQRVFVRGKCVRFSPAVINKYLGRPTDGVIDIAVSEHQIAKEITAKQVQHWPKKGKLSAGKLSVKYAILHRIGAANWVPTNHTSTIATGLGKFLYAVGTKTKFNFGNYIFDQTVKHSESFAVKLPIAFPTVLCGIMLSQHPDMLNYTDSVMKRESPLSLHYKLFEGTHVPDIVSTSGKAAASGAVSKDALIAELKDTCKVLEATIKATTEKKMELERLIERFSESGIDDEEAAEEEGEAAEEEEEAAEEEEDAAEDTESDDDDSEATP

SEQ ID NO: 137824 - protein, 90 aa, Glycine max
  Coding DNA Sequence Number=SeqID_46139
MSIWQTSVHGFLTVCGLLFPPLHSRDCESSHFLSDDIVCCCVMCICLSMRMNDNITLVLHHGGRFTPRASDGKVEYIGREFDVWEDISAA

SEQ ID NO: 137825 - protein, 257 aa, Glycine max
  Coding DNA Sequence Number=SeqID_46140
MWWFLDMVVRMRGASWASEGSRACGSEPMKGCDLDLAAWCDGDGLGGMKKKVKVKGKRDGKIKIIVRLEVIGRRNNRGHEFYQVLPPSNHLEEEEKQDSISQFWKMGLFKDEDPIYVWLYGGAFPNFSKEDLALIQNDPLNEESKSVVFSIRALKALGPDDLNPLFFLSQWDTVRSSIFLRVKEALLNLSSIKLLNHMNLILILKMVMNKLVSPHLTSFIPGRQVDLQKAYDSIRCLFIIGTLQKPDFGDFFLNLLF

SEQ ID NO: 137826 - protein, 115 aa, Glycine max
  Coding DNA Sequence Number=SeqID_46141
MCIHLKGPDKYLHVLTFRGLHVLTYRGLHALTFRGLHILTFRGLNALTFRGLHVLTFGGNAPSPSEDYKSSPSEDYMSSPSEDYTFSPSEGCTILPSEEYTSSPSEDYMFSPSED

SEQ ID NO: 137827 - protein, 163 aa, Glycine max
  Coding DNA Sequence Number=SeqID_46142
MILDASTEGTMMSKSAKEEIVIIDSIAASDYQVTMIGLQFKGKEGEAHYLQSQGRPQQNFQGNYQGYRGGSGSNQPYGWRQQNNNAYSSPTKPSFVGHSNNSYKNIDASIKNLEVQVGQLEKQLSEHGSGSFLANTQVNPKEQCKAITTRKGNVVGLKDNGEK

SEQ ID NO: 137828 - protein, 141 aa, Glycine max
  Coding DNA Sequence Number=SeqID_46143
MQLQHNRWWRALRSMVVVELHKGASGLVVVCANDRVERCGCALIENSDTIEEMTHKPKNTAVATCPFAGSRRRGSRVRFPKEERCAESPPTFICGKRRKNRRKSVKMKILSSGVVFTFEGGRQKRGCCSYVPSIEEEIRPT

SEQ ID NO: 137829 - protein, 226 aa, Glycine max
  Coding DNA Sequence Number=SeqID_46144
  Subcellular localization annotation: CTP_CleavageSite=45; ConfidenceScore=5.12e-01
MNSLPSTVHVSSTIESGAPRIDCLDLFANSPFSNLIRRPVNSLPSAVHVSSTIESGAPRIDCLALFANSPFCNLIRRPMNSLPSAVHVSSTIESGAPRIDCLALFANSPFSNLIRRPVNSLPSAVHVPSTIESGAPRIDCLALFANSPFSNLIRRPMNSLSSAIHVSSTIESGAPRIDCLALFVNSPLSNLIRRPMNSLPSAFHVSFVIKRGASEKEEGETRVVID

SEQ ID NO: 137830 - protein, 44 aa, Glycine max
  Coding DNA Sequence Number=SeqID_46145
MCHMQGGRQRRRGEGRHHPLGNKPRKKELHHQELPWIRSLKRML

SEQ ID NO: 137831 - protein, 169 aa, Glycine max
  Coding DNA Sequence Number=SeqID_46146
  Homolog annotation: Hit_ID=O82334; Match level="QueryCoverage=69%, HitCoverage=14%, E-value=2e-10, Identity=29%"; Hit description =En/Spm-like transposon protein
  Subcellular localization annotation: CTP_CleavageSite=40; ConfidenceScore=5.38e-01
MATPPRSPPQSDGQSEATLKRSRTTTRLRTLTLRTMDQPRPAVYVDPATGRASGPMREKFQSYLGVVAREKIPIIHNNWKDVPETLKEIVWNDILAKFDIPEAAKVKTKVMSMVAMRWRQFKSTLTSKFVFGKTEGQQMQDVVTKYGLDPEAWKQFEATRVTPNWEISL

SEQ ID NO: 137832 - protein, 134 aa, Glycine max
  Coding DNA Sequence Number=SeqID_46147
MVVVLMVSPSTEGDLQAKLRPRCGVVVAEHVHYDLKVVWVIKGYCCYNSLGEALYSGEPVKVSRIVAYVGSMIIPLLSGLEIFTNTLNLIDLPILFSFDGSHAMYPSNSFTNGFNHQLCLQVYKEIINPHLELA

SEQ ID NO: 137833 - protein, 238 aa, Glycine max
  Coding DNA Sequence Number=SeqID_46148
  Gene Ontology: Mol. function=unfolded protein binding; Cellular component=cytoplasm; Biological process=cellular protein metabolic process
  Homolog annotation: Hit_ID=A7PD22; Match level="QueryCoverage=58%, HitCoverage=28%, E-value=4e-51, Identity=68%"; Hit description =Chromosome chr17 scaffold_12, whole genome shotgun sequence
  Subcellular localization annotation: CTP_CleavageSite=24; ConfidenceScore=5.32e-01
MVLMQKSHSHIKLGAGKHMYQSTMTMLATSINFCCTWTPNFTPTFVFIGVSVWFHFASFFKKKNSNIFFYLVREKLPSVERPKVSIFYCQEEDWSLLLRMEEEYIEELCMQILKFKPDLVITEKGLSDFACHFLSNHGLSAIRRLRKTDNNRIAKACGAVILRRLEMSFLHLLRGASKDPKACSVLLRGASKDHLNEVERNLQDTVSVARNIIKNSKLVPGGGATELTNDCQRCRDFS

SEQ ID NO: 137834 - protein, 115 aa, Glycine max
  Coding DNA Sequence Number=SeqID_46149
MAAQLIHDRVEMECLEGVWETLEGNARCRFRGMIRLTTTSLPVQVIEVTSSEEDPEKDPEELPPEPAVDALDFPEGDKDPLPEVDSPEDVMSASEADSTEESGPGGIATSGGSSS

SEQ ID NO: 137835 - protein, 192 aa, Glycine max
  Coding DNA Sequence Number=SeqID_46150
MKVDMEAMKEQMTMMMEAMMSKRKMTEVNTAIVVVVSTATETDPIPLSGFNRVGCPTSNVVGQGGKAEENACRPHYAQVQSKHPFLPYGLPPNYTLPNVVYAPSENVNNYAPIPIENQQPQPNHAHVSQPVGETHETPQDHTLADFGPHPRYTTRGHAFPGAPRAKCSGGASVSNTTLTLAFCDRRRAFRST

SEQ ID NO: 137836 - protein, 90 aa, Glycine max
  Coding DNA Sequence Number=SeqID_46151
MKLPTISEEDKCTHNLTKDQIRGKLAQASWFLTTEGISSPRRASCLRLKVFHGPGMPDASLGELGSRRSDNQTSNLSDPLILHCNRCQTS

SEQ ID NO: 137837 - protein, 249 aa, Glycine max
  Coding DNA Sequence Number=SeqID_46152
  Homolog annotation: Hit_ID=A5B589; Match level="QueryCoverage=32%, HitCoverage=22%, E-value=4e-08, Identity=38%"; Hit description =Putative uncharacterized protein
MHVEMKQPLPGFICCYGVGFQGARRLDPTCLEEVGRPWEHIRKGSQVCKIAATLKHEIHERLVMLNVKSEESTRKSSESRLSEDHSCLSVVINYFLSDILCGLLYHSACILLAGFTFEDSGLDHDHGTLTTTMGHGQLIRAKGRGQLIRVVVNQEGHDTNTILLLKLLEGVTFGFKHEFLQMLENNLFSGATDEDPMQHLRKFIKFTNTMRPNHVTIEYIRHYAFPFSLNGKAWDWLCSLPENNITTLD

SEQ ID NO: 137838 - protein, 189 aa, Glycine max
  Coding DNA Sequence Number=SeqID_46153
  Gene Ontology: Mol. function=aspartic-type endopeptidase activity; Biological process=RNA-dependent DNA replication
  Homolog annotation: Hit_ID=Q69F85; Match level="QueryCoverage=80%, HitCoverage=8%, E-value=1e-23, Identity=37%"; Hit description=Gag -pol polyprotein
MSLIIDPRNLLVVGIIDTPLPPIRKEVTLDKYERFAKVALDIRNLDPIVAMHHLVMALRPGPFVNNLCKKLTTNLDGLHCWAAKYMQLEELIKYNRHLRIEASGSKKDAERDMQKGKERAHEPRYNYYISLNASRSRILEQGLATKVLAMPKCANTPLRVDPLKHCQYQRNKGHSTEKCPTLKTRSRIS

SEQ ID NO: 137839 - protein, 118 aa, Glycine max
  Coding DNA Sequence Number=SeqID_46154
MAYAIRKIRLASSCVVAINSVPTYFPDHSPGKNQQHTNYNAAKLYREVYRASSEVDKVMGGCATLLQSWPGTACLLLHQESHNPKQLIHGLKDGVVVDKNIGPNHESHLMVTWSDIDL

SEQ ID NO: 137840 - protein, 154 aa, Glycine max
  Coding DNA Sequence Number=SeqID_46155
MHHQKRKTLDETSPLSSGSETQHDHRSTSTPYGSHRPGSQWSHHQSQPTLRREGKAKSRDASSHEENVWSCHQRLFEENVRKTKKKKVCEFKNKGSGVVYAWRRKIGTWAMAARPGELMLTPEVIGSPRRAGYFTLKSFGDPGLPRRARVQETQ

SEQ ID NO: 137841 - protein, 103 aa, Glycine max
  Coding DNA Sequence Number=SeqID_46156
MIEKQMQKTDLRGKREADRREPIWRKQCGKKVRERKLTLRKIEIKSNVLEEGIHGVRDLNMILLIRIRDVDIVHSLFYAFHCSLSLSLSLSLALAQQKTLTIF

SEQ ID NO: 137842 - protein, 66 aa, Glycine max
  Coding DNA Sequence Number=SeqID_46157
MSHWTKILAKSIQAQSTLLVATTFCVLALVTKLPHTNIVFAANFCSKIYNPNHKGKVSNVNSFGIC

SEQ ID NO: 137843 - protein, 58 aa, Glycine max
  Coding DNA Sequence Number=SeqID_46158
MVFMMVITTMVLKWRIEISEGTTVVLTTTVLGFDDKILGRGHLTTGRSTDRQIVLKLN

SEQ ID NO: 137844 - protein, 190 aa, Glycine max
  Coding DNA Sequence Number=SeqID_46159
  Gene Ontology: Mol. function=histidine-tRNA ligase activity; Cellular component=cytoplasm; Biological process=histidyl-tRNA aminoacylation
  Homolog annotation: Hit_ID=Q45NM7; Match level="QueryCoverage=17%, HitCoverage=18%, E-value=2e-09, Identity=90%"; Hit description =Histidyl-tRNA synthetase
MSELYVLELGTKGCAEVTIFKTSYIVFKGGTQVGSIAAGGRYDNLIGMFGSRSVPAVGCGNMFICITLLHLMMINKTDIYAKAGRWEELPMLGSASCWEHHILKKKHFIGVFLKKKHFLKEADGDGGSAVQLYAKECSKLLLHVLKRGPSQKDDEVVTSIGDEKEEEDFCVMAREEEKMKLLCKCMLRPP

SEQ ID NO: 137845 - protein, 361 aa, Glycine max
  Coding DNA Sequence Number=SeqID_46160
  Pfam annotation: Domain name=zf-CCHC; Domain location=53-70; Score =21.5; E_value=0.00084; Accession=PF00098.14; Description=Zinc knuckle
MSTSKSYGSHSYLKKDQGQGILGVTPSKPKDDKGKTIEKQPLKASMQEKTSSMKCFKCLGRGHITSQCPTKKTMIMRGQDIYSSQDEATTSPSSSESEEAKGEESSEEIYPQKEGRPLMVKEECKETLVSIATPLRLEFIPQVKELLDEDLVHKRLNPCALLVPKIGIIRHQIPMIGGMMNVLSGATLFCKITHAPNIFMIFGHRDSLGRNNQHENKEKGMFYSITFPNFLNSDQGLPMDPKRTKVIPEWPTPPSVEERIHEFQEPLDLRSNPFQGRGNMVLAPLELVGLGSSSSMDFFASWKMNGNRMEKGRERERRRHFKEKMSLEEAHHHRRPWIRAWRKKEMNEGRGREEHKILCSI

SEQ ID NO: 137846 - protein, 99 aa, Glycine max
  Coding DNA Sequence Number=SeqID_46161
  Subcellular localization annotation: CTP_CleavageSite=35; ConfidenceScore=5.24e-01
MTTDQPPLPMSPQNRWSRQLSQPTLRRETDARFTGASSEKGKGAGVATNVYSRKTLEKTKRGLRILRIRVWELFTRGESISTLRVCHKGRQPLIECAKT

SEQ ID NO: 137847 - protein, 286 aa, Glycine max
  Coding DNA Sequence Number=SeqID_46162
  Gene Ontology: Mol. function=nucleotide binding; Cellular component =membrane; Biological process=defense response
  Homolog annotation: Hit_ID=A7Q3H0; Match level="QueryCoverage=71%, HitCoverage=53%, E-value=4e-47, Identity=49%"; Hit description =Chromosome chr13 scaffold_48, whole genome shotgun sequence
MPRAIVNFIVQSLGDLLIQEGMFLYGVEDKVLQLQTKLRMMRSYLQVADRKQDGNESLRNWISKIGEAAYDSDDVIESYALRGASRRNLTGVLSLIKRYALNINKFIETHKVGSHVDNVIARISSLTRSLETYDIRPEEGEASNSMHGKQRSLSSYSHVIEDDIIGVQDDVRILELCLVDPNKGYRVVAICGIGGLGKTTLAKKDTRNKIRALHYSKPTKLNLTYDIFLSFSHETTRPKTHADLLFPTVDHLPPKLSLLRITLSNQQWKQWKKEPYLNEERKNGAR

SEQ ID NO: 137848 - protein, 31 aa, Glycine max
  Coding DNA Sequence Number=SeqID_46163
MRSLLKSHPRITSEKWKNLEVAGWIGPDKGT

SEQ ID NO: 137849 - protein, 60 aa, Glycine max
  Coding DNA Sequence Number=SeqID_46164
MFLIFNTSALKGLDDAPQPKSKAAARWIVVKCNRQKGITECGYYVMHWMSTIILGSFRNN

SEQ ID NO: 137850 - protein, 91 aa, Glycine max
  Coding DNA Sequence Number=SeqID_46165
  Homolog annotation: Hit_ID=A5C1M1; Match level="QueryCoverage=70%, HitCoverage=11%, E-value=2e-11, Identity=48%"; Hit description =Putative uncharacterized protein
  Pfam annotation: Domain name=zf-BED; Domain location=20-66; Score =25.4; E_value=0.00021; Accession=PF02892.6; Description=BED zinc finger
MEVDDHVASSTKTGGGMLKSIVWNHFGKIKITDGQDEAQCKYYKKLLGGASKNGTKHLHAHVEKCIQKKLLDTNEGMVAIKSNMWTARHLN

SEQ ID NO: 137851 - protein, 270 aa, Glycine max
  Coding DNA Sequence Number=SeqID_46166
MESSIGGVCWKDPSSNSLIFKIFSWLKSFYSILYFFRSFIKELPYRSMGFKHFSEDNIVVDVLHNAFVLHHFTFKSIEENLGQFKGTALYQMIQNELVGIGQEGAILPWHVGPIGSLEGVPNLVFKFIALIVYELGSSSHTPNGFGNGFSIWLHWYTNNLPCKVSFNNLIVLDFGCSPKLMDEFRHHHHLGVLEEVVDVAQHKVCVDDVSNIFQIVNILKVFDMNFGFFVLQIDFYSKNGHSCRFLEASEGRGSSGVEVSGREKENVKSL

SEQ ID NO: 137852 - protein, 340 aa, Glycine max
  Coding DNA Sequence Number=SeqID_46167
MDAPLSKVAPTAQCPPPTLVAPKAIGAMTHEQKVAPPSDETPTPQVKRHLEGEQSFVVAVANDPQPTNIPPIRELRLFTLRKERELSPLLTWRMKFNPKHLHHPSTLVASNIKDHPPSIQTSQMKTLQEVITCPSSMHKANEVAPSSTTLDQSTEIEVLPPPTWKHLHPKISKPSSLMTLQKTVYKIPYGAYKEVVTYDRHFYGHQAIPLTKEDIFNVGMILMQCGLTNQWPSYPLGILIRLTTTIKFMLDRIALRLPPLDLRKKKGKDTAKKTVILKPDIEFDQNDTMLFYFNDMYENSHLASTLEYDKEDTSNHMCMVKILHPTKIYEFMDWQMCFLR

SEQ ID NO: 137853 - protein, 176 aa, Glycine max
  Coding DNA Sequence Number=SeqID_46168
CSNSDAGADGMASSAPLEEAPGLRRPHPFQKEKAGTGAVEEERAGVSGGAEVVGASDLLPLAFLGPLNVTVGSSRFQQFFLIYAKLMSCDQGRESNSGCVMLCNQRDLLGDEVMNKKLKRSKNNSSESKNISSKSRTSQEFKNQGEFKTQEESLESRIKTQDLKNQDQDSRLKIQE

SEQ ID NO: 137854 - protein, 152 aa, Glycine max
  Coding DNA Sequence Number=SeqID_46169
  Homolog annotation: Hit_ID=Q6WAY4; Match level="QueryCoverage=86%, HitCoverage=24%, E-value=1e-12, Identity=35%"; Hit description =Putative uncharacterized protein
MGTNQNGKRFYQVKVKGLDVTSLKELGRLMGPLQRQAFRKVYGKILDLTAAEVFTEVVVSLAQYYDQLLRCFTFGDFQMVPTVEEFEEILGCPLRGRKPYLFSGFLPSLSKIAAVVGDSAKELDRMKQTQNGVVGLPQRYLEGKARDMASQE

SEQ ID NO: 137855 - protein, 133 aa, Glycine max
  Coding DNA Sequence Number=SeqID_46170
GLCQSFGVPVAPSKVIRPPITRAFIEKYCTARQAQGGDPQAPDAQPPPPQVDLVGSFDTESLQSQGFASFPCPTLDQFRAEVAWPGDWPEAQAAEVGEAPTEPLAEAPGEADEAREDEEMTDLLDFLGGSGAT

SEQ ID NO: 137856 - protein, 183 aa, Glycine max
  Coding DNA Sequence Number=SeqID_46171
MIMRGQDIYSSQVEATTSPSSSESEEAKGKESREEIYPQEEGQPLMVKKECKEVSVSSKRLAKKEIYFAIKTKIKETSPLRQPTHLLLCKKTLLSTATPLGLEVIPQVKKLLDEGLVCRGKELRVLRTSGFEINSSFSRKLLKEASQGSFSRKLLKEWMAPPFTSSSLSSTTSLWWKITIEGP

SEQ ID NO: 137857 - protein, 133 aa, Glycine max
  Coding DNA Sequence Number=SeqID_46172
MGDKEEVQEQMKADMSALKEKMASMMDAILGMRQLMENNAATAAAVSSAAKANPTLLATAHHPIPNVVGRERSTLGHISNPIQGGPPLVADEKGKLDLIEERLKAIEGFGDYPFADMTDLCLVPDVVQRDDLS

SEQ ID NO: 137858 - protein, 85 aa, Glycine max
  Coding DNA Sequence Number=SeqID_46173
MLSGLITYIHHQGGMRLARHGPLSTFIWKSKILTAAMNRLSAQGNPVCRKAHQIVKYLKIKMDEFEYRTQGNKSKTGLNSEIRHC

SEQ ID NO: 137859 - protein, 92 aa, Glycine max
  Coding DNA Sequence Number=SeqID_46174
  Homolog annotation: Hit_ID=Q2HWT8; Match level="QueryCoverage=38%, HitCoverage=4%, E-value=2e-07, Identity=74%"; Hit description =Phospholipase D alpha 2
MVPEGLWSHALKHTRREKRGAQEGNSFASHALFIPFGFGKLMAQILLHGTLHATIYEVDKLKIGGGNNLTKFIDNLAMVSARPLSLASPNRE

SEQ ID NO: 137860 - protein, 57 aa, Glycine max
  Coding DNA Sequence Number=SeqID_46175
MGSMLETETTNTLRASENGEGFNRRSQGCLQGSMLKGSMLGLSAVFKGKDNTLREAV

SEQ ID NO: 137861 - protein, 427 aa, Glycine max
  Coding DNA Sequence Number=SeqID_46176
  Gene Ontology: Mol. function=transaldolase activity; Cellular component=cytoplasm; Biological process=carbohydrate metabolic process
  Homolog annotation: Hit_ID=A7QT89; Match level="QueryCoverage=68%, HitCoverage=66%, E-value=1e-113, Identity=68%"; Hit description =Chromosome chr1 scaffold_166, whole genome shotgun sequence
  Pfam annotation: Domain name=Transaldolase; Domain location=98-413; Score=49.7; E_value=5.4e-12; Accession=PF00923.10; Description =Transaldolase
MDEQVSSVSSVSTFVWNLKLEANNPNWEAIKSQVHKALVDYGCFEAIFEKVPLELRKAIFAALQELFDLPLQTKILNVSKKPYHGYVGQANMVPLFESMGIDDANVYENVESMTNIMWPHGNPSFRHDIESAYWELVVKDIQDTCKLLEPIYNETDGEDGHVSLAISPKLANDTKGTTEAAKWLHNMVGSPCVYMKIPATDESISSMKEVISLGISVNATLIFCLPKYEAVIDAYLDGLESCGMTDLSKVSSAAAFYISRVDVTLDKKLEQIGTTEALDLKGKGAVAQAVLAYQLYQKKFSGPRWERLENRGAKKQRLMWASTNVKNPSYLDTFYVNSVIGPHTISTFSVQALHAFMDHGILSRMLDAKVSEAQDIYNEIEKLGIDWSSVGSQLEHEVLDSFTKSFDNVLECMQKKAMNIYSFQKHV

SEQ ID NO: 137862 - protein, 107 aa, Glycine max
  Coding DNA Sequence Number=SeqID_46177
  Gene Ontology: Mol. function=oxidoreductase activity; Cellular component=extracellular region; Biological process=response to oxidative stress
  Homolog annotation: Hit_ID=A7NY36; Match level="QueryCoverage=47%, HitCoverage=20%, E-value=6e-14, Identity=74%"; Hit description =Chromosome chr6 scaffold_3, whole genome shotgun sequence
  Pfam annotation: Domain name=peroxidase; Domain location=3-106; Score= -75.2; E_value=0.015; Accession=PF00141.14; Description=Peroxidase
MLFMLCFVKLFTGEKSAGANVNSPRGFEVIDDIKSKVEAACPRVVSCADILAIVACDSVVADNRCRIAGYSTSIIRKTDVECFTMGSILQHFAATTDVEFQSFYIGY

SEQ ID NO: 137863 - protein, 273 aa, Glycine max
  Coding DNA Sequence Number=SeqID_46178
  Gene Ontology: Mol. function=motor activity; Cellular component=cell projection
  Homolog annotation: Hit_ID=UPI00016621D1; Match level="QueryCoverage =77%, HitCoverage=40%, E-value=4e-19, Identity=32%"; Hit description =UPI00016621D1 related cluster
GLHALTFRGLHSLAFIGLHILALRGLQALAFIGIHVLVFSGLHVLTFRGLHALPIIGLHTLAFRGLHILAFRGLHVLAFRGLHALTFRGLHVLTFRGLQALAFRGLHVLAFRGLYVLSFRGLHVLTFRGLHILIFRGLHALAIRGLHVLSFRGLHVLTLRGLHFLIFKGLHVLAFRGLHALTFRGLHSLAFIGLDALTFRGLHVLAFRGLHVLAFRGLHFLGHSSYIGGGPTVRAQPEEEAIMQLLYIPGQDFARAAANRRVRIMRTNMTTLT

SEQ ID NO: 137864 - protein, 80 aa, Glycine max
  Coding DNA Sequence Number=SeqID_46179
MAAYKSVNLNHMNYVPMLFTLQHILHVYENPFGLLPHESMWQEYKRDQWGPNPRRKRTAKGRSISTRIPIEMDEEENERK

SEQ ID NO: 137865 - protein, 191 aa, Glycine max
  Coding DNA Sequence Number=SeqID_46180
  Gene Ontology: Mol. function=hydrolase activity; Biological process =proteolysis
  Homolog annotation: Hit_ID=Q39MK3; Match level="QueryCoverage=100%, HitCoverage=61%, E-value=1e-74, Identity=74%"; Hit description =Alpha/beta superfamily hydrolase
METVKIRNHDMYWDIAADIHFPPNFDKSKKYPAIISAHPIGSCKDQTSGNVYGVALAKEGFVVIAFDASFQGASGGEPRFIEDPTLRVEDFRHVADYLVTLPYVDEDRIGVLGICGGGGYSINAAMTERRIKAVGTVTGANYGRLMRGNFTGLNPIGALEAMAKQRTAEARGGSLHVDNLLASSVEEARAA

SEQ ID NO: 137866 - protein, 73 aa, Glycine max
  Coding DNA Sequence Number=SeqID_46181
MRDIVHEPQVNIGADQKFSLVDGGPLGTCTYHLERTTRPRLERTTCPHHQRAARPHLQRTTRPRLKKATRPRL

SEQ ID NO: 137867 - protein, 91 aa, Glycine max
  Coding DNA Sequence Number=SeqID_46182
MVAITPSKVHQPPFLREYNSNATCACHGEASRHSIEHCMALKRKVQAIGLFAQATCAPEFGLPRPVNQKLLVLHVGGGAVKQRVKFKTNKF

SEQ ID NO: 137868 - protein, 261 aa, Glycine max
  Coding DNA Sequence Number=SeqID_46183
IPLEDELEPVISRGFNKTNMETLQKVRKAWEVLQKKDKELWGSNNGPIGGYRKWLKAHVQGLDWLSSLRTAKREEVEAPEEDEEVQALRMELKQAQTVKERFKSAALKIRKENAELRDINIATTKALEQETKRACREEHGRNKFRGALWGSNSDLKLRREERDQSRVDKTNMLAIITKYQEELNLAAAHEHRVADEYAQVYAEQEARGRVIDSLHQEATIWMDRFALTLNGSQELPRLLAKAKAMADTYFALEEIHELLGY

SEQ ID NO: 137869 - protein, 75 aa, Glycine max
  Coding DNA Sequence Number=SeqID_46184
  Homolog annotation: Hit_ID=Q8DEV3; Match level="QueryCoverage=54%, HitCoverage=93%, E-value=1e-07, Identity=70%"; Hit description =Putative uncharacterized protein
WAEGKEAPSVKVACLAQEVGTVENKVANGLTKPMMLSWSFRMISHTGTETRPGLPRGAAVGNLGQWAKARSSNIA

SEQ ID NO: 137870 - protein, 196 aa, Glycine max
  Coding DNA Sequence Number=SeqID_46185
MEESHRENNKYNISQSRGSALDGEEHIGEWRNPIGKITKITFPSQEGPLLTVKNTLENGGIPSENKKYNITQSRGSALDGEDHLGEWRNPIGKITNITFPSQEGPFLTVKNTLENGGKSNRENNKDHISQSRGSVLDGEEHIVQWRNHRENNKYNISQSRGSALDGEENTLENGGIPIGKITKITFPSQEGPLLTV

SEQ ID NO: 137871 - protein, 161 aa, Glycine max
  Coding DNA Sequence Number=SeqID_46186
MQLPETVTACFCKRDAGSRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPFNKVGFGRVEGEGWSPIQVAQYTKSLA

SEQ ID NO: 137872 - protein, 68 aa, Glycine max
  Coding DNA Sequence Number=SeqID_46187
MMAHHGSSVFQDYFDDAKYSSLESRVKQVSRIEESFNQSKFQESKSRSIKTRSIKNQDSSKRIQRRLN

SEQ ID NO: 137873 - protein, 127 aa, Glycine max
  Coding DNA Sequence Number=SeqID_46188
MGTNQTGKRFYQVKVKSLDTTSIKELGRLMEPLQMQAFRKTYGNILELTTVEVSIEAIASLTQYYDQPLRCFTFGDFQLGKKTIPFLRVSPLFEQNCNCGQGFSKRFGPHKTDSKRHSGPTTEVPRR

SEQ ID NO: 137874 - protein, 79 aa, Glycine max
  Coding DNA Sequence Number=SeqID_46189
MEPLELHQRKIPGNSNGRNFSHGGPIQAHNISRRSKLNNGSSREFNGHNFSHGCPIQAHNISRRSKLNNGSSVEKFKWS

SEQ ID NO: 137875 - protein, 190 aa, Glycine max
  Coding DNA Sequence Number=SeqID_46190
  Subcellular localization annotation: CTP_CleavageSite=20; ConfidenceScore=5.29e-01
MKKNRSANTVSRKRAKVARRAARRTSSEPTTPIRRRTAVMLGGELLICSRCGRTAVDMADADRWNAAFDSGYVRGYICPEDQSPLDSLEAQINDVDLGAPVSWNDLDSRQVAELVVRTIQQRTTRVIRGHADRAAAAGATAIEIDVRAWLDEIVDVRHPLFQGQSEALLESARAAAIDEIREILPAGMDI

SEQ ID NO: 137876 - protein, 146 aa, Glycine max
  Coding DNA Sequence Number=SeqID_46191
  Homolog annotation: Hit_ID=Q51617; Match level="QueryCoverage=28%, HitCoverage=59%, E-value=2e-14, Identity=92%"; Hit description =Putative uncharacterized protein
MTVKTSDTCSSRRRSQLVCKRMPGADKPVRARQRVLSGVGAGFNYAASEQIVLRVHHMRCEIPHRCVRRKYRIRRHSPFRLRNCWEGRSVRASSLLRQLAKGGCAARRLSWVTPGFSQSRRCKTTASAKLACLQVDSRGSPKYAHR

SEQ ID NO: 137877 - protein, 129 aa, Glycine max
  Coding DNA Sequence Number=SeqID_46192
MRSWVRGQWIPFDTDALGKFLGDPLVLEEGQECEFSQRRNKADGFDEEAIAQLLCTPGADHAHQHEHLDPDVDDIAAQQCMPPTRHPLDPNKSNRALGFPALITGLCQSFGVPVTPSKMIRPPITRAFI

SEQ ID NO: 137878 - protein, 427 aa, Glycine max
  Coding DNA Sequence Number=SeqID_46193
  Gene Ontology: Mol. function=motor activity; Cellular component=cell projection
  Homolog annotation: Hit_ID=P15305; Match level="QueryCoverage=99%, HitCoverage=91%, E-value=1e-15, Identity=19%"; Hit description =Dynein heavy chain
GLHVIAFRGLHVLAFRGLHVLAFRGIHALAFRGQHVLAFKGLHVHAIRGLYILAFRGLHVLAFRGLHVLAFRGLHVLAFRGLHILAFRGLHALSTNRLHALAFRGPHILTFRGLHVLAFRGIHILAFRGMRVLAIRGLDVLEFRGLHGFAFRGLHVLALPSETTRPRLQRATRPRLLRATRPYHQKATRPRLAFRGLHIFAIRGLHVLAFRGLHALAFRRLHVLAFRGLHLHAFKGLHLLAFRGLHILAIRGVHILAFRGLHVLAFRGLHAHTFTVRHVLTFRGLHAFALRGPHILAFRGLPMLAIRELHVPAFRGLQVLAFRGLHVVLAIRGLLALAFRGLHVLPFRGLHVLAIRVLHALALRALHILAFRGLHALAFRGLHVVAFRELHVLAFRGLHVLTFRGLHVLAIRGLHALAFSGLHVGIL

SEQ ID NO: 137879 - protein, 1166 aa, Glycine max
  Coding DNA Sequence Number=SeqID_46194
  Gene Ontology: Mol. function=motor activity; Cellular component=cell projection
  Homolog annotation: Hit_ID=P15305; Match level="QueryCoverage=93%, HitCoverage=97%, E-value=2e-29, Identity=20%"; Hit description =Dynein heavy chain
  Subcellular localization annotation: CTP_CleavageSite=37; ConfidenceScore=5.34e-01
DYTSRLQSTTRPRLQRATRPRLQRTTRPRLQIATLPRHQTTTCPRLQRTTRPHILAFRGLHVLPFIGLDVLAFRGLHVLAFRGLHVLPFIGLHDLAFRGLHVLDYRGLHVLTFRGLHVPAFIGLHILALRGLHVLAIRGLHVVAFRGLHVLAFKGLHVIAFRGLHVLAFRGLHVLAFRGLHILAVIGVHVLAFRGLHVLAFRGLHDDTSSPLEDNTPLPSDGRTSSPFEDYTGLHIVAFRGLQVFTIRGLQALTFRGLHVLTFRGLDVRTFRGLHALASTTEDSTTTRPRLKRTTPPHLAFREHQIFAIRALHVLAFRGLHVLAFRGLHVPALRGIQVMAFRGLHALALRGLHVLAFRGLHVLAFRGLHVLAFRGLHVLTVRWLHVLAIRQLHVLAFRGLHVVAFRGLQALSFRGQHILTFRGLDFLAFRGLHALASTTKDSTTTHPRLQMATHPHHQRATYPRLAFGGEYILAIRGLHVLAFRGLQVLAFRGLHVPAFRGLYVPALRGLQILAFRVPHVLALRGLHVLAFKGLHVLAFRGLQALAFKELHALTIRRLPALTMLSEDNTSSPSEDYTSKPLVELHVVAFRGLHVLAFRGLHVIAFRGLHVLSFRGLHILAVIGLHVLAFKGLHVLAFRGLHVIAFIGLHALAFIGLHVLAFRGLHVLAFRGLHVLSFRGLHVLAFRWLHAFTFRAQQILTFRGPDVLAFRGLHALARLQRTTRSRIQRTTHPRLQMATRPHHQKATRPRLAFRGQHILAFRGLHVLAFRGLHVPAFRGLHVPAFRGLHVLAFRGLHVLAFRGLHRATRPHHQKATRPRHAFRGQHIVAIRGLHVQAFRGGLHVPAFRGLHVLAFRGLHVLAFRGLHVLAFRGLHVIAFRGLHVLTFRGLHVIAFIGLHVLAFRGLHVLAVIGLHVLAVIGLHVLAFKGLHFLAFRGLHVIAFRGIHALAFRGLHVLAFRGLHVLGFRGLHVLAFRWLHVLAIRGQHVLAFIGLQVLAFRGLQALTFTGLHALASTSEDYMTTHPRHQRTTRPRLQGLHILAFRGLHVPAFRATVLAFRGLHVLAFRATRPRLQRTTRPRLQRTTRPFRGLHVLVFRGLHVLAFRGQHVQVFRGLHALCHTLISSGDLFLVACNFHLTILRPTWALQKIPPEGGCFWRKSPCSPGRA

SEQ ID NO: 137880 - protein, 165 aa, Glycine max
  Coding DNA Sequence Number=SeqID_46195
  Gene Ontology: Mol. function=enzyme inhibitor activity; Cellular component=cell wall; Biological process=double fertilization forming a zygote and endosperm
  Homolog annotation: Hit_ID=A7PDS0; Match level="QueryCoverage=75%, HitCoverage=54%, E-value=3e-35, Identity=59%"; Hit description =Chromosome chr11 scaffold_13, whole genome shotgun sequence
  Pfam annotation: Domain name=PMEI; Domain location=1-144; Score =119.5; E_value=9.8e-33; Accession=PF04043.6; Description=Plant invertasepectin methylesterase inhibitor
  Subcellular localization annotation: CTP_CleavageSite=69; ConfidenceScore=5.29e-01
MPPRDPLRSSCAKARYPTLCFQTLSNFSNLATKPLDLAQAAIKVSLARTRTLSVYFKTLNATSSRFGKRQRVAVSDCVEQISDSVTQLINTLNELQHLRAGTFQWQMSNAQTWTSAALTNGDTCLSGFNDGGTELEFVIMVIAVSCVKLLSAHNSTQHTSRKHKV

SEQ ID NO: 137881 - protein, 67 aa, Glycine max
  Coding DNA Sequence Number=SeqID_46196
  Homolog annotation: Hit_ID=A5BMG6; Match level="QueryCoverage=82%, HitCoverage=3%, E-value=6e-10, Identity=56%"; Hit description =Putative uncharacterized protein
MGAKYLEAVKQRLHAIKQWSPDKIRKNVCDSVIGMLLYVQGKTKDGLNSRQDLADMGIQSQLHPRFD

SEQ ID NO: 137882 - protein, 179 aa, Glycine max
  Coding DNA Sequence Number=SeqID_46197
LHYLAFRGLHVLVFRGLHVLTFRGLHVLAFRGLHVLTFRGLHVLAFRKLRALAFTPGPPPDIGGGPTQLSAQRPQCRSPPADVSVGLCRPDIGKYAYGSTDFLYHPLFAGIVLARHPVDPEKFNRVLRFPALITGFCQFYGVSVTLGKGETPQYPGDGWQRATNALPPPLEFISAHPRK

SEQ ID NO: 137883 - protein, 207 aa, Glycine max
  Coding DNA Sequence Number=SeqID_46198
MTSRDQVWSFCTQDTRRYLTVVRTLLSSRGGGPDDKQRPSLVILHPRYAEIPYGYLHPFARQTQLCPMASRDQVWSFCTQDTRRYLTVIRTLLSSRGGGPDDKQRPSLVILHPRYAEIPYGYLHPFARQTQLCPMASRDQVWSFCTQDTRRYLTVICTPLLGRHSCVRWQAETKFGHSAPKIRGDTLRLSAPFCHPEAAGPMTSRDQ

SEQ ID NO: 137884 - protein, 355 aa, Glycine max
  Coding DNA Sequence Number=SeqID_46199
  Homolog annotation: Hit_ID=A5B5V0; Match level="QueryCoverage=74%, HitCoverage=57%, E-value=2e-09, Identity=25%"; Hit description =Putative uncharacterized protein
MVEPLKKHKGSSSRSQRHSETQDIPIPSSISSSSLFSSDEQRIQYTNLFSSHSIIDPKFIDMYFFSDESFECIQAFQNSNLIPFMSPKLPVYSELVKAFYSNLEIQESTLISEVYGINMVIDQSLFYVLTQLSSDGVPFEGTLDDDWKFDFSVHDTRRLVCTNQADMTGRMLAGSLALESRTLHYLIVHILLPRSSNLAQVSEEDRIVMWAFHTGRQIGWAHLVRYCMHKALQLNAPLPYPHLVTLFLQHFNILLDFEPYVPIKRSFLIGAVVVASFGYRKERDGSWVKKGTQPNDDEGQLSVEGDSSLLQSILDRFDGLQTYVGERFEALVHSIPQCLFWEKSPRSNEEEQLAH

SEQ ID NO: 137885 - protein, 74 aa, Glycine max
  Coding DNA Sequence Number=SeqID_46200
MRVPRKEYAWSRHQRLFEENVRKTGKDAIYELLSERFGSCIYARGRTCKRNLQDSGTLKRVAWGLDVGTRVWPN

SEQ ID NO: 137886 - protein, 76 aa, Glycine max
  Coding DNA Sequence Number=SeqID_46201
MLGPIHDSPQISASPHQLDFAPYALGSYDAQWNAPGLLHDKHTLRSSRILRKMEVGFVVDLGMTFVDKWVVGNENG

SEQ ID NO: 137887 - protein, 139 aa, Glycine max
  Coding DNA Sequence Number=SeqID_46202
  Gene Ontology: Mol. function=transporter activity; Cellular component= intracellular; Biological process=transport
  Homolog annotation: Hit_ID=A5BH80; Match level="QueryCoverage=72%, HitCoverage=59%, E-value=9e-25, Identity=57%"; Hit description =Putative uncharacterized protein
MGLGEEVLAQEDERGRCFEPETSEDEWRKSRTRSLRRKAMTASTRLAYSLRKRNTRVANSDFASIFIEDVRDANEEKSVNSFCQVLLTRDLLPNSHDDYHEMLRSMKRYSVIILMATMVWAKRANRFILKDFAKLNPTS

SEQ ID NO: 137888 - protein, 260 aa, Glycine max
  Coding DNA Sequence Number=SeqID_46203
MEESMSPFLVRDFGAQNFKAIQAIHKAWETPLDWLAKLKVVSKESFEAPEEDEEVQALKSELGKAKLAKEKFKLAATHIGKECVGLREENATTARALEQETKRARKEEYGRNKFCGALWGSNSELKLRREERDQSRAHSMVLKEELVACSRSKRSLSQHLCETETNMLAIIAKYQEELDLATAHEHRVADEYAQVYAEKEARGRVIDSLHQEETMWMDQFALTLNGSQELPRLLAKAKAMADTYSAPEEIHGLLGYCQHM

SEQ ID NO: 137889 - protein, 96 aa, Glycine max
  Coding DNA Sequence Number=SeqID_46204
MPLSPVIFVTLADNELMSVASSFLSVGGAYLHEIAWLFRYGNGTGLTTEGYQGFWGAASLVKYTTKGLGLPKLLSSGDCIHICCSSLPSSPTSSRL

SEQ ID NO: 137890 - protein, 82 aa, Glycine max
  Coding DNA Sequence Number=SeqID_46205
MVHDIFVKVKLEVTRTSTILNVFGSRRSSDRKTKDHAWANMKTKGMQFVQQKQPTLRREGDVRLTGASSKKRIRVESPPTFI

SEQ ID NO: 137891 - protein, 235 aa, Glycine max
  Coding DNA Sequence Number=SeqID_46206
MGDQEETQEQMKADMSALKEQMASIMDAMLGMRQLMEKNAATAAAVSSAAEADPTLLATAHHPPSNIVGRGRDTLGHDGSPHLGYNRAAYPYGLPPNYSPPVLQDDAGHIASPVLEREPPQQPEEVHKDPQDYALREVEFYPLIPEGPAPSTLPQPNIATQPIVLSTEGPFPATEERRKLNLLEERLRAMEGFGDYPFADMTDLCLVPRCPLMVVFHHGDAAEDKGEEGRGGAIH

SEQ ID NO: 137892 - protein, 82 aa, Glycine max
  Coding DNA Sequence Number=SeqID_46207
  Subcellular localization annotation: CTP_CleavageSite=62; ConfidenceScore=5.34e-01
GSGVYPDLSSFTGSGVYPDLSSFTGSGVYPDLSSFTGSGVIQKLYSLYQVIRPVRFTSSGIRASALDTVGLKQTTVAKVMSI

SEQ ID NO: 137893 - protein, 412 aa, Glycine max
  Coding DNA Sequence Number=SeqID_46208
  Gene Ontology: Mol. function=DNA binding; Biological process =regulation of transcription, DNA-dependent
  Homolog annotation: Hit_ID=Q2HSK0; Match level="QueryCoverage=76%, HitCoverage=96%, E-value=6e-73, Identity=46%"; Hit description =Transcriptional factor B3
  Pfam annotation: Domain name=B3; Domain location=15-110; Score=39.5; E_value=1.2e-08; Accession=PF02362.12; Description=B3 DNA binding domain
  Pfam annotation: Domain name=B3; Domain location=211-314; Score=53.6; E_value=6.7e-13; Accession=PF02362.12; Description=B3 DNA binding domain
  Pfam module annotation: Pfam domain module=B3::B3; Domain location=15- 110::211-314
MAATFPQQLLVKPIHFFKIITAHNVHEGKLHVLRTILPISMMIPNKFVKKYGKRLQNTLFLKTPNGAEWKMILKKRDGKIWFQKGWKEFAEYHSLAHGHLLVHIFDLSALEIEYPTEIIKGKTASNRKGNESPGDEHLECHRSGQKRKVNSVEFLQQCQMRSRKCVKVENTMILPRQALHHTATKCKGKSKAMDNQVTALDRASSFKSCNPFFLTVMHRTHISSHGSLNLPMKFCRSHLDLHKKRRLISLQVLSGRIWPAKYQIHKQKTAIRFKLSWNAFVKDNNLKVGDVCIFELVHGTKLTFLVHIFRETDSSNCSTSQGRIDVCFSIPTIPYMSGSYHYPDSEGTQSLNYSYLDSYTHSRRLVLKEDIGPLSLANRSSLKGQGLFLYFVALSVATIGIALQCPHFCSHR

SEQ ID NO: 137894 - protein, 360 aa, Glycine max
  Coding DNA Sequence Number=SeqID_46209
  Homolog annotation: Hit_ID=Q6WAY6; Match level="QueryCoverage=32%, HitCoverage=20%, E-value=1e-13, Identity=37%"; Hit description =Putative uncharacterized protein
DWDQHLAGIRGSAINWFPRWKEGKEGVLFSCGDYPNVPLIGTRGCINYNPVLAIRQLGYPMRGAPTEGSLSPFLVKDLGPQGLKVIQRVHKAWRSPLRKDKELRGIRNGVIGGYHGWLRVHTRGLDWLSKLKVIDEENFEAPEEDEEVRALKLELGKARLAKEKFKLAATHIRKECTELQEENAVIARALEQKPKGPARRNMAKRNPRSIVGRSLAQHLEATEQSMLAIIGQYKEELNQSMAHEQKLVAEKEARGRVIDALHQEATMWMDRFALTLNGSQDLPRLLAKAKAMAKEQMKADLSALKDQMTSISEVMLKIQKTIEDKATATGSSTVREAEPVLQPGLNPQAYPYGLPLDFTP

SEQ ID NO: 137895 - protein, 85 aa, Glycine max
  Coding DNA Sequence Number=SeqID_46210
  Subcellular localization annotation: CTP_CleavageSite=60; ConfidenceScore=5.29e-01
MSERSSTRQFPSRQSGGHGPTKSDPLGASSSHIAATWPSSPRPALIKLLLMWQGGLPSSSCLNREPRLPLFLLAMFFLISACVGL

SEQ ID NO: 137896 - protein, 44 aa, Glycine max
  Coding DNA Sequence Number=SeqID_46211
MWRSNWFLEVTFESFITQLTDADQVRSQSLHQQYFVQTRKSIMD

SEQ ID NO: 137897 - protein, 80 aa, Glycine max
  Coding DNA Sequence Number=SeqID_46212
MEESMSPFLVRDFGAQNFKAIQRIHKAWETPLRKDQELRGIRNGIIGVVSEESFEAPEEDEEVQTLKNELGKAKLAKEKF

SEQ ID NO: 137898 - protein, 65 aa, Glycine max
  Coding DNA Sequence Number=SeqID_46213
MECPRAPPRYAHVAFESYPQKNGGLREPRRGYGFLCIIKLSCCTTHFLVGVLVYAKGGVLSLEVR

SEQ ID NO: 137899 - protein, 148 aa, Glycine max
  Coding DNA Sequence Number=SeqID_46214
MGEVEEVQEKMKADMEAMKEQMATMMEAMMIMKKIMEASAVAVAATSTVAKVNPMPPSGLNQMNHPTSAMVGKDLGSTGGPHDVKIQNEHAFPPYGLPLNYTPPKWRTLPIRMSITPLIYPLRANNPKLIMHMSLKPWGRHMKFPNTI

SEQ ID NO: 137900 - protein, 84 aa, Glycine max
  Coding DNA Sequence Number=SeqID_46215
MSKNNQTRLLQDYFDNHSKVKHCSKINTRLLQQTSIASRFIQDQLLSQNTLPPTYQGTGNRLPDSVIDYHKTSLPISFLKGFEI

SEQ ID NO: 137901 - protein, 89 aa, Glycine max
  Coding DNA Sequence Number=SeqID_46216
MHAHVVSSPMHHICLVIFVTGSRKVRITFLIACIGHHDSWVRSVATYPSAGGRRETHGCVFQGRKMLGVATNVYLRKNVRKTKKRVYEL

SEQ ID NO: 137902 - protein, 142 aa, Glycine max
  Coding DNA Sequence Number=SeqID_46217
MDECMMECIGHRCNLGMRGSGELVPFLDTTSRGSKMPQRTFLRRRHGPSVGLFTVGIKKNPYAMPMQKTPCGNSPVESPTVATYPSAGGRCETRGMRVPRKEYARSRHQRLFEENVGKTGKDAIYELLSERFGSCIYARGRY

SEQ ID NO: 137903 - protein, 54 aa, Glycine max
  Coding DNA Sequence Number=SeqID_46218
MESKKENRRSSDQMNFQRVALDWRCPAPPKQRGKDRNTQLPLQKHYPRENPIDP

SEQ ID NO: 137904 - protein, 159 aa, Glycine max
  Coding DNA Sequence Number=SeqID_46219
MVGYTPSSFADLVFTGKRIKVGLKKGKSDHHAFMKKTGESEEDENEGETHAVAAIPIWPSFPPTQQCHYSANNNPSPYPPPSYPQRQSLNQPQNPPTTQPMLNTTFSTNQNTNQEMSFAAKKPIEFTPILGSYADLLPYLLDNSMVAITPVKVHQPPFF

SEQ ID NO: 137905 - protein, 242 aa, Glycine max
  Coding DNA Sequence Number=SeqID_46220
  Homolog annotation: Hit_ID=UPI00016621D1; Match level="QueryCoverage =75%, HitCoverage=38%, E-value=3e-11, Identity=28%"; Hit description =UPI00016621D1 related cluster
RAPRHHLQRATCPRLQRTTHRRFRGIHAHAFRGLHVLTFRGLLALTIRGLHVLSFRGLHVLAFIGLHALAFRGLHVHAFRGLHVLAFRGLHVLAFRGLLALTIRGLHVLMFRGLHVHAFIGLHALALRGLHVLAFRGLRLLTFRRLHILTFRGLHALAFRRLHVLTFRGLHTLAFRGLDILTFRGLYALSFKGLHALAFRGLHIVASEGYTPSPSEDCTSSPLEGFLPSPSEGYTSSLSEDY

SEQ ID NO: 137906 - protein, 147 aa, Glycine max
  Coding DNA Sequence Number=SeqID_46221
LITGLCQSFGVPVTPSKVIQPPITRAFIEKYCTPRQAQGDAPQAVDAPPPPHQADPAGSFGMERYLQHLVQIHECLYQLSLSLQSQGFAPFACPTPDQFRAEVAWPRDWPEAQAGEAPAEAPGDAEEARMDEEMSDLLGFLGGSGAT

SEQ ID NO: 137907 - protein, 49 aa, Glycine max
  Coding DNA Sequence Number=SeqID_46222
MCVQEEERLIMEEGEKGMENLRKPVGSEQCIYSGSRMSSHVEAIGTLWF

SEQ ID NO: 137908 - protein, 299 aa, Glycine max
  Coding DNA Sequence Number=SeqID_46223
  Gene Ontology: Mol. function=oxidoreductase activity; Cellular component=cytosol; Biological process=metabolic process
  Homolog annotation: Hit_ID=Q2SYD8; Match level="QueryCoverage=98%, HitCoverage=90%, E-value=1e-100, Identity=63%"; Hit description =Quinone oxidoreductase
  Pfam annotation: Domain name=ADH_N; Domain location=28-109; Score =63.0; E_value=9.8e-16; Accession=PF08240.3; Description=Alcohol dehydrogenase GroES-like domai
  Pfam annotation: Domain name=ADH_zinc_N; Domain location=140-285; Score=89.1; E_value=1.4e-23; Accession=PF00107.17; Description=Zinc -binding dehydrogenase
  Pfam module annotation: Pfam domain module=ADH_N::ADH_zinc_N; Domain location=28-109::140-285
MPAAIIITQLGGPEVLRTTDIAIKAPGPDEVQIRHEVIGVNFVDIYYRSGLYPQSSSPAIPGFEGGGIVTATGINVRAFAQGDRVAYTGNPMGAYAEIRNIPASRLVRIPMNIDIRTAGSSMLRGLTAHMLLHKVRNVREGDWILVHSAAGGLGQLVTRWATMKGARVIGTTGSAAKVKIAQAAGAKEVLLHTDAAWADKAREISDGRGVHLAVDGIGGTMLSTTLSVVRPFGTVASLGQPAGPIPPVRVEELGFTRLIALMRPSSMAYADDAELYAQGARDLISALQNGLINPRHTQT

SEQ ID NO: 137909 - protein, 43 aa, Glycine max
  Coding DNA Sequence Number=SeqID_46224
MAGLAQQSKLDISIYGIKSESEGYNNYSGNPAASIPLHTRASN

SEQ ID NO: 137910 - protein, 333 aa, Glycine max
  Coding DNA Sequence Number=SeqID_46225
KYLEGKARDMASQEKWGPFADILALLIFGVVLFPNVDGLVDLAAIDAFLAYHHSKESPVVAILADLFDTFDRSAINWFPRWKEGMEGVLLSCGDYPNVPLIGTRGERQPKKVSRLSCEGSRRARSQGYTKNPQGVEESVEKDKELRGIRNGVIGVIDEENFEAPEEDEEVRALKLELGKARLAKEKFKSAATHIRKECTELQEENAATAKALEQETKRARKEEYGREKFRGALWGSNNELKLRREERDRSRAHGMILKEELVACARSKRNLAQHLEATEQSMLAIIGQFKEELNQSVANEQKLVEDFAQVNAEKEARGRVIDALHQEATMWMD

SEQ ID NO: 137911 - protein, 60 aa, Glycine max
  Coding DNA Sequence Number=SeqID_46226
MGAKPSQGPKKGRMSSSKGPGRKLVYDTNFLLSGCEIGCKRRCSDNHSGIPRIIGPAASG

SEQ ID NO: 137912 - protein, 192 aa, Glycine max
  Coding DNA Sequence Number=SeqID_46227
MVDYEYLKIVLGGGVSSGNNSISVDPDDTDAKTFEPENRTVGIEEFSYDPNTYQPPSPNQPSPPSHPPLDSEVPIEKQNYHKRRRSEYGGSSSAVGINNQGNVLENLSVGIGTIAVNFEKISNMMEKREKDRDRDRELEGIIWDVIKEIPNLDDITRFKTAELLNTKAKKDFFLPMSQEERSSWINFKLGNN

SEQ ID NO: 137913 - protein, 94 aa, Glycine max
  Coding DNA Sequence Number=SeqID_46228
MSALKEQMASMMDAMLGMRQLMENNVATAAAVSSAAEVDPTLPATAHPLPSVVGQERSTLGHISNPHLGYNRVAYPYGLPPNYTPPVMPDDPGH

SEQ ID NO: 137914 - protein, 156 aa, Glycine max
  Coding DNA Sequence Number=SeqID_46229
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNDRVFPVDSRGSPVRASGGFEVRVMFGVENAMVDIVVDEVIVKMGVVIGINKGRVREVEIGGVDERREGVPSSNS

SEQ ID NO: 137915 - protein, 96 aa, Glycine max
  Coding DNA Sequence Number=SeqID_46230
MTIEESIHVTFDETNITSPRKEFVDDIAYALEDTQNEERNLKRMRDDEDKDDQDDTTQENDNLPKEWKTSRNHPLDNIIGDISKGEEVYVEQPPGF

SEQ ID NO: 137916 - protein, 88 aa, Glycine max
  Coding DNA Sequence Number=SeqID_46231
  Homolog annotation: Hit_ID=A5AK77; Match level="QueryCoverage=71%, HitCoverage=7%, E-value=2e-07, Identity=42%"; Hit description =Putative uncharacterized protein
MAQTPPRERTLREMAAPDFMYESLCIQYPDEGVPYVLKTGLIHLLPKFHGLLGEDPHKHLKEFHIVCSTMKPPDVQEDHIFLTPFLVL

SEQ ID NO: 137917 - protein, 190 aa, Glycine max
  Coding DNA Sequence Number=SeqID_46232
  Homolog annotation: Hit_ID=UPI00016621D1; Match level="QueryCoverage =83%, HitCoverage=34%, E-value=5e-07, Identity=28%"; Hit description =UPI00016621D1 related cluster
GCTPCALRGLHVHAFRGLRLLAFRGLHVLPIRELHVLAIRGLHALAYRGLHVLTFIGLHALALKGLHRAPRPHLQRATCPRLQRTTHRRFRGIHALAFRGLPVLTFRGLLALSIRGLHVLTFRGLHVLAFIGLHALVFRGLHVHAFRGLHVLAFRGLHVHAFRGLHVLTFRGLLALTFRGLHVLVFRGLH

SEQ ID NO: 137918 - protein, 607 aa, Glycine max
  Coding DNA Sequence Number=SeqID_46233
  Gene Ontology: Mol. function=amino acid transmembrane transporter activity; Cellular component=integral to membrane; Biological process=amino acid transport
  Homolog annotation: Hit_ID=P25737; Match level="QueryCoverage=38%, HitCoverage=48%, E-value=1e-120, Identity=90%"; Hit description =Lysine-specific permease
  Pfam annotation: Domain name=AA_permease; Domain location=379-607; Score=52.6; E_value=1.4e-12; Accession=PF00324.12; Description=Amino acid permease
  Pfam annotation: Domain name=LysR_substrate; Domain location=173-368; Score=87.3; E_value=4.9e-23; Accession=PF03466.11; Description=LysR substrate binding domain
  Pfam module annotation: Pfam domain module=AA_permease::LysR _substrate; Domain location=379-607::173-368
DIDGDPADANVGNLRKSETKAVENDPETQQVLFGEDHAAVTGFPDMWVNGVTHDHAEQYRQPQDPARSATMYDDAVSNHAHYIAPAGSLCRSAEKRVDDAGIADAGALAICGQRSPDRPRRSAGRSAFRQGREAPGGQRARAPSLPARAGLAGAGYRNRTAVPRRQRGDPRLRQQHHRELHPAGSDCPLPSGFSHPAAGMSVGNSQDVINAVIDFRVDIGLIEGPCHNVDIIAEPWLEDELVVFASPASSLLQGEVTLERLAQAQWILREQGSGTREIVDYLLLSHLPHFQLGMELGNSEAIKHAVRHGLGISCLSRRVIAEQLETGSLVEIPVPLPKLESGSSATIAPHLLNGQHFHMVSEIKTTEAPTLRRELKARHLTMIAIGGSIGTGLFVASGATISAAGPGGALFSYILIGLMVYFLMTSLGELAAYMPVSGSFSTYGQKYVEEGFGFALGWNYWYNWAVTIAVDLVAAQLVMNWWFPDTPGWIWSALFLAVIFLLNYISVRGFGEAEYWFSLIKVATVIIFIVVGVAMIVGIFKGAEPAGWSNWAIGDAPFAGGLSAMIGVAMIVGFSFQGTELIGIAAGILAYPAVLCVRDPDYQPDHP

SEQ ID NO: 137919 - protein, 103 aa, Glycine max
  Coding DNA Sequence Number=SeqID_46234
RFVSKRPFRGKTGSNKIEENHSKCINLTQIFDRELSLFWKRVSSSIVNDFFSWETPLFLLPRTGMEISSWVKVYSGLRSWLKRLAERPNMMYVTVLVWPVVQG

SEQ ID NO: 137920 - protein, 86 aa, Glycine max
  Coding DNA Sequence Number=SeqID_46235
MDRVTSLLRLLPNTFRTIDVLVTSSFTLSHVEKSKLIQPHVLQHALRCPYRTCARARVTGEVEEAQEQMKADMEAMKEQMAMMSMK

SEQ ID NO: 137921 - protein, 71 aa, Glycine max
  Coding DNA Sequence Number=SeqID_46236
MRGAPTKESLSPFLVRDLGAQSLKVIQRVHKAWRSLLRKDKELRGIRNGVIGGYQGWLRVHTRGELRSSGG

SEQ ID NO: 137922 - protein, 73 aa, Glycine max
  Coding DNA Sequence Number=SeqID_46237
  Homolog annotation: Hit_ID=A5APP5; Match level="QueryCoverage=95%, HitCoverage=8%, E-value=2e-17, Identity=49%"; Hit description =Putative uncharacterized protein
MLHELVPLRRSIRERRNAIPDDYVVFCQEREENNGMIKAMNEKHKSMQDNKTKRDSNGNVERYKARLVANGYT

SEQ ID NO: 137923 - protein, 145 aa, Glycine max
  Coding DNA Sequence Number=SeqID_46238
MTDLVSAEDDTAIKNVYTDNHSGFSARQRDSNVSMTDLVSAEDDVNLRMSTGLLAAIDEGRRRRRQTLRAIRLFALQTAKKNVYTDNHSGISARQRDSHVSMTDLVSSKDDTGKKNVYTDNHSGISARQRDSHVSMTDLVSAKDD

SEQ ID NO: 137924 - protein, 72 aa, Glycine max
  Coding DNA Sequence Number=SeqID_46239
  Homolog annotation: Hit_ID=Q51617; Match level="QueryCoverage=63%, HitCoverage=66%, E-value=1e-15, Identity=91%"; Hit description =Putative uncharacterized protein
  Subcellular localization annotation: CTP_CleavageSite=56; ConfidenceScore=5.52e-01
MTGYIFEGVSRGPFVSRVSVMTVKTSDTCSSRRRSQLVCKRMPGADKPVRARQRVLAGVGAGLTMRHQSRLY

SEQ ID NO: 137925 - protein, 47 aa, Glycine max
  Coding DNA Sequence Number=SeqID_46240
DATVFEVFNPDFPLYIKHENLSEITHGGLDDAPQPKSKAPARWIVVK

SEQ ID NO: 137926 - protein, 45 aa, Glycine max
  Coding DNA Sequence Number=SeqID_46241
MGLSGLKEHSNPVTPKAYTPKSPSGSLPPDSGPTPKIILAHRHCS

SEQ ID NO: 137927 - protein, 54 aa, Glycine max
  Coding DNA Sequence Number=SeqID_46242
MSLPSAVHVFSIIKRETSEEKRRSRDDSRHHGKGQDGRNQCPIFAFLLSPMRGK

SEQ ID NO: 137928 - protein, 136 aa, Glycine max
  Coding DNA Sequence Number=SeqID_46243
  Subcellular localization annotation: CTP_CleavageSite=48; ConfidenceScore=5.07e-01
MPTLDPNKKKNPKPIAPSLPMWQVVKWKRFSSLTAENLKQLSNDANVLAAMPMQAEDWNLQLHHLKKIEKKLLLRGGELHPCKSYQFDDEKGDTKEFKRLVLCFFGKGRRETPKEFKRLVLGGFFLAKGEENEKDE

SEQ ID NO: 137929 - protein, 130 aa, Glycine max
  Coding DNA Sequence Number=SeqID_46244
MWSRQLLQPTLRREGDTRLTGTLSKKGKCTESPPSLFEENVRKTGKRCGLRTLSVKGSGVVFMHGEDEWQRNGEGRERGDATSKEKMSLEEAYDHRRPWIRAWRKKEMNEGRGREEHKILCSKRALKSEV

SEQ ID NO: 137930 - protein, 104 aa, Glycine max
  Coding DNA Sequence Number=SeqID_46245
MIEVFIEAIASLTQYYDQLLRCFTFGDFQLVPNVEEFEEILGCPLGGRKPYLFSGFYPSMGRIAKVVKIFAQELDRVKQNRNGVVGIPKKHLEEKAKALANQGE

SEQ ID NO: 137931 - protein, 28 aa, Glycine max
  Coding DNA Sequence Number=SeqID_46246
MWSPLKVRTCNPLKARNRSSGGKIRGLG

SEQ ID NO: 137932 - protein, 101 aa, Glycine max
  Coding DNA Sequence Number=SeqID_46247
MAFKKRKAPTTPSQVRVDRSRFTSQEAWERYTDIVVPRKLLPKRNVVVYYTEFDEFKEELERRHWDEELTDFADGSIDIAIVKEFYANLYDPEDKSPKQVR

SEQ ID NO: 137933 - protein, 233 aa, Glycine max
  Coding DNA Sequence Number=SeqID_46248
  Gene Ontology: Mol. function=secondary active sulfate transmembrane transporter activity; Cellular component=outer membrane-bounded periplasmic space; Biological process=sulfate transport
  Homolog annotation: Hit_ID=Q5PIR5; Match level="QueryCoverage=59%, HitCoverage=41%, E-value=4e-65, Identity=89%"; Hit description =Periplasmic sulphate binding protein
  Pfam annotation: Domain name=PFK; Domain location=1-70; Score=-173.7; E_value=0.062; Accession=PF00365.11; Description=Phosphofructokinase
GIAKGKKHAIVAITEHIWDVDELAKYIETETKRETRATVLGHIQRGGSPGPYDRILASRMGAYAIELLLQGHGGRCVGIQNEKLVHHDIIDAIENMKRPFKGDWLDCAKKLVLAKDIQLLNVSYDPTRELYEQYNKAFAAHWKQETGDNVVVRQSHGGSGKQATSVINGIEADVVTLALAYDVDAIAERGRIDKNWIKRLPDNSAPYTSTIVFLVRKGNPKQIHDWNDLIKPG

SEQ ID NO: 137934 - protein, 208 aa, Glycine max
  Coding DNA Sequence Number=SeqID_46249
MRGAPTEESLSPFLARNLGAQSLKAIQRVHRAWRSPLRKDQGLRGIRNGIIGGYHECEESFEAPEEDEEVQALKSELGKAKLSKEKFKLAATHIRKEYAGLREENAITTRALEQETKRARKEEYGRNKFRGALWGSNSELKLRREERDQSRAHSMVLKEELVACSRSKRSLSQRLCKTETNMLAIIAKYQEELGLATAHEHRIADEYA

SEQ ID NO: 137935 - protein, 91 aa, Glycine max
  Coding DNA Sequence Number=SeqID_46250
QPVEWILSTPTPYRLVEPVQVIEVSSSEEDPEEDPEELPPKPAVDDLDLPEDDEDPLPDVDSPEDVMSASEADSTEESGPRGTANSDDSSS

SEQ ID NO: 137936 - protein, 115 aa, Glycine max
  Coding DNA Sequence Number=SeqID_46251
DSPQISASPHQLDLAPYASEPYNAQWNAPGLLRDKHTLRSSRILGEMEADFVVDLGMAFVDNWAVGKQEVCYWLSNDIVGFGGKLGRIGMAVTAWVSPSFSPSSFAPVFSVVLVG

SEQ ID NO: 137937 - protein, 135 aa, Glycine max
  Coding DNA Sequence Number=SeqID_46252
  Subcellular localization annotation: CTP_CleavageSite=52; ConfidenceScore=5.33e-01
MNVGALISGHITSMAQSNSSRLGFPGLITTLCRSRGREDESSETCTPEPLIRRKRVVETQEATATYEKSLEATFEPSEPVVETASIQPIVDPSTPEDQTTPVLSSNTSPPATPVLHLTDDEDVQTQDTQDRSQDF

SEQ ID NO: 137938 - protein, 67 aa, Glycine max
  Coding DNA Sequence Number=SeqID_46253
MTEWYLEICRGGQETLGTSGGVLLAKTKLDQSRPNPGIVSSWQSTDKRTKTTKQGGSCGGWPAMDLE

SEQ ID NO: 137939 - protein, 121 aa, Glycine max
  Coding DNA Sequence Number=SeqID_46254
MSRNFTDCATMPSFDFRHITELHELPNDGPQQQMPSLYDRTMKLEETLAQFMQVPMSNQKSTESAIKNLQVQVGQLAKQLAERPSNSFTSNTEKNPKEDYKAMITRSRMVIQVEESRDDHK

SEQ ID NO: 137940 - protein, 92 aa, Glycine max
  Coding DNA Sequence Number=SeqID_46255
  Pfam annotation: Domain name=zf-CCHC; Domain location=47-64; Score =20.0; E_value=0.0014; Accession=PF00098.14; Description=Zinc knuckle
MELMRLNQHEENGKKKKGITLKASSSIQEESDKEDLNEIEEDDDFSFFCYECNQPGHLRVDCLSFKKRMEKSDTKTFNDKKEKKAYVTWEDM

SEQ ID NO: 137941 - protein, 213 aa, Glycine max
  Coding DNA Sequence Number=SeqID_46256
MGDRVTTDRRLFPALDEQRTSLQGSPKWPRGSWPQRDLGRIKRLKEPASLPNMTATVLGALSTNSASTPSRDGHFSGSDAGQWIPFDADALSQFLGYPLVLEEGQECEYGQRRNRSDGFDEEVIAQLLCIPGNIQPSNHNSDLPLPKCQLVYAILTRMSIHVAQLIADAIYLFVGMAPTRHPLDPDKSNRALRFPALITGLCQSFGVPVAPSK

SEQ ID NO: 137942 - protein, 153 aa, Glycine max
  Coding DNA Sequence Number=SeqID_46257
  Gene Ontology: Mol. function=oxidoreductase activity; Cellular component=integral to membrane; Biological process=potassium ion transport
  Homolog annotation: Hit_ID=P0A9T4; Match level="QueryCoverage=100%, HitCoverage=44%, E-value=1e-68, Identity=86%"; Hit description =Protein tas
MRYLHLADKHDLPRIVTIQNPYSLLNRSYEVGLAEVSQYEGVELLAYSCLAFGTLTGKYLNGAQPAGARNTLFSRFTRYSGEQAQKAVAAYVDIAKRHNLDPAQMALAFVRRQPFVASTLLGATTMEQLKTNVESLHLELSEEVLAEIEAVHK

SEQ ID NO: 137943 - protein, 269 aa, Glycine max
  Coding DNA Sequence Number=SeqID_46258
  Gene Ontology: Mol. function=motor activity; Cellular component=cell projection
  Homolog annotation: Hit_ID=UPI00016621D1; Match level="QueryCoverage =81%, HitCoverage=40%, E-value=3e-23, Identity=35%"; Hit description =UPI00016621D1 related cluster
LHVLTFRGLHVLTFRGLHALAFRGLHVLAFRGLHILTLRGLHVLTIRGLHALAFRGLRAFTFRGLHVLAFRGLHVLAFKGLHVLAFRGLHALAFRGLHVLVIRRLHALAFRGLHVLAFRGLHILTFRGLHVLPFRGLHALPFRGLHILTFKGLHVLTFRGLHTLTFKGLHVLTFREQHVLSFRGLRALTFRGIHVLAFRELHVLAFRGLHALAFRGLHVMQSYPPRVLDRRLQEDWARATKEGSRVLMTLRVYFLSPWTKVGSSLLCKY

SEQ ID NO: 137944 - protein, 165 aa, Glycine max
  Coding DNA Sequence Number=SeqID_46259
MDGLVDLAAIDAFVTYHHSKESPLFMYDWSRTSFIMKVDPPVPCKVTAYASRKGRPIGSSSWLVWWGHPLIGSPDGRKEESGFCPHEHRRKKVSRLSSPEVSVTPMQGYFKESAKHGSAVQRKDKELRGSSNWDHQPGYHKWLKAQTQELDWLPEAKDPQVRKEA

SEQ ID NO: 137945 - protein, 122 aa, Glycine max
  Coding DNA Sequence Number=SeqID_46260
MSLATLFGKLQEHEIELLRLHQHEENDKKNKGIALKASSSIQEESDQENDPDDDDDLSLFVKRFNKFLKKKMDKSEKKNLSEKKLKKTYITWEDNDMESSEDSENEEINLCLMAKSYESDEE

SEQ ID NO: 137946 - protein, 78 aa, Glycine max
  Coding DNA Sequence Number=SeqID_46261
MSSPSEDCTSLPLEHCMSSPLEDYISLPSEGCTPSPSEDYTSSPSEGYTSSLSEGSTSAPSEDLRDRARKTPSGPGEV

SEQ ID NO: 137947 - protein, 48 aa, Glycine max
  Coding DNA Sequence Number=SeqID_46262
MEELLGWVPLLGESKEGKLTYGEERVAGLNDDVTCDRGERGSKFNSLK

SEQ ID NO: 137948 - protein, 163 aa, Glycine max
  Coding DNA Sequence Number=SeqID_46263
  Homolog annotation: Hit_ID=Q2HS67; Match level="QueryCoverage=82%, HitCoverage=37%, E-value=1e-07, Identity=30%"; Hit description =Cyclin-like F-box; F-box protein interaction domain
MLSLEVSEKTEMKVYGAAKVGGVYLSGTLNWVKGKETIHSEIIIISVDLEKETCRSLFLLDDFCFFDTNIGVFRDSMCVWQDSNTHLGLWQMRKFGDDKSWIQLINFSYLHLNIRPYEEKSMILPFCMSNNGDFFMLKFTRNADDEYQTILYNQRDALNDFNL

SEQ ID NO: 137949 - protein, 104 aa, Glycine max
  Coding DNA Sequence Number=SeqID_46264
MYYNGKWNISRQGEFLGYSFTRTNPIRFGIPSGYSMDKLKDLIKQVAPIGVPHYGIHESQLVRRLFFRQSGHAKYSEKLIEYEIIELKDNEDMLKVSVQSNYWK

SEQ ID NO: 137950 - protein, 110 aa, Glycine max
  Coding DNA Sequence Number=SeqID_46265
  Subcellular localization annotation: CTP_CleavageSite=55; ConfidenceScore=5.30e-01
LVRESEVLTPPHLHFKLASEQVSSAVARRRRRNRRRLPPPPSLSGGHFSGEARVRLALGSASQPANSRQQRSSHAPPPPSRASSGACSPRAAVPTPESRHASAVLLVGFS

SEQ ID NO: 137951 - protein, 242 aa, Glycine max
  Coding DNA Sequence Number=SeqID_46266
MVIDQSLFYDLTQLSSEGVPFEGTLNDDWKFDFNVHDAHRLVCTNQADMTGRLLVGSLAFESRILHYLIVSEEDLIVMWAFHTGRQIDWAHLVRYRMHKALRLNAPLPYPHLVTLFLQHFNIPLDSEPDVPIKRSFLISAAVIASFGYRKDHDGSWVKKGAQPIDEEGHLPVEEDSSLLQMILDRFDGLQTFVGERFDTLGLQVDMRFDEMDSRITKVEGDVSYIFTCFDLPPLPPPSSLTL

SEQ ID NO: 137952 - protein, 15 aa, Glycine max
  Coding DNA Sequence Number=SeqID_46267
MASMDTSAMVNSKIF

SEQ ID NO: 137953 - protein, 93 aa, Glycine max
  Coding DNA Sequence Number=SeqID_46268
  Subcellular localization annotation: CTP_CleavageSite=89; ConfidenceScore=5.43e-01
MRVSKLSMDLGGSPPYQVNVAPSRDIGKTRHRIVSKASICSSGSVVSSYRSRLSDFHPKGMSTSITRSIKGCQWTVCVVGRCMRETRIVCSVA

SEQ ID NO: 137954 - protein, 74 aa, Glycine max
  Coding DNA Sequence Number=SeqID_46269
MGVQIAPRPTWALQKAVASGGSNLARLGELSSPGGGSEEEKGSAPLALLSLSNFAWKNCFREENLSRGASETFP

SEQ ID NO: 137955 - protein, 97 aa, Glycine max
  Coding DNA Sequence Number=SeqID_46270
  Gene Ontology: Mol. function=structural constituent of ribosome; Cellular component=ribonucleoprotein complex; Biological process =translation
  Homolog annotation: Hit_ID=Q2PMP7; Match level="QueryCoverage=80%, HitCoverage=37%, E-value=2e-19, Identity=67%"; Hit description =Chloroplast 30S ribosomal protein S3
  Pfam annotation: Domain name=Ribosomal_S3_C; Domain location=9-82; Score=38.2; E_value=2.9e-08; Accession=PF00189.11; Description =Ribosomal protein S3, C-terminal domain
MGSKVIEEFIAGQLKNRVSFRKAMKKAIELTEQAGTKGGTNCRTYRKRNCSIVEWIREGRVPLQTIRAKIDYVAIQFELLWGRDQSLDGNDETCKLL

SEQ ID NO: 137956 - protein, 82 aa, Glycine max
  Coding DNA Sequence Number=SeqID_46271
MAPRKLASKRSRKDKAAEGTSSALEYDNHRFRSVVHQQCFEAIKGWSFLRERRVQLRDDEYTDFQEEIGHRRWASLVTPGIL

SEQ ID NO: 137957 - protein, 89 aa, Glycine max
  Coding DNA Sequence Number=SeqID_46272
IVPTRHPVDSKKANRVLELPTLITGLCQFYGVPVTPNKVIRPPTNRAFIKRYCAPRQAQGETPQRPGDGQQQTTNAPPPPPKPLSSSTK

SEQ ID NO: 137958 - protein, 81 aa, Glycine max
  Coding DNA Sequence Number=SeqID_46273
MVVIMPKEHLVVWFCLLHNRPDNYLKGIINSLNQRLRLGGLSLSVIDRKEYFNNPRPLVPERLKALRIQWAQYYLRVRAQS

SEQ ID NO: 137959 - protein, 157 aa, Glycine max
  Coding DNA Sequence Number=SeqID_46274
MKVSVEEVKDADAPIPVPTEEFKLVGQTLNTFLAWPTHLVKHLSEQGAVGPAKPADRPDHEVDDPLYLMTLTIPQLFLKPLQVMWDAIVFGVFNEDFPLYINHEDLSKIAHGGQCLNISVIQLWILHMTETSMRAGNADVYGFLEPQSIQRSGQSQI

SEQ ID NO: 137960 - protein, 157 aa, Glycine max
  Coding DNA Sequence Number=SeqID_46275
MGCYNGQCLSISVIQLWILHLTETTMRAGNSDVYGFLEPQSIQRSRQSQFDSESYIKSWMQSSKCNVYLGGYLNGALNGLDDTPQPKSKASTGWIVVKCNRQKGSTECGYYVMHWMSTIILGSFRNNREAYFNDARPLEPERLKALHIQWAQYYLRL

SEQ ID NO: 137961 - protein, 78 aa, Glycine max
  Coding DNA Sequence Number=SeqID_46276
MVAKDQLTMKDKRDEEEKLEKQKKKNDSKALSSKARGREISLSTVIPLELEVIPQLKELLDEGLVCKTLTPCALLGPK

SEQ ID NO: 137962 - protein, 74 aa, Glycine max
  Coding DNA Sequence Number=SeqID_46277
MGPKHLTRTKEWSHVIEQRSPDEIRHLEILRDLIRHPSKKLLSFEFAQSFHIQFQASRYITGLNWISKKKVIVV

SEQ ID NO: 137963 - protein, 113 aa, Glycine max
  Coding DNA Sequence Number=SeqID_46278
  Subcellular localization annotation: CTP_CleavageSite=79; ConfidenceScore=5.16e-01
TYQGNPCGVYPDLSSFTGSGVYPDLSSFIGSGVYPDLSSFTGSGVYPDLSSFTGSGVIQNLRSLYQTIRPVRFISSGIRASALDTAYSNSVWGKNCLIAELLNCQICLMMIAY

SEQ ID NO: 137964 - protein, 151 aa, Glycine max
  Coding DNA Sequence Number=SeqID_46279
  Homolog annotation: Hit_ID=A5AK77; Match level="QueryCoverage=54%, HitCoverage=10%, E-value=1e-09, Identity=39%"; Hit description =Putative uncharacterized protein
MTKGNPSNLQPFDPEIDRTFHRLVRHHLVPFEHPEHSAIGDFEHYCFEYSNFEHSENMAQPPPRERTLREMAAPDFTYESLCIQYPDEDVPYVLKTGLIHLLPKFHGLAGEDPHKHLKQFHIVCSTLKPPDVQEDHIFLKAFPYSLEGGIL

SEQ ID NO: 137965 - protein, 85 aa, Glycine max
  Coding DNA Sequence Number=SeqID_46280
  Subcellular localization annotation: CTP_CleavageSite=74; ConfidenceScore=5.23e-01
MLVRMIHTCLFAAARAKSCPGMHSSYVIASLSGCACTVWIWSPLKVRTRSPLKERACSSLKFTTCRLLKARECSPMMARTCNPLK

SEQ ID NO: 137966 - protein, 143 aa, Glycine max
  Coding DNA Sequence Number=SeqID_46281
VVHDELAGGERHAAVRAGHADEHDLVAGIQRADAVDHRHPLQRPTAARLGHDLRQRLLGHARVVFQHQRADVVTQIMVAHLAGEGHHRAIGVALRQPLVLVADVERRFAHANAGIFHAYPPVTGGKKATSSPARSGWSAATSD

SEQ ID NO: 137967 - protein, 128 aa, Glycine max
  Coding DNA Sequence Number=SeqID_46282
  Gene Ontology: Mol. function=chitin binding; Cellular component =extracellular region; Biological process=chitin metabolic process
  Homolog annotation: Hit_ID=UPI00006A17C9; Match level="QueryCoverage =74%, HitCoverage=100%, E-value=4e-10, Identity=32%"; Hit description= UPI00006A17C9 related cluster
  Subcellular localization annotation: CTP_CleavageSite=3; ConfidenceScore=5.52e-01
MARACSPVKARLCSPLKARVCNPLKARTHSPLKVRMCSPLKARTCSHLKVRMCSPLKVRAWSPLKVRACSPLKARTCSPLKARACSPLKSRTCSPLKAIGDNSCNLFLSFENLFGNSLKVYVLFDLLT

SEQ ID NO: 137968 - protein, 204 aa, Glycine max
  Coding DNA Sequence Number=SeqID_46283
MLESFKQQGQMSVLELYIEKDVVGGSMFHSANSLTSCGNYLSNDETQPTTNMSNLHIDEDDDDDDYLVSNSYVEESLDEDDSVDGISDTDDEVTNIPQPVRIVHPAEGAQRIENPFWNDAMLYNNINWSYPDEEDICGLELSSTFNIGQELYVGMEFDSKDAVKNAVKQYVMKVHQSFKVVESKSNKHDQRRSINKNFFDSRED

SEQ ID NO: 137969 - protein, 243 aa, Glycine max
  Coding DNA Sequence Number=SeqID_46284
MAVACCSSRAQWAGLLRGHSVPGRLPRRALPAGAEKAGWRGGFGGLKALPAVVRRSGSVPKGIRNEASPRCLTANLNAVECAIPLIGRWFEGRRKRLSRKGNFRKYRLTEREVAAECAASVETKALTNCSLTSRIKQFVWVLVILNAGGRPNTCKSSGVMVLALSLSGGRWGILDNGRKPDPAMPPPANSVPAAAVIQRVQALIGFTGRKARDGRIPGVAVKCVEIWRIPMAKAAIWPNTDAE

SEQ ID NO: 137970 - protein, 275 aa, Glycine max
  Coding DNA Sequence Number=SeqID_46285
  Gene Ontology: Mol. function=IMP dehydrogenase activity; Cellular component=integral to membrane; Biological process=GMP biosynthetic process
  Homolog annotation: Hit_ID=P0ADG8; Match level="QueryCoverage=20%, HitCoverage=11%, E-value=4e-21, Identity=98%"; Hit description =Inosine-5'-monophosphate dehydrogenase
MGYVRKYRPAYQSRAAASAVRAIYGGLSTIYAAEKIITPYGCASSVVVTPSPDSPPSHHPAGYAADRRIGGDAKAARQRRQRTYAFQLCCQPGSATAVTAAERAEYVPAAAGIAGAAAGDPAGDAPGATAGRPPPADDAAAGSAWFAGVPFTARADACCSIISVIVGAAHTAAKADASIAVAEHGTAQTCAPSSFRVKYHWRTPRWLLDGGTDIGGGDIAMLRIAKEALTFDDVLLVPAHSTVLPNTADLSTQLTKNIRLNIPMLSAAMDTVTEA

SEQ ID NO: 137971 - protein, 71 aa, Glycine max
  Coding DNA Sequence Number=SeqID_46286
MSVSTSSASVSRGQGFAPFACPTPDQFRAEVAWPEAQAGEAPAGAPDDAEEARIDEEMTNLLGFLGGSGAT

SEQ ID NO: 137972 - protein, 64 aa, Glycine max
  Coding DNA Sequence Number=SeqID_46287
MSQRALRGRARARLTGALSHGGKMRGVATNVYLWKTSGKPKETGRQRQGFCSYVPSFGEEIRPT

SEQ ID NO: 137973 - protein, 120 aa, Glycine max
  Coding DNA Sequence Number=SeqID_46288
MAPRKLASKRSRKDKAAEGTSSAPEYDSHRFRSAKHQQHFETIKGWSFLRERRVQLRDDEYTDFQEEIVRWRGGRVRYAILGEGSVDPVQCGCSQSVPGISFSAGRGPGVRVWPEEEPGQ

SEQ ID NO: 137974 - protein, 67 aa, Glycine max
  Coding DNA Sequence Number=SeqID_46289
MLGLSNKEADAYKYISLSNHALVFYAVAKITKPRSLVKPNQSKLRPQIPLVGLGPNPSCKTRLSSSN

SEQ ID NO: 137975 - protein, 105 aa, Glycine max
  Coding DNA Sequence Number=SeqID_46290
MLAIVSKYQEELNLATAHEHKVADEYARVYAEKEARGRVIDSLHQEATMWMDRFALTLNGSQELARLLAKAKAMADTYSAPEEIHGLLSYCQHIIDLMTHIIRNR

SEQ ID NO: 137976 - protein, 167 aa, Glycine max
  Coding DNA Sequence Number=SeqID_46291
MSHHSSSVNGEGTSHKDPLSRILDELSSLKLWKEKLERKEKGKERVEINQDEREQIRAEERRKILKELRKEKHASYSSHDPCKSLIEELHDYYEGRHRSHLRPHSHRREKERKPQEANINLPCLHGKDNVEAYLDWEIRVEQQLKGSLLQILMSLTHIQRKTKVKAS

SEQ ID NO: 137977 - protein, 228 aa, Glycine max
  Coding DNA Sequence Number=SeqID_46292
  Gene Ontology: Mol. function=motor activity; Cellular component=cell projection
  Homolog annotation: Hit_ID=UPI00016621D1; Match level="QueryCoverage =65%, HitCoverage=42%, E-value=2e-16, Identity=36%"; Hit description =UPI00016621D1 related cluster
IRGLQALTFKGLHILTFRGIYVLTFKGLHFLTFRGLHVLAFKGLQVLAIRELQVLVFRGLHVLAIRGLHVLAFRGLHVLTFRGLHVLTFRGLHILTFRGLHVLAFRGLHVLAIRRLHALTSKGLHLLTFRGLHVLTFRWLHALAFRGLHALAYRGLHGYRPSPSKDYTSLPSGGYTPSPSKDYMSFPSEDCTPSPLEDYMSSPSEDYTSSPSGGYTPSPLEDYTSSPS

SEQ ID NO: 137978 - protein, 118 aa, Glycine max
  Coding DNA Sequence Number=SeqID_46293
MGCMIGPFLGRIASPGIGPNISKCVQTVWVSCVNGAILELPLPTFQANKKFQGRYNKYITGRPSQDSMAQSISNYKSNRYKDTHQEAITWQKLYTNMNKTKDKRNEVEAKTTKRTVAE

SEQ ID NO: 137979 - protein, 170 aa, Glycine max
  Coding DNA Sequence Number=SeqID_46294
CWNPEDLTVSIRGARRARARPIEAPSTSAAPPPAHTLVAPSTLSSTDFQHLEAMLQSIHQGQIVLLQSLQLREDESSDTSTPEPLIRWKRIVETQEVAATSEKSLEATSEPSERVVDTTSIQQAVDPSTLEDQNTPVLSPNTSPLATPVLHLTDEEDVQTLDTQDRSQDF

SEQ ID NO: 137980 - protein, 100 aa, Glycine max
  Coding DNA Sequence Number=SeqID_46295
MSGCATVMNRNRGRSGVQSDSVWQKKADGSAEYVNTTHMREFLAELHRSVVTAATLRKWIPYNGAGIRINLQKILVYREESIRAKSRFLELRPPDKHHEI

SEQ ID NO: 137981 - protein, 131 aa, Glycine max
  Coding DNA Sequence Number=SeqID_46296
  Subcellular localization annotation: CTP_CleavageSite=82; ConfidenceScore=5.46e-01
NHPNLRWANPPQQQQQQQLVPPFQNVVGPSRPYVPPPIQQMTIQNMQFQQETRASIQSLTNQMRQMATQLNQAQSQNSDKLPSQTVQNPKNVSAITLRSGKQIEVPPPVAAPALEPVKLHSTPGKEDELAA

SEQ ID NO: 137982 - protein, 108 aa, Glycine max
  Coding DNA Sequence Number=SeqID_46297
MEETHEIPHHDLANFEPCLGYAAEGQAVGAFINPSQCQSIPDSPRIGCNYKQRVLVMESPGGSIEHGRALKRKVQGLIDAGAEIEERLATQVATPKNRDKRLCHNGEF

SEQ ID NO: 137983 - protein, 78 aa, Glycine max
  Coding DNA Sequence Number=SeqID_46298
MWAIIDQYKEKLNLAATHEQRIEDVYAKRSDDVDGQIHLDFEWESRASPTASQGQGNGGCVLSPEGGSRAPQLLPTHD

SEQ ID NO: 137984 - protein, 126 aa, Glycine max
  Coding DNA Sequence Number=SeqID_46299
MGAKHLEVVKRGSHPNNGWSPNDIRGAEFVYARLSLNEHADNRMSSEIAKESFKSADNHLGISACHMTPGVQKMTLVSACYHALSLRDSKRKFKRITTRGAEDDGQYDRDCGVAGKSEALAPTYPQ

SEQ ID NO: 137985 - protein, 137 aa, Glycine max
  Coding DNA Sequence Number=SeqID_46300
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=71%, E-value=1e-24, Identity=69%"; Hit description=LacZ protein
  Subcellular localization annotation: CTP_CleavageSite=31; ConfidenceScore=5.32e-01
NPSTQGCATSQSTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 137986 - protein, 100 aa, Glycine max
  Coding DNA Sequence Number=SeqID_46301
PEIIGKFFGMKHDLAALQSPVFPFNYAILLWCNGCRELMSDAFRCAEFSKLAVFKLSAMVFDFSDKVDPGKSGEIIHNNIDIPLSSKAFNLHRPHQVHVK

SEQ ID NO: 137987 - protein, 133 aa, Glycine max
  Coding DNA Sequence Number=SeqID_46302
MAFPYMGSAISFHSEPVITALRVIVLTQHHKNPVANLLNILLSLYTEKRSLVTGDMSTGGFFVSTLFDFFENRFHLAVSLSTGRAGSRSRVMRDGLAGRGEVENIGCQGGQCIDHLILFPRYVVERNVVKEFS

SEQ ID NO: 137988 - protein, 75 aa, Glycine max
  Coding DNA Sequence Number=SeqID_46303
  Subcellular localization annotation: CTP_CleavageSite=29; ConfidenceScore=5.16e-01
GFCFYQLSLLSATDGVVRNGKSTRRTSALASVAAAQLLGRAIGAGLFAITPAGERGMCCKAIKLGNARVFPVTTL

SEQ ID NO: 137989 - protein, 92 aa, Glycine max
  Coding DNA Sequence Number=SeqID_46304
  Subcellular localization annotation: CTP_CleavageSite=84; ConfidenceScore=5.18e-01
MENGFARPSHFPVKYLSWHLPGNLRPVRKAISARRSRTTERSESCQHSKPVYTPLAPQYANRLSPRVGRFINAAGTTGFPTGKRAVSATQLM

SEQ ID NO: 137990 - protein, 74 aa, Glycine max
  Coding DNA Sequence Number=SeqID_46305
MTWQDLPEISTKDHDFTSKDCTVLCSCYSQQMIISKTVIKCLKAEKSITSLQPLQNAKICQTLECQLLPSSAIA

SEQ ID NO: 137991 - protein, 267 aa, Glycine max
  Coding DNA Sequence Number=SeqID_46306
MASRKRKAIASMSQFTNLTEGSIDVAIVKEFYANLYVPEDKSPKQVRVRGHLIKFDVDSLNTFLETPMGLPWKLLRKDLTTLAQTWSVLSYSNLAPTSHTSDLNLERTKLVYELVMKMNMNLGSLISGQISLIAQSNSSRLGFTALITALCKARGVTSDSLTFESLNLAINLAYIKKNCWNLDEPSVTFPGTQKSKARRSEAPSTSAASTPPTSAPSTSALPSPPAAPVLPEPASGPAPDHTEFAGCGPTAASYELGGVCSEDGLAR

SEQ ID NO: 137992 - protein, 241 aa, Glycine max
  Coding DNA Sequence Number=SeqID_46307
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
DLPSQVLQWLLFLSAVPPVQLLTGWCVTAKAPPDISAGKCSGRVPFAIQAAQLLGRAIGAGLFAITPAGERGMCCKAIKLGNARVFPVTTFFGSSLASTIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 137993 - protein, 191 aa, Glycine max
  Coding DNA Sequence Number=SeqID_46308
  Gene Ontology: Mol. function=DNA-directed DNA polymerase activity; Biological process=metabolic process
  Homolog annotation: Hit_ID=Q4UQ98; Match level="QueryCoverage=86%, HitCoverage=38%, E-value=7e-54, Identity=60%"; Hit description=DNA polymerase related protein
  Pfam annotation: Domain name=UDG; Domain location=53-186; Score=44.9; E_value=2.8e-10; Accession=PF03167.10; Description=Uracil DNA glycosylase superfamily
MHDRPAQAPQRKIPARALAPMPAADAKGLQTLRQQALACHQCPLWEAATQGVFGEGPADAPIMVVGEQPGDVEDLRGQPFAGPAGQLLDRALAELGIDRATLYLTNAVKHFHHERRGKIRLHKRPESRHIQACRPWLMGEIARVRPQVIVCLGATAAASVFGRDFDLSRDRGRWHTLEDGTRGYATVHPSW

SEQ ID NO: 137994 - protein, 125 aa, Glycine max
  Coding DNA Sequence Number=SeqID_46309
  Homolog annotation: Hit_ID=A5BKB9; Match level="QueryCoverage=54%, HitCoverage=7%, E-value=1e-12, Identity=48%"; Hit description =Putative uncharacterized protein
  Pfam annotation: Domain name=zf-CCHC; Domain location=54-71; Score =22.1; E_value=0.00069; Accession=PF00098.14; Description=Zinc knuckle
MGLKNQGSHLVHYVSHQGNQGAEKKFMKKHDKGKGPLKINEDSLQIQQKVSKDNNCQFCGKYGHFQKDCQKRKSWFEKKGELNAHRFLTIQTISPNEKFIFIGNRVKALVEAVGTYRLKLDTDMI

SEQ ID NO: 137995 - protein, 459 aa, Glycine max
  Coding DNA Sequence Number=SeqID_46310
  Homolog annotation: Hit_ID=A1HBA1; Match level="QueryCoverage=97%, HitCoverage=29%, E-value=2e-66, Identity=38%"; Hit description =Putative uncharacterized protein precursor
MQRIFRPQNFTSGCHRGSQLYQRILLVIRYAKYMLARHQRPGVALAGWPRKQTLRAFLRQLAVLLRNGSQFRTFFRPGDQRFKRLRQHGFQLRVYRIVCVLTCHRHAQRVLWTVRQQTVQVKRTARFRTGAGQTFTAERLHAHDRADHVAVNVQVAHFGAAGHLRDGFVNTGVYAERQAICGGVDLINQLVKVVTVVAHHVQHRAEDLFFQLVEACQLNQRWRHKGSCPPFAGIFAVLADRLEHRTAFRAHGLNVVFDVGFGFRVDHRPDIGGETARVAHAAFGHRAAQHLQRVVRHVVLQAQHAQGGAALAGAVERGGQHVDHHLLGKGRGVNDHGVHPAGFRDERSRAALRIQTGGNIALQQRRHFGRTGEHHAAHTVIGGQFGTDRFTAARQQLNHARRHAGFEKNVDALRGNQRGLLCRFCQHAVACGQRGGNLAGEDRQREVPRADTRRPDPAE

SEQ ID NO: 137996 - protein, 17 aa, Glycine max
  Coding DNA Sequence Number=SeqID_46311
MEDRRTTLGNQFAGLQT

SEQ ID NO: 137997 - protein, 26 aa, Glycine max
  Coding DNA Sequence Number=SeqID_46312
SETCQKSKGSGLAQSVKFCDVAEIEK

SEQ ID NO: 137998 - protein, 120 aa, Glycine max
  Coding DNA Sequence Number=SeqID_46313
MGASGNRLPACVIDYTEEWVTDEPARTLQRTVEWILPTPTPYRLVEPVQVIEVTSSEEDPEEDLEELPPEPAVDALDFLEGDEDPLLEVDSPEEVMSASEADSTEDSGPGEMAISGGSSS

SEQ ID NO: 137999 - protein, 97 aa, Glycine max
  Coding DNA Sequence Number=SeqID_46314
MAPQRLTHKKFPVESPTVATCPFAGERGEAHGCAFQRRKDARSRHQRLFVENVRKTEGNPVIKNIPSSGVVFTFKEGRQKQGSCSYVPSIEEEIRPT

SEQ ID NO: 138000 - protein, 101 aa, Glycine max
  Coding DNA Sequence Number=SeqID_46315
MAPMMSIPHKEKGQGGGHDIQRMWRNIDIVRERLTFMAFPYMGAAITFHGEPVITCSKDLPGHSMPIGVRSKRTLVDFLDHVVHLFGIHASQEGHVMVSLV

SEQ ID NO: 138001 - protein, 187 aa, Glycine max
  Coding DNA Sequence Number=SeqID_46316
EVVETLQYMVLPQGRNTWTVDDLVPYVGKLAIISEEQERITEPVSHGPASEREFSAQEFHILQSSVETRGIGRRRESVEAEEYSQQMMERGHEMYYTPATFSQYPSQMYQYPFEGHYTDTSASEHLFCGVVKTQPHFLWPTMTPSQQHDVPMETPNAPLAPQWNEFSAEAEQVEAGRQRDRRNPDRQ

SEQ ID NO: 138002 - protein, 96 aa, Glycine max
  Coding DNA Sequence Number=SeqID_46317
MSLHVLDLDVFSGFPPGIPRLLGRIILSYLLGWGQNMNSRNQSRYLGTDASGDGVTTDRSLPLLCAKQAENVAQGSPVSFGFAVFYYHCLFLLINA

SEQ ID NO: 138003 - protein, 164 aa, Glycine max
  Coding DNA Sequence Number=SeqID_46318
VPSVVRLMKRANVFPWKKTLEKFIIWEINSDKGILKEDFQASSRVSIINKDSGGHTLATSSIKTRVTMSNHKSTESTLKNLEVQVGQLAKQIADKSSNSFVENTEQNAKEECKVVMTRSKRFVEAKDEESVVHKEKAAEKKGTEVMKNDVRGEGNQEKGKQIMV

SEQ ID NO: 138004 - protein, 86 aa, Glycine max
  Coding DNA Sequence Number=SeqID_46319
MARSVSASCPYSKDLYGRELKRKSPKMLKHPRPIHIYWEEKSGSFYHGRSQILPCFAKIVYLLGTRLLFIADHATALALLKKAGDS

SEQ ID NO: 138005 - protein, 207 aa, Glycine max
  Coding DNA Sequence Number=SeqID_46320
ARLAKEKFKLAATDIRKECVGLREENATTARALEQETKRARKEEYGRNKFRGALWGSNSELKLRREERDQSRAHGMVLKEELVACSRSRRNLSQRLCKTETNMLAIIAKYQEELSLATAHEHRVADEYAQVYAEKEARGRVIDSLHQEATMWMDRFALTLNGSQELPRLLAKAKAMADTYSAPEEIHGLLGYCQHMIDLMTHIIRNR

SEQ ID NO: 138006 - protein, 106 aa, Glycine max
  Coding DNA Sequence Number=SeqID_46321
  Pfam annotation: Domain name=Ins_element1; Domain location=10-82; Score=-22.6; E_value=0.021; Accession=PF03811.4; Description =Insertion element protein
DLPSQWLLFLSAVPPCSATDGVVRNGKSTAGHQRWQAAQLLGRAIGAGLFAITPAGERGMCCKAIKLGNARVFPVTTLANWSSTAVAAALELVDPPGCRNSIPVKR

SEQ ID NO: 138007 - protein, 204 aa, Glycine max
  Coding DNA Sequence Number=SeqID_46322
  Pfam annotation: Domain name=Transposase_23; Domain location=119-189; Score=5.0; E_value=0.00033; Accession=PF03017.5; Description =TNP1ENSPM transposase
DVLVAAIGRPEHPGRVRAAGAGVTIKQYFGSAPQTSRSASSLPPDKLQQLTQQIRDQLEESITEKVTRQVMASFSQLQSQMQSQELAVPLEPLVGPGPFGPRVSTKGSCVDPSRNDPETGDSDRCGLYIEADPARLVAMGRVYEGSALVHNTPLLPGQVKVGVEEVTDVDAPVPVPTDEVSLVGQTLHTFLAWPTHLVKSLSQQ

SEQ ID NO: 138008 - protein, 75 aa, Glycine max
  Coding DNA Sequence Number=SeqID_46323
  Homolog annotation: Hit_ID=A0ST23; Match level="QueryCoverage=36%, HitCoverage=55%, E-value=2e-08, Identity=100%"; Hit description =Putative reverse transcriptase
MSTSFEDIIKLIDTVDLEGGPVGKPVVPAALMNRPTRGERRFAYWALAECILAYYVGTDEGVSEVLHVAEKKAAP

SEQ ID NO: 138009 - protein, 120 aa, Glycine max
  Coding DNA Sequence Number=SeqID_46324
MSSRGKKTISFLRVSPLFEQNCNCGQGFNKRFGPHKIDSERHSGPTTGVPRRQGEGYGQSRRLGPVYGCVSFANFWDRPLSKRGWFGGPSSNRRYRPAPGISVSTGRGPGVRVWPEEEPV

SEQ ID NO: 138010 - protein, 282 aa, Glycine max
  Coding DNA Sequence Number=SeqID_46325
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDTFLLTPCALHYNLTPQVPNLELYTFLLTPRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138011 - protein, 61 aa, Glycine max
  Coding DNA Sequence Number=SeqID_46326
  Homolog annotation: Hit_ID=A0PAV3; Match level="QueryCoverage=57%, HitCoverage=15%, E-value=6e-07, Identity=80%"; Hit description =Restriction endonuclease
  Subcellular localization annotation: CTP_CleavageSite=54; ConfidenceScore=5.11e-01
MVKVGTSYVPINVSFSPKVGPGLPGINRDTRIYLFCESSVTGAPVASVSISCPSCSATDGV

SEQ ID NO: 138012 - protein, 236 aa, Glycine max
  Coding DNA Sequence Number=SeqID_46327
  Gene Ontology: Mol. function=motor activity; Cellular component=cell projection
  Homolog annotation: Hit_ID=UPI00016621D1; Match level="QueryCoverage =97%, HitCoverage=40%, E-value=5e-20, Identity=34%"; Hit description =UPI00016621D1 related cluster
GGPLGTSTLTLRGLHALAIRGLHVLAFRGLHVLAFRGLHVLAIRGLHVLAFRELHVLAIRGLHVLAFRGLHVLAFRGLHVHSFRGLRALTFRGLHVLTLEDYTSSELRVLAIRGLHVLTFRGLHVLTLRGLHVLALRGLHALTFRGLDVLTFRGLHALTFRGLHVLPFRGLHALTFRRLHVLAFKGLHALAFRGLDVLTFRGLHALTFRGLYILPLRGLHVLAFGGLHALTFRGLH

SEQ ID NO: 138013 - protein, 186 aa, Glycine max
  Coding DNA Sequence Number=SeqID_46328
MGKAEEVQEQMEADMEAMKEQMAAMMEAMMSMKKIMEANAVAVASTSAVAKVNPTSPSGINQMNHPTSNMTHEIPHHNLADFESCLGYATEGQAVRGIPLQNTLEGPQYHPQLHLLHSTTSKNPHAMAEMGKLDHLEERLRAIKGGEDYALANLEELFLVPNIITLPNFKVLYFDKYTELLAPRTI

SEQ ID NO: 138014 - protein, 160 aa, Glycine max
  Coding DNA Sequence Number=SeqID_46329
  Gene Ontology: Mol. function=zinc ion binding
  Homolog annotation: Hit_ID=Q2HTA0; Match level="QueryCoverage=83%, HitCoverage=23%, E-value=2e-15, Identity=34%"; Hit description=IMP dehydrogenase/GMP reductase, related
  Pfam annotation: Domain name=DUF1723; Domain location=76-125; Score =51.9; E_value=2.2e-12; Accession=PF08330.1; Description=Protein of unknown function (DUF1723)
MTGAADAVHTEGVATDGSLESPAANEGFPGGPRDPSVLTDFAEHVAHNIWSGQRLRSKGMIAATGLSPLIRCSVITTDPGLISVFVERWHRETSTFHLPVGELMITLDDVASLLHVPITGALHKFEPLVTSDTIGLLIELLEVSHEEATFETRQAGGPHV

SEQ ID NO: 138015 - protein, 129 aa, Glycine max
  Coding DNA Sequence Number=SeqID_46330
MGRTNGFLELWLKDDQRFEERKSRKDADRTSFRRGNTQFQDKGLVIYRALQRRFCIRHRHANLDKIKILNANLGQLKKNLMDSEPVTEIVATENHPMLANVGHHWSQKVMTDRGLKKHTGWTPLLRTLN

SEQ ID NO: 138016 - protein, 64 aa, Glycine max
  Coding DNA Sequence Number=SeqID_46331
MGRVNLESNVRMIVLWVEKIEILRVRKVKFGVSGNWSLKTCRKAWAEQMRKMSDKCERKEPFLG

SEQ ID NO: 138017 - protein, 81 aa, Glycine max
  Coding DNA Sequence Number=SeqID_46332
ALKGLDDAPQPKSKAAARWIIVKCNRQKGSTECGYYVMHWMSTIILGIFRNNWKAYFNNPRPLETEIKGASDPVGTVLSPS

SEQ ID NO: 138018 - protein, 142 aa, Glycine max
  Coding DNA Sequence Number=SeqID_46333
MALVTGPFLGSIASTRISKECDELKDINMIVVEALDNELKLRKAKREKSRMESMMFEDKLKSCQRSKRTASHMRMLEDKQTKVSALQVEKEAREGVIELLHKEAMKWMDRFALTLNESQELPRLLARAKEVADTYSAPDEVH

SEQ ID NO: 138019 - protein, 134 aa, Glycine max
  Coding DNA Sequence Number=SeqID_46334
MVGYTPLSFADLVFVGERIKVGLKGGKFDLLALMNAKTGANEEDENEGETLAVTAIPTRPNFPSAQQCHYLANNNLSHYPPPNHSQRPSPNQPHGLPSHDQCQAPPLAETKTPTKEGILQQKAYRIHPNSSVLC

SEQ ID NO: 138020 - protein, 262 aa, Glycine max
  Coding DNA Sequence Number=SeqID_46335
  Gene Ontology: Mol. function=motor activity; Cellular component=cell projection
  Homolog annotation: Hit_ID=UPI00016621D1; Match level="QueryCoverage =98%, HitCoverage=40%, E-value=2e-32, Identity=44%"; Hit description =UPI00016621D1 related cluster
MHALTFRGLHVLAFRGSCILTFRGLDILTVRGLHVLTFRGLDVLTFRGLDVLVVRGLHVLTFRGLDVLTFRGLRVLTFRGLHVLTFKGLHILTFRGLHVVTFKGLHVLTFRGLCVLTFKGLHVLTFRGLHVLTFRGLHVLTFRGPHVLTFKGLHVLTFRGLHVLTFRGLHVLTFRGLHVLTFKGLHVLTFRGLDVLVVRGLHVLTFRGLDVLAVRGLDVLAFRGLDVLADRGLDVLAFRRLHVLAFSGLHIHTLSEFKVLYP

SEQ ID NO: 138021 - protein, 157 aa, Glycine max
  Coding DNA Sequence Number=SeqID_46336
MSGTRTPRDASVDSGRGRRSVARSETRSELLGQELPGCSGSGHRHAQAGARTDHRVVARLARLARHPGGTTDLDHVIGLQQRNRHRLCGEIVDQVQFVEPEHRCGAAARDHPRMVGDARFVTINATGHCEHAAAGGGADLFQMVARGITQRWELRHR

SEQ ID NO: 138022 - protein, 23 aa, Glycine max
  Coding DNA Sequence Number=SeqID_46337
KEGETGVTYFKSLMVGTIVIEIN

SEQ ID NO: 138023 - protein, 145 aa, Glycine max
  Coding DNA Sequence Number=SeqID_46338
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=5e-25, Identity=55%"; Hit description =Putative uncharacterized protein
  Subcellular localization annotation: CTP_CleavageSite=39; ConfidenceScore=5.32e-01
MTMITPSSKLTLTKGNKSWLRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138024 - protein, 419 aa, Glycine max
  Coding DNA Sequence Number=SeqID_46339
  Homolog annotation: Hit_ID=A7PJZ4; Match level="QueryCoverage=57%, HitCoverage=60%, E-value=3e-21, Identity=30%"; Hit description =Chromosome chr12 scaffold_18, whole genome shotgun sequence
  Pfam annotation: Domain name=DUF1723; Domain location=130-179; Score =52.6; E_value=1.4e-12; Accession=PF08330.1; Description=Protein of unknown function (DUF1723)
MVKEDYRETLVSTATPLGLEVIPKVKKLSDEGLVRKSLNPCALLIMVRTRGLGWALGRVIGRALGREHVDHADDEVHEQPKEAAVDDERPELKLSSHGSKVEKFGRPAPEIKGLVAATGLSPLIACSLDTSDRGLMFAFVERWHKETSSFRLRVGEVTITLDDVASLLHLSITCVFHCFEPLHVDDFVFLLVELREVSAKEERAKTVQCHRAYVRLSWLRDNATHMHVVFLDAFRDLTQSGSYAWGATVLVHMYDNLNDASKSTARQLLQCWIYEHFPTVGSAIATEDYDERTPLVCRWNSGKALPVSTYYKNLDRLTSDDVFWILYGGHRAFREFETIPPHPATPSLCIEDIDNRWIQFSEYIASVGQICVAPGQCSLDYMEWFYMISHPFMSLAQPGDPPRHPPMQHHDTFVEPDVA

SEQ ID NO: 138025 - protein, 442 aa, Glycine max
  Coding DNA Sequence Number=SeqID_46340
MSSRKRKSIGARPTTQYDTRRFHSFEAWTRYTDNVLGRHLLAERKVEIYHMELDEFKAELERHNFHKHLTNLADSNIDLALVKEFYANLYSPKGPLPKQVRIQGHLIKIDADNLNTFLETPVVLAEGESLPAYSRYCRMPIDIKEIEAALCIPGRGFVLNAEGHPGKILRKYLDLTTLAQVWSVLSYSNLSLTSHTSDLISDRARLIFGLVSQLDMNVGSLISGQITSMAHSNSSRLGFPALITSLCRSRGVASDSLVFERLSPFINLAYIRKNCWNLADLTVTIRGARRARARPAKAPSTSTAPPPARTLAAPSTPSSVDFQRLEAMLQSIHQGKIVLLQSLQLVAPPDSIPSVEQFNEWVAWPGTQPPLHREDEGLTAQVPQQREDESSETSTLEPLIKRKRVVETREAATTSEKSLEATSEPSEPVAGFNSAGNRPLHS

SEQ ID NO: 138026 - protein, 169 aa, Glycine max
  Coding DNA Sequence Number=SeqID_46341
MYPEEIFGTEGGRSGMTTSGRPSSGMYNGIILNDLGVVNFWMWLYDNLNVLVYDAYVLKMDEDQWRYDFAMSQEVHMDYDYDNQEECGVNERHVDCSNAFNTSQVFATRDDVLQWARTVAHENGFVAVIMRSDTETEIKNSLEKTPGVGNVVVPSGFVGNQCVEGKVGW

SEQ ID NO: 138027 - protein, 111 aa, Glycine max
  Coding DNA Sequence Number=SeqID_46342
MGSLEAHEARMKRFEQPLEQAFQSKINISKNDGDKKNNHGKFPQKRGGAFTNRGKRSGKQWSNNVSSSYCKLCKKNNHDSNDCRSKCKKVQKAPTLPKILFLPTKRRSKFS

SEQ ID NO: 138028 - protein, 176 aa, Glycine max
  Coding DNA Sequence Number=SeqID_46343
MGDQEETQEQMKADMSALKEQMASMMEAMLGRGRDTLGHDGSPHLGYNRVAYPYRLPPNYSPPVLQDDAGHIASPVLEREPPQQPEEVHKDPQDYARRDVEFYPPIPEGPAPSTLPQPNIATQPIVLSTEGSSPATEEKRKLDLFEERLRAMEGFGDYPFADMTDLCLVPDVVIPP

SEQ ID NO: 138029 - protein, 154 aa, Glycine max
  Coding DNA Sequence Number=SeqID_46344
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=57%, HitCoverage=75%, E-value=2e-24, Identity=68%"; Hit description=LacZ protein
MEMFLFFFFFSLRRSLTLSPRLECSGMILASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138030 - protein, 243 aa, Glycine max
  Coding DNA Sequence Number=SeqID_46345
RKTKMFVDPNNANTAALGEVVETLQYMVSPQGRNTWTVDDLVPYVDKLAIISEEQERVTEPVSHGPASEREFPAPEFNILQSSVETRGLGRRREPVEAEQYSQQMMERGHGMYYTPTTFSEYPSQMYQYPFEGHHTDTSASEHSFGGVAETQAHFSWPTMTPSQQHDAPMATPYAPFAPQWNVPGAIPDMGDLLGVDLRQEFSAEAEQAETGRQRGRRNPDRQARRWDRPCGTSSRHRGHHND

SEQ ID NO: 138031 - protein, 187 aa, Glycine max
  Coding DNA Sequence Number=SeqID_46346
MRAQPKREVIAQQLCILGQDFIQPLQGDECGSCAPPQLRSPPTEVSVGLCHHDIGIAPIRHLVGLEMSNRVLGFLALITSLCQFYEVPFAPNKVIRPPTNQAFIRKYCAPRQVGRDTTTARGWLAAGNRHTAATSRAPQLIYKSWSVAYDPWSTTRRPSPKPKVSKSTRSVTDKSSCVQLKTLKKRY

SEQ ID NO: 138032 - protein, 53 aa, Glycine max
  Coding DNA Sequence Number=SeqID_46347
MGVKYLEAVKRRLHATKQWSPDKIRGFGLDGGGCMNNARQSIHGAPDSMMEDA

SEQ ID NO: 138033 - protein, 79 aa, Glycine max
  Coding DNA Sequence Number=SeqID_46348
MGKAEEVQEQMKADMEAMKEQMATMMEAMMSMKKIMEANAAKIWEVRAAPMMCKFITSTPSRRMACLPTYTTQCGVHSQ

SEQ ID NO: 138034 - protein, 106 aa, Glycine max
  Coding DNA Sequence Number=SeqID_46349
MAKFDPEVVLEFYANAWPTEEGVRDMRSWVRGRLGVGVQSEEEQGQRVRRGGHCPAVMHTGAGFRPDRCREAGVDHVHQHDHLDPVVDDIAAQHPRPSNLIRSPMN

SEQ ID NO: 138035 - protein, 64 aa, Glycine max
  Coding DNA Sequence Number=SeqID_46350
MLVKKDMREMIHLFFIDFEKRFDTLELQVDMRFNEMESRMTKVEEDVSYIRSSFDLPPPPPPSS

SEQ ID NO: 138036 - protein, 69 aa, Glycine max
  Coding DNA Sequence Number=SeqID_46351
MGAKYLEVVKRGSRSNNGWSPDQIRIAVATCPSRASEGETHGCAFQRRKDARSRHQRLFVENIGKTEGN

SEQ ID NO: 138037 - protein, 57 aa, Glycine max
  Coding DNA Sequence Number=SeqID_46352
MYDYHEKERAPDLESILADFMTYQASSKGTSLLQVINGESYRQSDYHNKEEGVLNLR

SEQ ID NO: 138038 - protein, 187 aa, Glycine max
  Coding DNA Sequence Number=SeqID_46353
  Homolog annotation: Hit_ID=Q6WAY4; Match level="QueryCoverage=65%, HitCoverage=26%, E-value=2e-08, Identity=29%"; Hit description =Putative uncharacterized protein
MGSSQKPSLKKRFYQVKIKSLEVTSLGELGQLMGQLQRVEVSMEPIASLSQYYDQPLRCFTFEDFQLVPTVKELEEILGCQLGGRKPYLFFGFYPSTTRVAKVVKISAQELERLKQNRNGVVGVPRKFVLFPNMEGLVDLAAIDAFLAFHHGKESPVVAILAMYDTFDRGCPSIRYKVTARASKRER

SEQ ID NO: 138039 - protein, 155 aa, Glycine max
  Coding DNA Sequence Number=SeqID_46354
MGRAEGVQEKMKDDMEAMKEQMATMMEAMMSMRKIMEANAVVVAATSAVTKVNSMPPSGLNQMNHTTLAMVGKDLGSTNGPMMCKFKTSTPSRHMACLPTYTSQCGAHKNAPPQSSRLRAFASNMPLKGKQLVIYPCKTLWRVLSITHNHTPHIP

SEQ ID NO: 138040 - protein, 62 aa, Glycine max
  Coding DNA Sequence Number=SeqID_46355
MTQELVARGDTLRLSASRHSVTPSVIDEQRPMWSSVPFPEMSASSGGDFFKSQWSHMTCGDT

SEQ ID NO: 138041 - protein, 92 aa, Glycine max
  Coding DNA Sequence Number=SeqID_46356
MSHAVKDHRGKWAPNYEGPFVVKRAFSGGALGQDHLGLPSGVKTKHEWQKPVKVLKDERKRGWGHDRPIVALLFAKQAGNVAARQPRILSIL

SEQ ID NO: 138042 - protein, 83 aa, Glycine max
  Coding DNA Sequence Number=SeqID_46357
MKNWMQNSKWDVYLGAYLNGAHWQVAIILPKETLVVWFCSLHNRPDNYLKGIINSALKGLDDTPQSKSRAGARWIVVKLTFNM

SEQ ID NO: 138043 - protein, 71 aa, Glycine max
  Coding DNA Sequence Number=SeqID_46358
MWDATVFGVHNDNFSLYIKHEDLSEIAHDGQCLSISVIQLWIFALKGLDDTPQSKPKVAARWIVVKIKRKH

SEQ ID NO: 138044 - protein, 113 aa, Glycine max
  Coding DNA Sequence Number=SeqID_46359
RLKKAFNGTHESEGAPEPLAGHEVYDQTQWKDHDDKNIWKKRQDKGWSFEMLTRFGRDGYTTTVASADTRSTNLFALSMLHNVNQGEKTFLSFSEKCKSPTRILFQYQEPCLN

SEQ ID NO: 138045 - protein, 498 aa, Glycine max
  Coding DNA Sequence Number=SeqID_46360
  Homolog annotation: Hit_ID=A7PHN7; Match level="QueryCoverage=94%, HitCoverage=73%, E-value=1e-65, Identity=37%"; Hit description =Chromosome chr17 scaffold_16, whole genome shotgun sequence
MGLPQVASGCTAEEVAASLGTFVQTAPRMASIGSYEVNLLAGEDLELSKETHISSMCSDSKLKNDPMEQISKLFVNSEKTRQTPVSRTVGFQIRASTPRVNGFGGNGYSSPVFNVISDATEASESQLRKQLLSPLNGMLLADHFKGDPLDIGAGIYQSRSKAGDDNSNALHEYKKDHIGNNNQIHSMIWSTSCFQEFTNSFCNDSTINHIVSSHHQRAEPWSYKHFKSSPVRNVSEETTKTRSQTAALSIPQKNVSSPPFPLSPLGKKSSKNENLGECRNIDVILDDGNFTFNSVEQSLDRTCQGILSAQEIPGKSQLNLNNMQQKSDLFTPDNMIDMKEYWTHSGSFPPRDAKLCGTMSRLPIRRSLVGSFEESLLSGRLLSGKVSPKIEGFLALLNVTGGNFSPQSQKIPFAVTSVDGDKYLLYYSSINLSGKLLSGKSRVAKFQRTLSMDESRSEKPRIRIPMKGRIQLKMVMQSVADLMHKTRQGSIIQLPTLI

SEQ ID NO: 138046 - protein, 93 aa, Glycine max
  Coding DNA Sequence Number=SeqID_46361
  Gene Ontology: Mol. function=DNA binding; Cellular component=nucleus; Biological process=regulation of transcription
  Homolog annotation: Hit_ID=A7PHM2; Match level="QueryCoverage=100%, HitCoverage=58%, E-value=8e-23, Identity=56%"; Hit description =Chromosome chr17 scaffold_16, whole genome shotgun sequence
  Pfam annotation: Domain name=NAM; Domain location=14-93; Score=25.7; E_value=7e-10; Accession=PF02365.6; Description=No apical meristem (NAM) protein
MERINFIENGVSGLPPGFRFQPTDEELLPASIIPEINVSKYDPWDLPAVTSQTQEYEEDFKGNCDVQERYFFSSKEAKYRNGNRMNRTTNSGY

SEQ ID NO: 138047 - protein, 157 aa, Glycine max
  Coding DNA Sequence Number=SeqID_46362
  Gene Ontology: Mol. function=metal ion binding; Cellular component =integral to membrane; Biological process=multicellular organismal development
  Homolog annotation: Hit_ID=A7P9Z1; Match level="QueryCoverage=99%, HitCoverage=34%, E-value=6e-58, Identity=68%"; Hit description =Chromosome chr14 scaffold_9, whole genome shotgun sequence
MECSLHRNYRFYYMFVFSATLLCLYVHGFCWVYIKRIMDSEEISIWKAMIKTPASIALIIYSFISVWFVGGLTVFHTYLISKNQSTYENFRYRYDQQSNPYNKGVAANFREIFCSCIPPSKNNVRSKIPIPKEPSDSSRRRVVKSLSPMMRKTAGDL

SEQ ID NO: 138048 - protein, 435 aa, Glycine max
  Coding DNA Sequence Number=SeqID_46363
  Gene Ontology: Mol. function=transferase activity; Cellular component= cytoplasm; Biological process=flavonoid biosynthetic process
  Homolog annotation: Hit_ID=A7PHK7; Match level="QueryCoverage=99%, HitCoverage=99%, E-value=0.0, Identity=75%"; Hit description =Chromosome chr17 scaffold_16, whole genome shotgun sequence
  Pfam annotation: Domain name=Transferase; Domain location=11-435; Score=324.3; E_value=2.2e-94; Accession=PF02458.6; Description =Transferase family
MAIADMSSIKLNVKQQGEPTRVLPAEETEKGLYFLSNLDQNIAVPVRTVYCFKSGSRGNEDAAQVIKESLSKILVPYYPMAGTLRISSEEKLIVDNPGEGAVFVEAEADFDIEEIGDLTKPDPDALGKLVYYVPGAPSILEMPLMTVQVTKFKCGGFTLGLCMIHCMKDGLCAMEFVNAWSQIARGLNLKTPPFLDRTIIKARDPPKIEFQHTEFAEIEDISNTKKLYEEENMLYRSFCFDTEKLDMLKKKATEDGVLEKCSTFEALSGFVWRARTAALGMQPDQQTKLLFAVDGRKRFVPPIPKGYFGNAIVLTNSLCNAGELLKNPLSFSVGLIREAIDMVTDSYMRSAIDYFEVTRARPSLTATLLITTWTKLSFHTADFGWGEPLCSGPVTLPEKEVILFLSHGQERKSVNVLLGLPSSAMVIFEALMMMQ

SEQ ID NO: 138049 - protein, 121 aa, Glycine max
  Coding DNA Sequence Number=SeqID_46364
MEVEEVTSYTGSAATGIAGFVEAMPSKIVLMMPKNQESNKFQESGSRFKNNQDQDSRFKNNQDQDSRFKSREDLIKISIKRVKIFYQRVLLSGNRLPEGSNRLPVANILFKTNLQSCNRLP

SEQ ID NO: 138050 - protein, 280 aa, Glycine max
  Coding DNA Sequence Number=SeqID_46365
  Gene Ontology: Mol. function=oleoyl-[acyl-carrier-protein] hydrolase activity; Cellular component=chloroplast; Biological process=fatty acid biosynthetic process
  Homolog annotation: Hit_ID=A7PHJ8; Match level="QueryCoverage=61%, HitCoverage=54%, E-value=2e-28, Identity=43%"; Hit description =Chromosome chr17 scaffold_16, whole genome shotgun sequence
  Pfam annotation: Domain name=Acyl-ACP_TE; Domain location=1-208; Score=17.1; E_value=1.8e-11; Accession=PF01643.8; Description=Acyl -ACP thioesterase
MVQETALKHVSSFGASQNNFGATQEMELRKLIWVVNRIFRFKYRDIANGNCSKPYIQLWGKSERFWSYSGNGPSQSRSFGLLFVFRFPISREEIDHQKIENLTDATDESFRFGVTPGRNDMDVNQYVNNVKYITWILESVPREVLEDYKMTSMTLEFRCECTQSDLLESMSSPSVIGASNNDSVNTKPDLQYIYTCFVYKTLKPSWSKPEQNGILSKTQVMQGYELKTVDALDGQRNVEERKGTVQTFALFLCLLSMHSHGNFGKTCETHVKRFPRKNEQ

SEQ ID NO: 138051 - protein, 247 aa, Glycine max
  Coding DNA Sequence Number=SeqID_46366
MAEATRPKTRMEHIEEAIAKLASNQLHVTTKLGELIHRITVLEARQHHSPTPPSSSSAKTFLTHIPISTLSLTSPLPPLLKPTSPPHPALMPKHPAPLSVPFPMHVPHLVTNSKHQVAYASSSVFNQLDHACAVASLDNLLSIVVHYGREAAPHDKLLEHRDMTLFERGVAPYGSAMVACERQPVAFALGITADPKEPRRYRPWDPGGPRRTHNTLRTRSPDPRNLGSYKTIFKNVPNNLGNGKLVA

SEQ ID NO: 138052 - protein, 139 aa, Glycine max
  Coding DNA Sequence Number=SeqID_46367
MVHKVKLENGLIRLSVIANSMIRIFYSLVLFEKRVNLICYDEVEDDVLEHRDGEGVADEDEVKDDALKHCNREVVVDKKELKDDVLKHYIEEVSVDGEDKVEDDTLKSNAKKFLEPLLVVCGLEKNREDEGDEKKKRVR

SEQ ID NO: 138053 - protein, 88 aa, Glycine max
  Coding DNA Sequence Number=SeqID_46368
MEKHQVMLPTSSTSSTPFSSDFKVDYISTVHVENEVLRTQRMAISEQKESDKEFIKQHRYVFQTKSQVDVLDDGIPVEKIYEKDSEKQ

SEQ ID NO: 138054 - protein, 339 aa, Glycine max
  Coding DNA Sequence Number=SeqID_46369
  Pfam annotation: Domain name=DUF1723; Domain location=117-166; Score =17.9; E_value=0.0041; Accession=PF08330.1; Description=Protein of unknown function (DUF1723)
MFLICKSVVWVVMLALLEISQGASAQPSCMVAVGQGCEAWWNARSNCKAAERQPCRNGLSGVMKILNLLGILIACNLEMPQSQPTVVRIIGPPIGGGAIDLSLLRSYRDHCVRHVWIRQERPEVKLVSLDAQDTSSFHLPIGEMTITLDYKSCLLHLPMTRRPIDYVSSVFDKEEVKILLMCYLGSPTKTEAFATAKTGARVSLTCTIFANKSSTRIHVSYLQYLDNLDGFHEVGGLCCGELDSHKMKTVEKCRIGVKPYHPKRVLRIFHPYVIPSKEGQSLGGPVHLVSIRVQPQPGHPLTNYVLALEAMQGLLDLRAVPEGTSHHQLIKQALELDAA

SEQ ID NO: 138055 - protein, 116 aa, Glycine max
  Coding DNA Sequence Number=SeqID_46370
MYTLYAFNNTVNIIARKGIGTLGTMVTRLLIQAIAIRTLTNPLGVSGMKARILIGVPGILEIKILTGERKVKIIILDLMMLIKTPLGEAITIGTQQMPQAMMVLGTGEVVTRAEVA

SEQ ID NO: 138056 - protein, 161 aa, Glycine max
  Coding DNA Sequence Number=SeqID_46371
  Homolog annotation: Hit_ID=A5AWU6; Match level="QueryCoverage=79%, HitCoverage=78%, E-value=3e-26, Identity=50%"; Hit description =Putative uncharacterized protein
MEEEQSVNGTMSGSKTTQELAMEGQEYLEETIENAFQILSSMNDELCNPVLWSTSPSTSPNADATSDNSNHHADASAASAAAGGALEEARARYKKAVTALRTILTAIPTSQKEKTFDAGSAASPADEAEIDKLEERASSLRRAQSLLEFRNTSRPNTGTLL

SEQ ID NO: 138057 - protein, 21 aa, Glycine max
  Coding DNA Sequence Number=SeqID_46372
MEETKTGQQNKVPQYVWLVPQ

SEQ ID NO: 138058 - protein, 52 aa, Glycine max
  Coding DNA Sequence Number=SeqID_46373
MDQFDTKEQSKFDMIKNHYLFLSPTATASDAVSLIILTAILLVPHQKFKTSR

SEQ ID NO: 138059 - protein, 153 aa, Glycine max
  Coding DNA Sequence Number=SeqID_46374
MRKDGHSCNNEGGYRAKVKDILCGMKVIFTAQLKLVVEIPWKCPHQIKYLFFLFATRHYNFRFTVGSYCLLCSLLASSFMLTRLINGIVLTSSFSFREHGSRHRVAPRSLLPVQELRFSLRFLTDPSSFTVSNHPYLSLAPPLSSPPQNPPLS

SEQ ID NO: 138060 - protein, 309 aa, Glycine max
  Coding DNA Sequence Number=SeqID_46375
  Gene Ontology: Mol. function=aminoacyl-tRNA ligase activity; Cellular component=cytoplasm; Biological process=tRNA aminoacylation for protein translation
  Homolog annotation: Hit_ID=A7Q3X6; Match level="QueryCoverage=98%, HitCoverage=82%, E-value=3e-86, Identity=54%"; Hit description =Chromosome chr13 scaffold_48, whole genome shotgun sequence
  Pfam annotation: Domain name=tRNA_bind; Domain location=209-304; Score=132.3; E_value=1.4e-36; Accession=PF01588.11; Description =Putative tRNA binding domain
MATIESRRKSVALALSKYFSLDPSVVPADSSDSDIKSLYLNIIAVSGHRVNHSDEWVAFAEAFPVALDACFENLKRLNDELSGKAVLLGNGLNPSEADVIVYSVVHSSLINLSDTSKEKLPHVLRWMDYIQVTKPVGAVEADLKSNKTEQSIKNVNKSEADSSKDKNKAEGKATGGKSTGDKEPTKGKAKPADKVAEKENEVSVSLLNIQVGLIHKAWKHPSADSLLVEEIDVGEAKVRQVVSGLAKYYSPDELMNRRVVLITNVKPGKLRDVMSEGLVLCASNEGPTIVEPLLPPEGAKIGEHISFSG

SEQ ID NO: 138061 - protein, 577 aa, Glycine max
  Coding DNA Sequence Number=SeqID_46376
  Gene Ontology: Mol. function=ribonuclease activity; Cellular component=exosome (RNase complex); Biological process=rRNA processing
  Homolog annotation: Hit_ID=A7PKV4; Match level="QueryCoverage=100%, HitCoverage=60%, E-value=0.0, Identity=86%"; Hit description =Chromosome chr7 scaffold_20, whole genome shotgun sequence
  Pfam annotation: Domain name=RNB; Domain location=111-442; Score =441.5; E_value=1.2e-129; Accession=PF00773.10; Description=RNB-like protein
MPMPAGSGGIAHALFVSKDRRIPKIRIQTRQLENLLDKRIIVAVDSWDRQSRYPSGHYVRTIGEIGDRDTESEVVLIENDINTRPFSSQVLACLPPLPWVVSSEDLSNPIRKDLRHLRVFSVDPPGCKDIDDALHCHVLPNGNFEVGVHIADVTNFVYPGTPLDDEAAQRGTSVYLVERRIDMLPKPLTEDICSLRSDVERLAFSVIWEMTPEADIIATSYTKSVIKSSAALSYVEAQARMDDSRLMDPITADLRNMNSLAKKMRLRRIERGALTLASAEVKFQIDTETHDPLDIGMYQIREANQMVEEFMLAANVSVAQQILKSFPLCSLLRRHPTPTREMLEPLLRTAAAVGLHLDVSSSKALADSLDHAVGDDPYFNKLIRILATRCMTQAVYFCSGDLSPPEYHHYGLAAPLYTHFTSPIRRYADVIVHRLLAASLGISKLPPVFQDSLQLTSIADRRASVELHTLIYFRKRPTDTEGRIVKIRSNGFFVFVPNEFVTYCLYGPFTPYRYGIEGPVYLTKAEKGSGEWYVDEQQQKIKKMDGSLSYNVLQTVQIHMEVVEPQPNRPKLQLTLI

SEQ ID NO: 138062 - protein, 77 aa, Glycine max
  Coding DNA Sequence Number=SeqID_46377
  Subcellular localization annotation: CTP_CleavageSite=44; ConfidenceScore=5.06e-01
MAKHLAAMLLLVFLLLTSSTSTSADNNFAATEPSLNLALPSDRRVAGGKYGPMILNMLPKGPVPPSGPSKGTNNLNN

SEQ ID NO: 138063 - protein, 119 aa, Glycine max
  Coding DNA Sequence Number=SeqID_46378
MVGMILYSYYCATEGQQKAAEAAAQASQAREGESETLINVENASTVLNKRPPVSNSYSCELFVQYKLSIMYIDSQGWVAGPPCDVEGVTVKKERRRGSEEKKEQRRGSEAWLCHFVLQC

SEQ ID NO: 138064 - protein, 300 aa, Glycine max
  Coding DNA Sequence Number=SeqID_46379
  Gene Ontology: Mol. function=metal ion binding; Biological process =metal ion transport
  Homolog annotation: Hit_ID=A7QEU2; Match level="QueryCoverage=84%, HitCoverage=85%, E-value=2e-58, Identity=76%"; Hit description =Chromosome chr16 scaffold_86, whole genome shotgun sequence
  Pfam annotation: Domain name=HMA; Domain location=133-194; Score =36.0; E_value=1.3e-07; Accession=PF00403.17; Description=Heavy-metal- associated domain
  Pfam annotation: Domain name=HMA; Domain location=48-109; Score=46.1; E_value=1.2e-10; Accession=PF00403.17; Description=Heavy-metal -associated domain
  Pfam module annotation: Pfam domain module=HMA::HMA; Domain location =133-194::48-109
MGEEAKQVSLQFWHSAFSLISESPKAHESKPEENQEEKKEPKPPSPCVLFLDLHCKGCAKKIKKSIMKMRGVEGVVIDMAKNEVTIKGTVEPQAICNMISKKTKKRAKVISPLPEAVEGEPIPSQASEPVIVELNISMHCEACAAQLKRKILKMRGVETAVTELSTGKAIVTGTMDANKLVDYVYRRTKKQVKIVSQPEPEAEPEKKEENKELEKPAAEEAKPDEEEKEGGKDENENKEEKGVEEVGGDENGVVVLNIDDDESMKRMMYHYYYYQPLCVIEGIPPPQLFSDENPNACCIS

SEQ ID NO: 138065 - protein, 113 aa, Glycine max
  Coding DNA Sequence Number=SeqID_46380
  Gene Ontology: Mol. function=receptor binding; Cellular component =membrane
  Homolog annotation: Hit_ID=A7P6L9; Match level="QueryCoverage=42%, HitCoverage=11%, E-value=3e-19, Identity=100%"; Hit description =Chromosome chr9 scaffold_7, whole genome shotgun sequence
MVPITKWHCQMRMVQKLRKIPDVYEYDLGHLSGPSMGIVMVDLIQLYNDNIVDPKLASYGVENPIYAVIQLAQTTMRSELGKITLDKTFEERDTLNEKRLCYLLPLFLPEEAS

SEQ ID NO: 138066 - protein, 440 aa, Glycine max
  Coding DNA Sequence Number=SeqID_46381
  Gene Ontology: Mol. function=transporter activity; Cellular component= membrane; Biological process=transport
  Homolog annotation: Hit_ID=A5B8A6; Match level="QueryCoverage=87%, HitCoverage=67%, E-value=1e-167, Identity=75%"; Hit description =Putative uncharacterized protein
  Pfam annotation: Domain name=Sulfate_transp; Domain location=46-386; Score=-155.1; E_value=0.016; Accession=PF00916.11; Description =Sulfate transporter family
  Pfam annotation: Domain name=Xan_ur_permease; Domain location=1-373; Score=-72.6; E_value=2.2e-05; Accession=PF00860.11; Description =Permease family
  Pfam module annotation: Pfam domain module=Sulfate_transp::Xan_ur _permease; Domain location=46-386::1-373
MGSNAYFAYTVVGFHGSGNVSYQSALAAVFIEGTIFLLVSAIGLRAKLAKLVPKPVRISSSAGIGFFLAFIGLQNNQGIGLIGYSPSTLVTLGACPSSSRASLSPVLTAANGTVSLLPGGSVSGDILCLKDRMESPTLWLGLVGFVIIAYCLAKNIKGAMIYGIVFVTVVSWFRGTKVTAFPNTDAGNSAHEYLKKVVDVHTIKTTAGALSFKNIGKGYFWEAVVTFLYVDILDTTGTLYSMARFAGFTDEKGDFEGQYFAFMSDATSIVVGSLLGTSPVTAFIESSTGIREGGRTGITALTVAAYFFLAFFFTPLLASIPAWAVGPPLILVGVLMMRSVVEIDWEDMREAIPAFVTLILMPLTYSIAYGLIGGIGTYIVLNLWDWGWEGLGHFGLGKKTTTAAAMASDEDSHHHHGVNGILQNQHSPQNPTAKALQLEP

SEQ ID NO: 138067 - protein, 229 aa, Glycine max
  Coding DNA Sequence Number=SeqID_46382
  Gene Ontology: Mol. function=histone-lysine N-methyltransferase activity; Cellular component=nucleus; Biological process =multicellular organismal development
  Homolog annotation: Hit_ID=A7Q3T1; Match level="QueryCoverage=86%, HitCoverage=99%, E-value=8e-68, Identity=68%"; Hit description =Chromosome chr13 scaffold_48, whole genome shotgun sequence
  Pfam annotation: Domain name=DUF260; Domain location=49-149; Score =238.3; E_value=1.7e-68; Accession=PF03195.5; Description=Protein of unknown function DUF260
MRPAKFLHAYYRERFDEIGKKIKREGDVSSQMGRRHMLGPPGTLNTITPCAACKLLRRRCAQECPFSPYFSPHEPQKFASVHKVFGASNVSKMLMEVPECQRADAANSLVYEANVRLRDPVYGCMGAISALQQQVQSLQAELNAVRGEILKYKLREANMIPSSHVAMLPSSGAVSIAAPPPPPPPPPPLPPPSLPLPLPLTSSPPSMYIQQRDPTTYTTISSDNISYFV

SEQ ID NO: 138068 - protein, 385 aa, Glycine max
  Coding DNA Sequence Number=SeqID_46383
  Gene Ontology: Mol. function=metal ion binding; Cellular component =cytoplasm; Biological process=ubiquitin cycle
  Homolog annotation: Hit_ID=A7PL24; Match level="QueryCoverage=96%, HitCoverage=28%, E-value=1e-156, Identity=75%"; Hit description =Chromosome chr7 scaffold_20, whole genome shotgun sequence
  Pfam annotation: Domain name=zf-C3HC4; Domain location=337-374; Score= 20.6; E_value=0.00041; Accession=PF00097.16; Description=Zinc finger, C3HC4 type (RING finger)
MANIKKHRASRHCHVTFVVTHFNDPRISSADLRDLLLQSISVLVQYREYLATFESNEAATQRMPKALLSAFDNRSWIPVMNILLRLCKGSGFVGSISHHKGFSPLTLDGMQRLLREACISDEGLFSSFLNRLFNTLSWTMTEFSVSVREMQEKYQVIEFQQRKCCVIFDLSCNLTRILEFCTHEIPQAFLSGPDTNLRRLTELVVFILNHITSAADAEFFDLSLRRHNQPPEKVNRGMILAPLVGIILNLLDATNSAEYRENNDLLDVFASMDCPDTVQYGFQYLLDYNWDGSFRGEAYVAKYEQLENFLSLLTCRTVLHHDKVDSVGDTDLDDGLCCICYACEANAQIAPCSHRSCYGCITRHLLNCQRCFFCNATVTDVSKIG

SEQ ID NO: 138069 - protein, 1074 aa, Glycine max
  Coding DNA Sequence Number=SeqID_46384
  Gene Ontology: Mol. function=DNA binding; Cellular component=nucleus; Biological process=regulation of transcription
  Homolog annotation: Hit_ID=Q0GXX5; Match level="QueryCoverage=38%, HitCoverage=79%, E-value=9e-91, Identity=79%"; Hit description=Auxin conjugate hydrolase
  Pfam annotation: Domain name=M20_dimer; Domain location=857-965; Score=28.7; E_value=2.2e-05; Accession=PF07687.5; Description =Peptidase dimerisation domain
  Pfam annotation: Domain name=NAM; Domain location=22-150; Score =286.6; E_value=4.9e-83; Accession=PF02365.6; Description=No apical meristem (NAM) protein
  Pfam annotation: Domain name=Peptidase_M20; Domain location=672-997; Score=26.9; E_value=3.2e-05; Accession=PF01546.19; Description =Peptidase family M20M25M40
  Pfam module annotation: Pfam domain module=M20_dimer::NAM::Peptidase _M20; Domain location=857-965::22-150::672-997
MGSVDCYPSRVDDAAVVSLDSLPLGFRFRPTDEELVNYYLRQKINGNGREVWVIREIDVCKWEPWDMPGLSVVQTKDPEWFFFCPQDRKYPNGHRLNRATNNGYWKATGKDRKIKSGTILIGMKKTLVFYTGRAPKGNRTNWVMHEYRPTLKELDGTNPGQNPYVLCRLFKKHDESLEVSHCDEAEPTASTPVAAYYSTEEIQSDLAVVAGSPSQVTEDDKHQSMIPAHSEEAISNVVTPVDRRTDGYDACDAQNQIELPTAEEFQPLNFDIYYDPRSELLDGKLFSPVLAHIQPEFHYQANIESDGRYGLQYGTNETNMSDFLNSVVNWDQVPFEDPNCQQQSYPLFNVKDNILNSDLDSELANMTCMQAGYAEGAIDGRIPLLITSEFCSTTGIPVDCVGDEQKSNVGLFQNNSQRAFTDVNMGQVYNVVDDYEQQRICSAVASGNTGIIRRHREVRNEQLSINSTQGTAQRRIRLSMATHGSNKTVKSESCAQEELYAKPVIAVGEKGSENHASDESATLTNDGNELQKTPESTGKRKISQQVTKAGSTLGLKDLFLLRRCGEMSAYLITAIHLLLVFLSSSTSLSTVFGSEEEQFYAKEILGAAQKEKEWLVSVRRKIHEHPELAFQEYETSSLIRSELDKLGISYTYPVAKTGIVAHLGSGSRPIIAIRADIDALPMQELVEWEHKSKIEGRMHACGHDAHTTMLLGAAKLLNQRQDNLQLIWEKHGGGVEVKSAMMELFVDPNKLGSIPSTKVYVQDVAQYGLFSSGSEVIAVPLKHMSVLTLIPPVAGLDGMLQIISSLKGTVRLLFQPGEEGARGALQMINEGVLQDVEAIFALHIDTTTPTGAIASIPGALTAAGCMFEAKIVGVGGHAASPHKNVDPVLATSFAILALQQLVSRESDPLHNQVLSVTFVEGGTALNVIPSYVKFGGTLRSLTNEGMYHFRQRLKEAAVHRCNAYVDFKEEYFTPYPAVVNDNNLHLHVERVGQILLGPDNVHAAKKTAEGRRTMMKESKSMSIVKEKCDVMVVLVWRGGSWIIVMIDECDDDGWWSAMAMEVWEVAARVFLGEE

SEQ ID NO: 138070 - protein, 608 aa, Glycine max
  Coding DNA Sequence Number=SeqID_46385
  Gene Ontology: Mol. function=hydrolase activity, hydrolyzing O -glycosyl compounds; Cellular component=anchored to membrane; Biological process=carbohydrate metabolic process
  Homolog annotation: Hit_ID=A7PKZ4; Match level="QueryCoverage=45%, HitCoverage=71%, E-value=4e-77, Identity=45%"; Hit description =Chromosome chr7 scaffold_20, whole genome shotgun sequence
  Pfam annotation: Domain name=Glyco_hydro_17; Domain location=221-504; Score=19.3; E_value=5.2e-12; Accession=PF00332.9; Description =Glycosyl hydrolases family 17
  Pfam annotation: Domain name=TPR_1; Domain location=215-248; Score =15.6; E_value=0.071; Accession=PF00515.19; Description =Tetratricopeptide repeat
  Pfam annotation: Domain name=TPR_1; Domain location=289-322; Score =2.1; E_value=3; Accession=PF00515.19; Description=Tetratricopeptide repeat
  Pfam annotation: Domain name=TPR_2; Domain location=215-248; Score =19.2; E_value=0.016; Accession=PF07719.8; Description=Tetratricopepti de repeat
  Pfam annotation: Domain name=TPR_2; Domain location=289-322; Score =12.3; E_value=0.88; Accession=PF07719.8; Description=Tetratricopeptid e repeat
  Pfam annotation: Domain name=X8; Domain location=511-576; Score=49.1; E_value=1.6e-11; Accession=PF07983.4; Description=X8 domain
  Pfam module annotation: Pfam domain module=Glyco_hydro_17::TPR_1::TPR_ 1::TPR_2::TPR_2::X8; Domain location=221-504::215-248::289-322::215 -248::289-322::511-576
GIKENGVSLSPWSQTPTTTGEYFPGKNIDVDDINMTSTSITTFSIYSQSQPKFLNLLQHPLIHTRTKRTSISFQPPIVRATLFSTFTSSHTPSTPSSNFPSGRALSKFLSEKVAFFLIGSFLLSGCFSKRSAFAEAAPSVGSGAVLEQNMNPTEEKNEEEKSEEEVEEMWESILEKDPKNVEALKVVLYGKIRKGKSKEAVKFVEDLIAAEPNEVEWRLLLALCYETMGQLSKAKKLFREILKKRPLLVRALHGLAMAMHKNHEGPAVFEMLNNAQELASRENRVTEERNIRILIAQMHVVQGNLEEGLKRFQELIDQNPRDFRPYICQTTFPAMQNIQKAIDKAGLGDTVKSSDGDFRRDIRDAIKQILSLILERNSPFLVNIYPFLSLNQNTYFPEEFAFFDGQGRIIQDKDAQYSNVIVVGEIGWPTDGNKNANNNNAKRFYQGILKKMAHKKGTPLHPGAMDIYLFSLTDENLKSIEPGNFERHWEIFRYDGRPKFPIDFSGQGQDKWPVAAKGVVYQERFGCSCEKLDLAGNASFAFNQYFQTRDQSVEACDFNGMATIVKQDPSKGSCLFPIEIQSSGEMLRAMCTIGSLFIGLPLFFITFT

SEQ ID NO: 138071 - protein, 41 aa, Glycine max
  Coding DNA Sequence Number=SeqID_46386
MLALDLDAIFYQPEMLGEPIATLRLMHYEGYFQVRPQKLYR

SEQ ID NO: 138072 - protein, 473 aa, Glycine max
  Coding DNA Sequence Number=SeqID_46387
  Gene Ontology: Cellular component=mitochondrion
  Homolog annotation: Hit_ID=A7QWL2; Match level="QueryCoverage=79%, HitCoverage=59%, E-value=1e-42, Identity=38%"; Hit description =Chromosome chr4 scaffold_205, whole genome shotgun sequence
MVHMVLGMETLGCHLKTHSCQALENVEIYEPSLDLKLGEGMFLFSPRRQTWQWYKLLKGENLIGKHFNHPPDGPYGSWYGNFRVPLENSFPAKTKPDSLKMSSKGSSDDDIVGSEDASVDDIGTANYESGNFRATDKCVNPTRKEVDDVCHSPYAFQVDDSLVDKKTGGSDETYRKGPTFFGWIRSRWQFWKGNAKSGDSTAHQNKVVNRFEDSNSSELVDQTVQTVSDFEDKSSELDQNAICSGKPELFSSSSFWNDMESFIFTLRGSLIVSQSKNREDMAHKLQKDGAPVFRSLPEKDILQLLELLISEKKWLEESPTQTFPFQLTQPVHKNSLMGQSHGANGLRSLFLSRESQSSTQKSSEHNVEKHNQSIPCTRVSATTTETKYTERYGYHLDLQKLGYQKLATLLQIMPEVKVESNYIYASDYDPIVSGNSLVDIFNSSTESTQGTVSKEKPRFQKNYSFAAEPVFPS

SEQ ID NO: 138073 - protein, 84 aa, Glycine max
  Coding DNA Sequence Number=SeqID_46388
MASSQNKRILFVAFVILCLFSSPTIAARTLKEKSNLTSGDVNTVQHNKEAIAKVFKPKDEDVNVGGDVFSMDYTPASRKPPIHN

SEQ ID NO: 138074 - protein, 819 aa, Glycine max
  Coding DNA Sequence Number=SeqID_46389
  Gene Ontology: Mol. function=ribonucleoside-diphosphate reductase activity; Cellular component=ribonucleoside-diphosphate reductase complex; Biological process=DNA replication
  Homolog annotation: Hit_ID=Q8GZU8; Match level="QueryCoverage=100%, HitCoverage=100%, E-value=0.0, Identity=87%"; Hit description =Ribonucleoside-diphosphate reductase
  Pfam annotation: Domain name=ATP-cone; Domain location=1-91; Score =52.7; E_value=1.3e-12; Accession=PF03477.7; Description=ATP cone domain
  Pfam annotation: Domain name=Ribonuc_red_lgC; Domain location=226 -773; Score=1081.3; E_value=0; Accession=PF02867.6; Description =Ribonucleotide reductase, barrel doma
  Pfam annotation: Domain name=Ribonuc_red_lgN; Domain location=152 -224; Score=135.0; E_value=2.2e-37; Accession=PF00317.12; Description= Ribonucleotide reductase, all-alpha d
  Pfam module annotation: Pfam domain module=ATP-cone::Ribonuc_red _lgC::Ribonuc_red_lgN; Domain location=1-91::226-773::152-224
MYVVKRDGRQEAVHFDKITARLKKLSYGLSADHCDAVLVSQKVCAGVYKGVTTSQLDELAAETAAAMTTNHPDYACVSSLKFLFHLMKLCVLDGWIIDCRFESAQEHQEILLRDRCFVRLKLEIVVDSGSRSCTIILNAARLDSEIIYDRDFDYDYFGFKTLERSYLLKVQGKVVERPQHMLMRVAVGIHKDDIDSAIKTYHMMSQRWFTHASPTLFNAGTPRPQLSSCFLVCMKDDSIEGIYETLKECAIISKSAGGIGVSIHDIRATGSYIRGTNGTSNGIVPMLRVFNDTARYVDQGGGKRKGAFAVYLEPWHADMFEFLDLRKNHGKEEHRARDLFYALWVPDLFMERVQSNGQWSLFCPSEAPGLADCWGEKFEELYHRYEREGKAKKVVQAQNLWFEILKSQIETGTPYMLFKDTCNRKSNQQNLGTIKSSNLCTEIIEYSSPTETAVCNLASIALPRYVREKGVPMESHPSKLVGSTGSGNRYFDFDKLAEITALVTTNLNKVIDVNYYPVENAKRSNLRHRPIGIGVQGLADTFILLGMAFDSPEAQQLNQEIFETIYYHALKTSCDLAAKEGPYETYSGSPLSKGILQPDMWGVTPSNRWDWDALREMISSNGARNSLLVAPMPTASTSQILGNNECFEPYTSNIYSRRVLSGEFVVVNKHLLHDLTEMGLWSPTLKNKIIYEDGSVQKIPEMPAVLKSIYKTVWEIKQRTLVDMAADRGCYIDQSQSLNIHMDQPNFGKLTSLHFYAWSKGLKTGMYYLRSRAAADAIKFTVDTSALKEKSNVEYDDNTKMAQMVCSLTNREECLACGS

SEQ ID NO: 138075 - protein, 878 aa, Glycine max
  Coding DNA Sequence Number=SeqID_46390
  Gene Ontology: Mol. function=DNA binding; Cellular component=nucleus; Biological process=chitin metabolic process
  Homolog annotation: Hit_ID=A7Q3C6; Match level="QueryCoverage=93%, HitCoverage=79%, E-value=0.0, Identity=48%"; Hit description =Chromosome chr13 scaffold_48, whole genome shotgun sequence
MDLRLTALSEKLVETFNKATGATCSPEDLSYLGKFSQHFDATNIEHSLCKFIELTQKSQDVGPLSKETTLHSCDVTKDDANKAVKTLQIAKPLPSDTPVKYGVSPAKAAQVERHSSTESEESSKSSDEDQRSAERSRSLVRSATPRRSASPMRRVQIGKAGPRRAAALTIKSLNYFPGRERPISFRDAAENDFEGEVFELPNKKSEIDVKRITVQDAISLFESKQRDQTTDVQKRKSLVDVSVSTNKSVLRRWSAGMGETSVQDQAEHVPEDPVPVTSNDVVHAEAPTNSEVGVVSDFITESHNNNDNTDPDVKPERQENIGSFAADNPDETNPTVKGETNKKLAASAEWNQRKQEEFNQILKKMVESKPVLFGKSKPSRNQNISFEQRGGSYDNYKEKRDAKLRGAKAGKQVEKEAQFQQMQQLLDKRKVEMPKSVSASKKSSPRMPQNSLRKSTPPANSTKETSKPLTTKKISSRTSPMPATRKSWSATPSPRAAGTSPAKVRGGISSANTTPTRRKPVSTTSVPQPTSQREKSMPWNRNEKETQTNNARSLKSMDEKRQPAVPNKNKAIKAKVTKASEEASVPSKTNIGNKGTKKSSVVPLESKPFLRKGSRMGHGTADLNKKKGPPKMDKSQRESADLIEDQESELVVNASDLVSQHSDGDTVTPIHQNAATEPDPQIHNQLQCSETENLDQNPTDGEVLTYTEESSLNIRNEESTISPSAWVETEEDLEMPKPCEDDTFQSVSLANAAPVGSASPRVRHSLSQMLQEESSEPDTCEWGNAENPPAMIYQKDAPKGFKRLLKFARKSKGDAGSTGWSSPYMGHILVKLMKMNYSTLRNEELNRDRRDDGKGSYKMQDGRDLGAGSTTRGQSFTP

SEQ ID NO: 138076 - protein, 711 aa, Glycine max
  Coding DNA Sequence Number=SeqID_46391
  Gene Ontology: Mol. function=ATPase activity, coupled to transmembrane movement of substances; Cellular component=integral to membrane; Biological process=transport
  Homolog annotation: Hit_ID=A7QER8; Match level="QueryCoverage=12%, HitCoverage=58%, E-value=3e-33, Identity=63%"; Hit description =Chromosome chr16 scaffold_86, whole genome shotgun sequence
  Pfam annotation: Domain name=ABC_tran; Domain location=558-711; Score= -6.2; E_value=2.4e-06; Accession=PF00005.18; Description=ABC transporter
MEHVHYHLVMKEEEQQQQQLQDNAALKGRQSLQHGKVHSSIVTAVPPSFLSLEKQPLLQKEELFHTQKEQKEQPTQKVEETSNVVAENDNNLNGESETAGLGSIDEFVENAVNGEAKRSATINVDASQNKNSVYFDKQQGNDIDGANSILPKNLGEGDFDARVENSDIQCNPCNEVNNQCMETVDEKEPLLNSSEILAATVDNCGDENSAKVYPNLGEEIDQQLKDYDVEAVLAKQETHDLFCPNCKSCITKRVILRKRKRSTIPIPNLDTKAKRDKSATEVVNGSIDVTNQGDETIATPDVGRVETPADNYEPEREPEVFRCLSCFSFFIPMRNGIKLFPSFGGTREPETSQKPLVTPSSNVEDPSIVVAASNANWFFNLFTSIKGRKDSAQVDASIEDSRTDPASIEDSRVDNPESPLANTAISQSVNLSADIKPGHGGVNSSIPSILKSVIKIESWIEKSKKSNVALQNEPLVDQNDSWDFSAKEQLLTENVKTDVGDKNRDSVVGIKTDTVADISKRDSVLLTTVATTENVRTDLGEKNRDPVEVIKTANHHVQSIYSLLPSGAGKSSVLALLLRFYDPQAGKVLIDGKDIQKYNLRWLRTHIGLVQQEPLLFNCSIRDNICYGNNGASESEIVEVAKEANIHEFVSDLPLSAFRRTKAKNSHCQNITIEACNSECFKSNTTEGRQWLVREKNEGVKEQGSYIISGF

SEQ ID NO: 138077 - protein, 361 aa, Glycine max
  Coding DNA Sequence Number=SeqID_46392
  Gene Ontology: Mol. function=oxidoreductase activity; Cellular component=cytoplasm; Biological process=metabolic process
  Homolog annotation: Hit_ID=A9PG84; Match level="QueryCoverage=87%, HitCoverage=91%, E-value=1e-128, Identity=71%"; Hit description =Putative uncharacterized protein
  Pfam annotation: Domain name=ADH_N; Domain location=37-118; Score =73.8; E_value=5.8e-19; Accession=PF08240.3; Description=Alcohol dehydrogenase GroES-like domai
  Pfam annotation: Domain name=ADH_zinc_N; Domain location=149-297; Score=115.4; E_value=1.7e-31; Accession=PF00107.17; Description=Zinc- binding dehydrogenase
  Pfam module annotation: Pfam domain module=ADH_N::ADH_zinc_N; Domain location=37-118::149-297
MEALLCRKLGDPTVSLEDNNSPIVLSKNHPIPQLDSPTAVRVRIKATSLNFANYLQILGKYQEKPSLPFIPGSDFSGFVDAVGPKVSNFRVGDAVCSFAALGSFAQFIVVDQSQLFQVPQGCDLVAAGALAVAFGTSHVALVHRAQLSSGQVLLVLGAAGGVGLAAVQIGKACGAIVIAVARGAEKVQLLKSLGVDHVVDLGNENVTQSIKQFLQARRLKGIDVLYDPVGGKLTKESLRLLKWGAHILIIGFASGEIPVIPANIALVKNWTVHGLYWGSYKIHRPGVLEDSLKELLSWLARGLISIHISHSYPLSEVIRFNSEFSLTCHMEWQWLLSVHHYCGLGAGLMLLFQTAVVVLLI

SEQ ID NO: 138078 - protein, 106 aa, Glycine max
  Coding DNA Sequence Number=SeqID_46393
MKDQTPSLLTDLVQLVMERTSFKLSVGNQHPFFAHRTKAKLNIPHIIQANTNAENCKGQKGRQMEMLQTLEKVLRKKDQDFIRVLHLAQERTIQAKALKSECVKVS

SEQ ID NO: 138079 - protein, 468 aa, Glycine max
  Coding DNA Sequence Number=SeqID_46394
  Homolog annotation: Hit_ID=Q8GT91; Match level="QueryCoverage=100%, HitCoverage=100%, E-value=7e-96, Identity=64%"; Hit description =Putative uncharacterized protein
  Pfam annotation: Domain name=TLD; Domain location=256-412; Score =29.0; E_value=4.1e-08; Accession=PF07534.7; Description=TLD
MGASTSAEPRVSAEQKEAEAVTASTGALPLLQKAFSKLANPETNAVPLEISSFGREGRSYSGSNVPDSFPVLLDHLASSLVDQFFVPDKEGIIWVEFVRGYNKCCARVSASVSLNMLMRVFAAISQSANVPLHLEFESGDDDCKVNGHVLPSNVFLLLALCWVMSWGGSRKLKGEGNLSLPDLNHLVLSVIASCGEVEGGLNVWDCDISSLEVQLPAGKFVTWVMSTVPCLPDCLRQYFHARLLIAASDGVICVFMINGFSDHRGYKGPLLILIAASSGDAHEGNSIDRKWVIGALTDQGLENKDIFYGNSGCLYSIDPVFHVFPPTGKEKNFVYSHLHPTGKVYQPHPKPVGVAFGGTPGNERIFIDEDFAKVTVRHHAIDKTYRSGSLFPDQGFLPVEGLISEVEVWGLGGKVAKEVQNSYKKREELFTEQRRKVDLKTFASWEDSPEKMMMDMMSDPNAVRKEDR

SEQ ID NO: 138080 - protein, 774 aa, Glycine max
  Coding DNA Sequence Number=SeqID_46395
  Gene Ontology: Mol. function=protein phosphatase type 2A regulator activity; Cellular component=protein phosphatase type 2A complex; Biological process=signal transduction
  Homolog annotation: Hit_ID=A7QB92; Match level="QueryCoverage=85%, HitCoverage=100%, E-value=1e-166, Identity=48%"; Hit description =Chromosome chr4 scaffold_73, whole genome shotgun sequence
  Pfam annotation: Domain name=WD40; Domain location=328-366; Score =41.8; E_value=2.5e-09; Accession=PF00400.23; Description=WD domain, G-beta repeat
  Pfam annotation: Domain name=WD40; Domain location=416-453; Score =40.8; E_value=5e-09; Accession=PF00400.23; Description=WD domain, G -beta repeat
  Pfam annotation: Domain name=WD40; Domain location=457-495; Score =36.5; E_value=9.9e-08; Accession=PF00400.23; Description=WD domain, G-beta repeat
  Pfam annotation: Domain name=WD40; Domain location=498-536; Score =2.8; E_value=14; Accession=PF00400.23; Description=WD domain, G-beta repeat
  Pfam annotation: Domain name=WD40; Domain location=586-626; Score =10.5; E_value=1.6; Accession=PF00400.23; Description=WD domain, G -beta repeat
  Pfam module annotation: Pfam domain module=WD40::WD40::WD40::WD40::WD4 0; Domain location=328-366::416-453::457-495::498-536::586-626
MTQRERIGGDYYITVHYITAKHEDVVEWVGARVEFRGGSLGFKTGIVFQLQKLLASFCVSSRIGILVSREFPTCQQELSLAVSVELVRGSSYLVPRVKLGPLIFGGVLAMLISDEGDSDLFFDSVDCFSPTRESLLTKQEFGYEIWVNEPVSVMERREKFLQGLGLGDGSSSKVCSQENNMMSSDDSSVRLGLERIRDSGAASNACSCILPDDQVSELVLSGSEATSEAQALFDEHKGCPKDESCFEGKVYEVSCTDQEVRHRKVEVPEKCLGFDMGEKEKKNWWKHFISSKKGGGGKFRSKLNSTTNKTRRINVRQNKKRWMEFSALYIGQEIRAHEGLIWTMKFSPNGQYLASGGEDGVIRIWRVKTLNTSSICLNAEDSAASKVKHDFSSSQKKHSSQSSFIVLPNKIFKIEESPLHEFYGHASDVLDLAWSSSDTLLSSSSDKTVRLWKIGCSQCLSVFYHKDYVTCIQFNPVDENYFISGSIDGKVRIWGIHEERVVDWADIRDVISAISYRPDAKGFVVGSLTGTCRFYVASGKYFQLETKIRVNGKKRTSGNKITGIQKNHQRVMITSDDSKVRILEGIELVQTYKGLSRSGSQMSGSFTSGGEHIISVGGDSRVYIWNFNDSGNASSKQTKSNYSCEHFGSEGVTIAIPWSGMSAEERSGSSNDFTHYSSQHQLEASHGVRESERFSFGSWFSIDGSCRGSVTWPEEKLPSWDLPLVEVEFDHQKLCTKDPSHEKHVSETWGLSIVAAGCDGTIKTFHNFGLPIRL

SEQ ID NO: 138081 - protein, 213 aa, Glycine max
  Coding DNA Sequence Number=SeqID_46396
  Gene Ontology: Mol. function=protein binding; Cellular component =nucleus; Biological process=defense response
  Homolog annotation: Hit_ID=A7QB89; Match level="QueryCoverage=91%, HitCoverage=89%, E-value=7e-41, Identity=51%"; Hit description =Chromosome chr4 scaffold_73, whole genome shotgun sequence
  Pfam annotation: Domain name=VQ; Domain location=70-100; Score=43.3; E_value=8.6e-10; Accession=PF05678.5; Description=VQ motif
MGLESTTPRLKTPPPKKEVQLQGPRPPPLKVSKDSHKIKKPPPHPAHHHHNHPHAPPEQNLQQREPVIIYSVSPKVIHVTPGDFMDVVQRLTGASSGEYPPAGRGDVSPAARLASIEKTSPSERERVLHYKDDDIAWMLEEGVEVGQFPGILTPEPGTLPPIPAEVFSPPISGEDFSPSYWSASSFLASPSGFLSVAVASPQPSPNLFSLFDL

SEQ ID NO: 138082 - protein, 266 aa, Glycine max
  Coding DNA Sequence Number=SeqID_46397
  Gene Ontology: Mol. function=phosphotransferase activity, alcohol group as acceptor; Cellular component=rough endoplasmic reticulum membrane; Biological process=phosphoinositide-mediated signaling
  Homolog annotation: Hit_ID=A7QB59; Match level="QueryCoverage=89%, HitCoverage=21%, E-value=1e-123, Identity=91%"; Hit description =Chromosome chr4 scaffold_73, whole genome shotgun sequence
  Pfam annotation: Domain name=PI3_PI4_kinase; Domain location=8-214; Score=98.4; E_value=2.2e-26; Accession=PF00454.18; Description =Phosphatidylinositol 3- and 4-kinase
MGSHVYVLLSSDNLANTNHERSYSSQNKYIFQEAGLPLWLRPYEVLCTSSYTALIETIPDTASVHSIKSRYPNISSLREFFIAKYQENSPSFKLAQRNFVESMAGYSLVCYLLQVKDRHNGNLLMDEEGHIIHIDFGFMLSNSPGGVNFESAPFKLTRELLEVMDSDAEGIPSEFFDYFKVLCIQGFLTCRKHAERIILLVEMLQDSGFPCFKGGPRTIQNLRKRFHLNLTEEQCVSLVLSLISSSLDAWRTRQYDYYQRVLNGIL

SEQ ID NO: 138083 - protein, 223 aa, Glycine max
  Coding DNA Sequence Number=SeqID_46398
  Homolog annotation: Hit_ID=A5ARX6; Match level="QueryCoverage=83%, HitCoverage=17%, E-value=8e-11, Identity=30%"; Hit description =Putative uncharacterized protein
MDEAVKEQLRISLVSGMTMELDYVKTHLFNSKGALNNSMWKLLDMTPETSDHVDASEKSASFNLFLEETPQPCAQTGVQTKSPVKQFTETKTLKALLLNNGKDLPISLFGRARFTLQDSGFSIGGCNTLPVNVLCQTVSNDARQEFLQDAEVKERSPEKRMIYIEWRRISNLRFRRTRVHESAFYLNIGSSGLSGSVRKLYRKVEGKNMQDCVRVVKSVSILL

SEQ ID NO: 138084 - protein, 82 aa, Glycine max
  Coding DNA Sequence Number=SeqID_46399
  Gene Ontology: Mol. function=nucleoside-triphosphatase activity; Cellular component=chloroplast; Biological process=transport
  Homolog annotation: Hit_ID=A7QB49; Match level="QueryCoverage=81%, HitCoverage=24%, E-value=4e-23, Identity=74%"; Hit description =Chromosome chr4 scaffold_73, whole genome shotgun sequence
MASLFVLTVEFIHVGVIKAVRNSVDTSEEVTALWVTHRLEELEYADGAIYMEDGKVVMHGDAASIRSFIETRQSAHITQISS

SEQ ID NO: 138085 - protein, 495 aa, Glycine max
  Coding DNA Sequence Number=SeqID_46400
  Gene Ontology: Mol. function=DNA binding; Cellular component=nucleus; Biological process=regulation of transcription
  Homolog annotation: Hit_ID=Q9M4U3; Match level="QueryCoverage=86%, HitCoverage=90%, E-value=3e-70, Identity=41%"; Hit description=NAC1
  Pfam annotation: Domain name=NAM; Domain location=1-128; Score=251.5; E_value=1.8e-72; Accession=PF02365.6; Description=No apical meristem (NAM) protein
MPGFRFQPTDVELIEYFLKRKVRGKKFPSEIIAELDLYKFAPWDLPDMSLLKNGDLNWYFFCPRGKKYSTGGRLNRATEAGYWKTTGKDRAIEHNNRVVGMIKTLVFHTGRAPKGDRTDWVMHEFRLDDKVLADEGVLQKGILQASNFVEVYVSVVGFVTVRMVYQKEGPGPRNGAQYGKPYEEKEWETDEEIDSVQSAPVAAVCAPVPIQPSESHISVANYIHPSTSGCAGLTSVSCVSELMPSCSTHPSAPSNPVGTVSCVSELIPSCSEPHHLPSNNQVGSVSCVSEFMPSCSAHPSAPNSQVGSVSRVSEFMPSCSAHPSAPNCQVGSVSSASELMPSFSDHPSAPSNQVGSVSCVPELMTSCSAHPSAPNNQVDNDILSLLDCFFEDDDTLAVKENNRIENIDDPDQANNADGALCSDPNAIFEELGDLNSLVGLGEGSFSCGQKNEYTTSEMLYTVDIFGSCDHDFLELLDLETPQLWLNKHGSGSQDK

SEQ ID NO: 138086 - protein, 66 aa, Glycine max
  Coding DNA Sequence Number=SeqID_46401
MAYDMTMAMTMRCINLDSMTKAQRSSKESDVKQRRRLLLPTPESPIINNLNKYSNSWVELESIAIN

SEQ ID NO: 138087 - protein, 104 aa, Glycine max
  Coding DNA Sequence Number=SeqID_46402
MECGNAHFHCRARNSSHINNHREEGTRQWDWRVGHVATPDGLASYCPRGRPSILVYPEQIIQPFSIILAGSQLRSCSFFIKNNHHLPNNFPIFDGRKGEVGLQR

SEQ ID NO: 138088 - protein, 136 aa, Glycine max
  Coding DNA Sequence Number=SeqID_46403
  Gene Ontology: Mol. function=transcription coactivator activity; Cellular component=nucleus; Biological process=regulation of transcription, DNA-dependent
  Homolog annotation: Hit_ID=A5BZH1; Match level="QueryCoverage=30%, HitCoverage=39%, E-value=1e-12, Identity=73%"; Hit description =Putative uncharacterized protein
  Pfam annotation: Domain name=PC4; Domain location=10-93; Score=73.7; E_value=6.2e-19; Accession=PF02229.7; Description=Transcriptional Coactivator p15 (PC4)
MSGKAKRRDDDDASDADSEGHAPPMKSLKKDSDDDPDSVTICEISKNRRVAVRNWKGSIMVDIREFYVKDGKQLPGRKGWNSKGFRSDLFNAMNVILLIVLKELQFLLPCWLVARLGTIDKVLTSLKVEGYARFLY

SEQ ID NO: 138089 - protein, 438 aa, Glycine max
  Coding DNA Sequence Number=SeqID_46404
  Gene Ontology: Mol. function=metal ion binding; Cellular component =cellular_component; Biological process=intracellular protein transport
  Homolog annotation: Hit_ID=A7PKR9; Match level="QueryCoverage=98%, HitCoverage=97%, E-value=1e-179, Identity=70%"; Hit description =Chromosome chr7 scaffold_20, whole genome shotgun sequence
  Pfam annotation: Domain name=RCC1; Domain location=127-185; Score =32.2; E_value=1.8e-06; Accession=PF00415.9; Description=Regulator of chromosome condensation (RCC1)
  Pfam annotation: Domain name=RCC1; Domain location=188-237; Score =26.7; E_value=8.4e-05; Accession=PF00415.9; Description=Regulator of chromosome condensation (RCC1)
  Pfam annotation: Domain name=RCC1; Domain location=240-289; Score =20.5; E_value=0.0045; Accession=PF00415.9; Description=Regulator of chromosome condensation (RCC1)
  Pfam annotation: Domain name=RCC1; Domain location=25-71; Score=15.6; E_value=0.015; Accession=PF00415.9; Description=Regulator of chromosome condensation (RCC1)
  Pfam annotation: Domain name=RCC1; Domain location=292-338; Score =19.8; E_value=0.0054; Accession=PF00415.9; Description=Regulator of chromosome condensation (RCC1)
  Pfam annotation: Domain name=RCC1; Domain location=343-390; Score =9.1; E_value=0.076; Accession=PF00415.9; Description=Regulator of chromosome condensation (RCC1)
  Pfam annotation: Domain name=RCC1; Domain location=77-124; Score =13.2; E_value=0.027; Accession=PF00415.9; Description=Regulator of chromosome condensation (RCC1)
  Pfam module annotation: Pfam domain module=RCC1::RCC1::RCC1::RCC1::RCC 1::RCC1::RCC1; Domain location=127-185::188-237::240-289::25-71::292 -338::343-390::77-124
MELEATAATSPPSRVLLISAAGNVVCSWGRGEDGQLGHGDTDDRPLPTQLSALDAQHIDSIACGADHTLAYSESRNELYSWGWGDFGRLGHGNSSDLLIPQPIIALQGLRIKQIACGDSHCLAVTMEGEVQSWGRNQNGQLGLGNTEDSLVPQKIQAFKVPVSKTFIKGVPIKMVAAGAEHSVAITENGELYGWGWGRYGNLGLGDRNDRWNPEKVSSVDCDKMVMVACGWRHTISVSSSGGIYTYGWSKYGQLGHGNFEDSLVPQKLQALSDKLISQVSGGWRHSMALTSTGLLFGWGWNKVGVGDNLDHCSPVQVKFPQDQRVVQISCGWRHTIAVTEKENVFSWGRGTNGQLGHGDTIDRNSPKIIEALSVDGSAGPHIESSNTDLLSGGKSGVSLSERYAVVPDETVSGQTASSSSGDRLEISVPESDVKRLRV

SEQ ID NO: 138090 - protein, 44 aa, Glycine max
  Coding DNA Sequence Number=SeqID_46405
  Homolog annotation: Hit_ID=A7PKS9; Match level="QueryCoverage=81%, HitCoverage=36%, E-value=1e-07, Identity=80%"; Hit description =Chromosome chr7 scaffold_20, whole genome shotgun sequence
MALLGQTELLEDPAITSAIDEETEFNALVEEEAALLDSLWFVWS

SEQ ID NO: 138091 - protein, 68 aa, Glycine max
  Coding DNA Sequence Number=SeqID_46406
  Homolog annotation: Hit_ID=A7PKR6; Match level="QueryCoverage=82%, HitCoverage=8%, E-value=6e-10, Identity=60%"; Hit description=Beta -galactosidase
MEKWVALVLLLVFWKIREGFGVKAEEVTYDGRSLIIDGQRKILFSGLIHYPRSTPQCLKDWFLCLNNA

SEQ ID NO: 138092 - protein, 822 aa, Glycine max
  Coding DNA Sequence Number=SeqID_46407
  Gene Ontology: Mol. function=hydrolase activity, acting on glycosyl bonds; Cellular component=beta-galactosidase complex; Biological process=carbohydrate metabolic process
  Homolog annotation: Hit_ID=Q5CCQ0; Match level="QueryCoverage=98%, HitCoverage=97%, E-value=0.0, Identity=64%"; Hit description=Beta -galactosidase
  Pfam annotation: Domain name=Gal_Lectin; Domain location=744-821; Score=96.6; E_value=7.8e-26; Accession=PF02140.9; Description =Galactose binding lectin domain
  Pfam annotation: Domain name=Glyco_hydro_35; Domain location=28-291; Score=441.1; E_value=1.5e-129; Accession=PF01301.10; Description =Glycosyl hydrolases family 35
  Pfam module annotation: Pfam domain module=Gal_Lectin::Glyco_hydro _35; Domain location=744-821::28-291
MKLCLLLVLLLVTFTVALSGNVSYDGRSLLIDGQRKLLISASIHYPRSVPAMWPGLVQTAKEGGVDVIETYVFWNGHELSPGNYYFGGRFDLVKFAKTVQQAGMYLILRIGPFVAAEWNFGGVPVWLHYVPGTVFRTYNQPFMIENEYGYYENFYKEDGKKYALWAAKMAVSQNTGVPWIMCQQWDAPDPVIDTCNSFYCDQFTPTSPNRPKIWTENWPGWFKTFGGRDPHRPAEDVAFSVARFFQKGTNFGRTAGGPFITTSYDYDAPVDEYGLPRLPKWGHLKELHRAIKLCEHVLLNGKSVNISLGPSVENFHDWLFVVQFKEVNFSFVIVSTVGGRVLAAYNIPPPYLRIAKSLWTMGYEADVYTDSSGACAAFISNVDDKNDKTVEFRNASYHLPAWSVSILPDCKNVVFNTAKVTSQTNVVAMIPESLQQSDKGVNSLKWDIVKEKPGIWGKADFVKSGFVDLINTTKDTTDYLWHTTSIFVSENEEFLKKGSKPVLLIESTGHALHAFVNQEYQAGPFYDFIGAGLTSVKIKGLKNGTIDLSSYAWTYKIGVQGEYLRLYQGNGLNKVNWTSTSEPQKMQPLTWYKYLIKFLALQAIVDAPPGDEPVGLDMLHMGKGLAWLNGEEIGRYWPRKSEFKSEDCVKECDYRGKFNPDKCDTGCGEPTQRWYHVPRSWFKPSGNILVLFEEKGGDPEKIKFVRRKVSGACALVAEDYPSVGLLSQGEDKIQNNKNVPFAHLTCPSNTRISAVKFASFGTPSGSCGSYLKGDCHDPNSSTIVEKACLNKNDCVIKLTEENFKTNLCPGLSRKLAVEAVCS

SEQ ID NO: 138093 - protein, 596 aa, Glycine max
  Coding DNA Sequence Number=SeqID_46408
  Gene Ontology: Mol. function=carbon-nitrogen ligase activity, with glutamine as amido-N-donor; Cellular component=cytoplasm; Biological process=translation
  Homolog annotation: Hit_ID=A7PKQ4; Match level="QueryCoverage=91%, HitCoverage=99%, E-value=0.0, Identity=62%"; Hit description =Chromosome chr7 scaffold_20, whole genome shotgun sequence
  Pfam annotation: Domain name=Amidase; Domain location=153-558; Score =216.2; E_value=7.7e-62; Accession=PF01425.12; Description=Amidase
MEFLNGKGVVYTPVKDVDLGPYSTEFYLQANVKAPRMTGLLVKIFTHLLECPILGTLLLFILKGNNLIHRLITNAEFKESPLFVPLHDFEGLKEKEVKCLDSSLSPPEKVQLALDCLPKSSEKTLDGTNSSFCRWTIMDYAKAYRSGDITPSLVAERFIAAIDESTKPPLQMGFFIHYSADDILKQATESTLRYQRGEPISLLDGVPVAIKDEIDCLPYPTTGGTTWLHKERPCSDDACCVKRLRLCGAILVGKTNMHELGSGTSGINPHYGPARNPYDTNKIAGGSSSGSASLVSAGLCPVALGVDGGGSVRMPAALCGVVGLKPTFERIPNEGYAAISGEIPYHKTFSVSTKINLPRLSLTKSISDIKLAKYGKWFDDCSDDVRICCTKTLHMLQDHYSWKIIDVTIPEIEAMRLAHYITIGSECSTALDSFKEKNFAELGWDVRVAQSIYGAFSGLEYLKAQKMRNRQLQFHKKIFAEADVIVSPTTGVTAYQIQDDALQTGELDYVNGAALVRYSIAGNFLGLPAVTVPVGFDRLGLPIGLQFIGRPWSEATLIHLAFAMQAICMSEYRKPELYYDLLRRKNSSNGMSFDAK

SEQ ID NO: 138094 - protein, 541 aa, Glycine max
  Coding DNA Sequence Number=SeqID_46409
  Gene Ontology: Mol. function=signal transducer activity; Cellular component=membrane; Biological process=signal transduction
  Homolog annotation: Hit_ID=A5BXJ6; Match level="QueryCoverage=90%, HitCoverage=66%, E-value=1e-133, Identity=55%"; Hit description =Putative uncharacterized protein
  Pfam annotation: Domain name=DUF869; Domain location=79-537; Score =244.2; E_value=2.8e-70; Accession=PF05911.2; Description=Plant protein of unknown function (DUF869)
MDRRSWLWRRKSSEKNPGEIESSGSMSSHSERFSDDLVYPTQTTPSPEGTCEAAPNDEVNDVKTLTERLSAALLNSSAKEDLAKQHAKVAEEAVSGWEKAENELLILKQQLDTAKQKNSVLEDQVSHLNEALKECMRDLQQAKEEQEQKIHEALTNNSYGLESKKPDHEWKVVDAAKADDAASSVHLELQQRLGDKEKENSSLKIELQSQLEELKFRTIERDLSTQAAEAASKQHLESIKKVAKLEAECRRLKAMARKTLSANDHRSVAASSVYVESFTDSMSDIGERQLVVESDMQKLGGWDVSEGEPNHHDSWPSALIKELDQFNNENTAGKNSMVFSTEINLMDDFLEMERLVALPDTESVSSFPVERTASDQLNVGCGTKNAEVEAIVQKNAALEKKLEKMEAEKLELEMDLTECQKQLEASLSRIKEVELEVVELQTKLALANKSNEEAYEKLKATQEKKEIDESKLRVAHTEAEELVSKICSLEEEIEKERALSAENLAKCGKLEDELLRIKNEAQLQKDTEILYGEGANSELKQ

SEQ ID NO: 138095 - protein, 720 aa, Glycine max
  Coding DNA Sequence Number=SeqID_46410
  Gene Ontology: Cellular component=mitochondrion
  Homolog annotation: Hit_ID=A7PKP7; Match level="QueryCoverage=85%, HitCoverage=82%, E-value=0.0, Identity=72%"; Hit description =Chromosome chr7 scaffold_20, whole genome shotgun sequence
  Pfam annotation: Domain name=Polyketide_cyc; Domain location=358-489; Score=80.8; E_value=4.4e-21; Accession=PF03364.11; Description =Streptomyces cyclasedehydrase
  Pfam annotation: Domain name=Polyketide_cyc; Domain location=97-232; Score=73.7; E_value=6.2e-19; Accession=PF03364.11; Description =Streptomyces cyclasedehydrase
  Pfam module annotation: Pfam domain module=Polyketide_cyc::Polyketide_ cyc; Domain location=358-489::97-232
  Subcellular localization annotation: CTP_CleavageSite=45; ConfidenceScore=5.77e-01
MIASTSTSTNVVPHPLRFLSKPTSHSTTRFLSLTLHSRGIAVALSSSSRTTPLKPTCHFNSKDGSFELHEDEDERDVHCEVQVISWRERKVNAQITVDADTESVWNALTDYEHLADFIPNLVWSGRIPCPYPGRIWLEQRGFQRAMYWHIEARVVLDLREVINSAWDRELHFSMVDGDFKKFDGKWSVKSGTRSSTAILSYEVDVIPRFNFPAIFLERIIRSDLPVNLRALAYRAERNFVGYQKLPVSENHLRKTYAAINGSSVKKINGASSESFKKINGALCGSDKLPPAENKKEIATSVSGSMLTSSSEVRSNWGVFGKVCRLDRPRMVDEVHLRRFDGLLENGGVHRCVVASITVKAPVREVWNILTAYETLPEIVPNLAISKVVSRDNSKVRILQEGCKGLLYMVLHARVVLDLCEYLEQEISFEQVEGDFDSFRGKWIFEQLGNHHTLLKYSVESKMRKDTFLSEAIMEEVIYEDLPSNLSAIRDYIENMNASKSSEVCEQNTNSGQQIVSSGSQKDDNSGSTEEVPHCDVRCSSQQRSKVPGLQRNIKVLESELLKFIAEHGQEGFMPMRKQLRLHGRVDIEKAITRMGGFRKIATILNLSLAYKHRKPKGYWDNLENLQEEISRFQRSWGIDPSFMPSRKSFERAGRYDIARALEKWGGLHEVSRLLSLKFSSMILHQAIQYSPRPSLGFFNMHFVCPDELLFHSNFPGGEGK

SEQ ID NO: 138096 - protein, 63 aa, Glycine max
  Coding DNA Sequence Number=SeqID_46411
MGDGTIWHKEGTVNKFERNRPYYILYTNGIFVMQCPEALEPRDVTDHRTTHSTTLYNLIFILL

SEQ ID NO: 138097 - protein, 220 aa, Glycine max
  Coding DNA Sequence Number=SeqID_46412
  Gene Ontology: Mol. function=receptor activity; Cellular component =mitochondrion
  Homolog annotation: Hit_ID=A7QN13; Match level="QueryCoverage=90%, HitCoverage=57%, E-value=4e-50, Identity=51%"; Hit description =Chromosome undetermined scaffold_129, whole genome shotgun sequence
MKISLFFPLFFCSFLMVAAWVLQLTIADITDEMEKTLHWLSPMATNTSKAHHGFGWVGEWANTGSEVRKTGVMRIETFHHADKDKVEYYILELLLWLHRLAIRSKAVSDAGKVRPAIKSPVGAALQKTNEQISLLTIDEQNMLQDVNKKIPIRRISKSLDFDCLNIRFRENCRLTKSRSHSSCKSKEITFNRIFSKLPVIDFDIDKERALNVIDRLDVVR

SEQ ID NO: 138098 - protein, 104 aa, Glycine max
  Coding DNA Sequence Number=SeqID_46413
MPLPTMSFSMTSLRVAVCCRVNLTEVDRFTVVAVKEEDKGEGRLCAQLESERKRNTGDVAGGAMGWWWSEEEEVEVGWSEIRAGTGFVRCWEPQKEFMDRVRLG

SEQ ID NO: 138099 - protein, 81 aa, Glycine max
  Coding DNA Sequence Number=SeqID_46414
MEEAQIWAKKVELPAFMGTDPIGWIARAEKFLSQNNPDLDWASFSTALIKRFRDRYGNHVFERLSILKQEKKTEMETHIKK

SEQ ID NO: 138100 - protein, 715 aa, Glycine max
  Coding DNA Sequence Number=SeqID_46415
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A7NV71; Match level="QueryCoverage=93%, HitCoverage=90%, E-value=0.0, Identity=65%"; Hit description =Chromosome chr18 scaffold_1, whole genome shotgun sequence
  Pfam annotation: Domain name=MORN; Domain location=101-123; Score =35.5; E_value=1.9e-07; Accession=PF02493.11; Description=MORN repeat
  Pfam annotation: Domain name=MORN; Domain location=124-146; Score =27.9; E_value=3.7e-05; Accession=PF02493.11; Description=MORN repeat
  Pfam annotation: Domain name=MORN; Domain location=147-169; Score =28.7; E_value=2.2e-05; Accession=PF02493.11; Description=MORN repeat
  Pfam annotation: Domain name=MORN; Domain location=170-192; Score =36.3; E_value=1.1e-07; Accession=PF02493.11; Description=MORN repeat
  Pfam annotation: Domain name=MORN; Domain location=193-215; Score =35.9; E_value=1.4e-07; Accession=PF02493.11; Description=MORN repeat
  Pfam annotation: Domain name=MORN; Domain location=55-77; Score=28.0; E_value=3.4e-05; Accession=PF02493.11; Description=MORN repeat
  Pfam annotation: Domain name=MORN; Domain location=78-100; Score =36.4; E_value=1e-07; Accession=PF02493.11; Description=MORN repeat
  Pfam annotation: Domain name=PIP5K; Domain location=392-711; Score =425.1; E_value=1e-124; Accession=PF01504.9; Description =Phosphatidylinositol-4-phosphate 5-Kinase
  Pfam module annotation: Pfam domain module=MORN::MORN::MORN::MORN::MOR N::MORN::MORN::PIP5K; Domain location=101-123::124-146::147-169::170 -192::193-215::55-77::78-100::392-711
MQETLLTLSEHQQDDNNKDIELLVVPPPPCRRPPRMARRVSPGAVEKALPNGDIYSGSLSGNVPHGTGKYLWSDGCMYEGDWKKGKACGKGRFSWPSGATYEGEFAAGRMHGRGTFVGVDGDTYRGAWLSDRKHGFGEKRYANGDVYEGFWRCNLQEGEGRYTWRNGNNYVGEWKGGAISGKGVLVWKNGNRYEGCWENGVPKGRGVFTWRDGSTSSGNWGKEFVNEKRVSVDVCSNHNNNKSVSFPRICIWELDGEAGDITCDIVEASMIYGGGGGVCESDVQLQKSPCGSVDGDVKKPGHTVSKGHKNYDLMLNLQLGIRYSVGKHASVLRDLRPGDFDPKEKFWTRFPPEGSKFTPPHQSVDFRWKDYCPVVFRHLRELFGIDPADYMLAICGNDTLREMSSPGKSGSFFYLTQDDWFIIKTLKKSEVKVLIRMLPSYYQHVSQYKNSLVTKFLGVHCVKPIGGQKYRIHKRFDLKGSSHGRTTDKPREEIDETTTLKDLDLCFVFRLEHSWFQELKWQLDRDCEFLEAEGIMDYSFLIGLHFRDDSSVDEVKSLPDELCSGKRDMQNDDIQDMKWIPIDRSIISLSCYVNSNPSFLDDGPFQVILDIPGDPLIRLGTNMPARAERVCKAGLDPHTGTGSSNSTPSESGGEVSDVILYFGIIDILQDYDISKKLEHAYKSLQVDPSSISAVDPKLYSKRFRDFIHRIFVEDK

SEQ ID NO: 138101 - protein, 1087 aa, Glycine max
  Coding DNA Sequence Number=SeqID_46416
  Gene Ontology: Mol. function=ferrochelatase activity; Cellular component=chloroplast; Biological process=porphyrin biosynthetic process
  Homolog annotation: Hit_ID=Q9FEK8; Match level="QueryCoverage=40%, HitCoverage=92%, E-value=1e-162, Identity=64%"; Hit description =Ferrochelatase
  Pfam annotation: Domain name=DUF537; Domain location=627-737; Score =95.1; E_value=2.2e-25; Accession=PF04396.5; Description=Protein of unknown function, DUF537
  Pfam annotation: Domain name=Ferrochelatase; Domain location=119-391; Score=357.4; E_value=2.4e-104; Accession=PF00762.10; Description =Ferrochelatase
  Pfam module annotation: Pfam domain module=DUF537::Ferrochelatase; Domain location=627-737::119-391
  Subcellular localization annotation: CTP_CleavageSite=55; ConfidenceScore=5.64e-01
MNTPIHAPSSSPSSSSSSYMLRPPSCLSHPSRNIKCPMLLPQAICTSQKKYWCFRAHVEASFNTNPLKNYTSVSCSTWWSEAQSLVSYKTHNKQLFTVGSLATSTAQDVSDTTLIGGDKIGVLLLNLGGPETLEDVQPFLFNLFADPAEELKKSLWEKNVPAKVYVGMRYWHPFTEEAIEQGWNYKACYSSTLSTIFNINEWLKPTSTGEYIPDEYLVNMQHTVIPSWYKREGYIKAMANLIEKELKSFDCPEEVMIFFSAHGVPLAYVEEAGDPYKAEMEECVDLIMEELETRKITNACTLAYQSRVGPVEWLRPYTDETIVELGKKGVKSLLAVPISFVSEHIETLEEIDVEYKELALESGIEKWGRVPALGCEPTFISDLADAVIESLPYVGAMTASDLEAQQSLVPLGSVEELLAAYDSQRRELPPPVIVWEWGWTKSAETWNGRVAMLAVGVELPLDEEPPHSVSAVEVEIGYGGITTGRERVSTSRDGDSIESGRISGRFCLSPRKPKRGMSVSVIGKELDIQRLKTGKAPSDQLFRLLFLLCFFMVKSSGGHCSSASKKEKGSACYVCESECKPNVKECEEANAVVSKEQFSGARTLLVRLQACELSSSSSSPPRDSRYVRVSVWWDLRSCPVPDDVDPLKVAPAIRQAVRANGIKGPIAINAFGNLSSLPEHHLDTLASSGIQITHFPQGFAGLLHRISLNNYNILLAVSTNAPVLSTEATITWQWYKLLKGENLIGKHFNHPPDDPYGSWYGNFRVPLENPFPAKTKPDSLKMSSKGSSDDDIVGSEDASRKSQERYTTSMNRSAGNDQTTVDDIGTANYESGNFRARDKCVNPTRKEVDDVCHSPYAFQVDDCLVDKKTGGSDETYRKGPTFFGWIRSWWQFWKGNAKSGDSTAHQNKVVNHFEDSNSSELVDQTVQTVSDFEDKSSELDQNAICSGKPELFSSSSVWDDMESFIFTRRGSVIVYESKNRYDMLKDCEKLVREILREHPDGFRISSFPRFFVVRYGYHLDLEELVPTKDGSTESPWEEFGPVSVHNSNQSNLESELSQKAMELLASKCPDYDPIVSGNSLVDKELQF

SEQ ID NO: 138102 - protein, 25 aa, Glycine max
  Coding DNA Sequence Number=SeqID_46417
MERVVVVVVSCGGGGVARDRTFSIR

SEQ ID NO: 138103 - protein, 618 aa, Glycine max
  Coding DNA Sequence Number=SeqID_46418
  Homolog annotation: Hit_ID=A5YVF1; Match level="QueryCoverage=98%, HitCoverage=98%, E-value=1e-167, Identity=48%"; Hit description=SGS3- like protein
  Pfam annotation: Domain name=XS; Domain location=316-441; Score=-2.3; E_value=8e-06; Accession=PF03468.5; Description=XS domain
  Pfam annotation: Domain name=zf-XS; Domain location=246-284; Score =43.3; E_value=8.9e-10; Accession=PF03470.5; Description=XS zinc finger domain
  Pfam module annotation: Pfam domain module=XS::zf-XS; Domain location= 316-441::246-284
MSLKRGGGRPVTVANNDMSKGKSISEPQPKVEQLTQGIADTKLNSEQDDGEWEVYARKSKNKAGSSAAKPWGPPVHNSNPRAWGNAEMVQKPGIRSHGGVGRSSGNPWQTPNANFRRPAGRGNGRPQLGTSGYESNYVTPNPVIRPPLEHGWNWQSRPGAMQSNVRDEISPEDLQKNYGVDDDGEEEESDDLEDTDDDLMSDDDDSDASQKSHETRKKSKWYKKFFEILDGLTVEQINEPERQWHCPACQGGPGAIDWYRGLQPLVTHAKTKGSKRVKIHRELAILLDEELRRRGTSVIPAGEVFGKWKGLKEEEKDHEIVWPPMVVIQNTKLEQDENDKWIGMGNQELLDYFSTYAAAKARHSYGPQGHRGMSVLIFEASASGYLEAERLHKHFAEQGTDKDAWFNRPILYLPGGNRQLYGYMATKEDLDFFNRHSQGSISSFLDKAVKGAKHTKALEESIGIMSEKLRKTMEENRIVRRRTKMQHEETKEEMYMQEQFFKDQIKIIHDSRDAKEEDFEKMQQEEREKVKQSSSTGHVNAEEYRLKVEEYLKFVEVQDKEMENFVAEKEKLLHAHGMGYAAMKRRHWEEEVQYEQKFDEELANLMEKYSPLEKFNGI

SEQ ID NO: 138104 - protein, 140 aa, Glycine max
  Coding DNA Sequence Number=SeqID_46419
  Homolog annotation: Hit_ID=A7QR31; Match level="QueryCoverage=100%, HitCoverage=100%, E-value=2e-25, Identity=49%"; Hit description =Chromosome undetermined scaffold_147, whole genome shotgun sequence
  Pfam annotation: Domain name=4HBT; Domain location=47-125; Score =58.6; E_value=2.1e-14; Accession=PF03061.13; Description =Thioesterase superfamily
MDLESINKLLEEGAQSESPSHSLSTFYYIFIFFLTHDLSIFPSKNGGNSLHGGATATLVALVGAAAILSAGHSSDSGVSVEINVSYFGAVYAHEEIEIDARVLRVGKAVAVVSVEFRKKKTGKVFAQWRHTKYLPITSKI

SEQ ID NO: 138105 - protein, 538 aa, Glycine max
  Coding DNA Sequence Number=SeqID_46420
  Gene Ontology: Mol. function=phospholipase C activity; Biological process=intracellular signaling cascade
  Homolog annotation: Hit_ID=A5B4L8; Match level="QueryCoverage=81%, HitCoverage=77%, E-value=4e-80, Identity=44%"; Hit description =Putative uncharacterized protein
MDLWGAHHRLLFIGRHEEDGTPDTSMGEESNDEEEKIIKTEPVFVPEIKKRKRLSLSQLKEVKEESHGKQSSSKPKRKKHDSRDRWSAERYQLAEQNMWEVLKAEGASFENPITRPALRLAARKHIGDTGLLDHLLKHIDGKVAPGGTERFRRWFNTNGIMEYWLESADLDKVRQEAGVQDPFWIPPSAYRAAGAPSQNIDSSDELKQLKIELTQMKKDMHELIAKKEEKSDINMMEHFMVFCVELLWQETHKEFVKWKFMTDHRLTEIMTSLKDVQGKYGELMIWKTTVAQQLMEITNKLNDLQASRECTTYSPPSERWKDWIESTNLDNIQEDAFATWIGNPELLNVPQEVILEDPNTTMPTQPPSEELTNKKSDVLELVPVKLEDQPNVTPDSSTTVNSKSDLDNSLIMFQEMFMDLYKWKEKMEQQLMEVSNTVYEFLQYRSAYLVGVLPLLVSKYAILLCPCSLLSLCRSEVESGTIKKHLEKEKCKEISSSICTRNQSKQRGNAALIEIQIEGGNCQTLHHVPTHCQTLHLH

SEQ ID NO: 138106 - protein, 52 aa, Glycine max
  Coding DNA Sequence Number=SeqID_46421
  Gene Ontology: Mol. function=N-acetyltransferase activity; Biological process=metabolic process
  Homolog annotation: Hit_ID=Q1KUY7; Match level="QueryCoverage=75%, HitCoverage=24%, E-value=8e-10, Identity=71%"; Hit description =Putative uncharacterized protein
MEHTRSMGCYKVILDCSVENKAFYEKRGFQQKSVQMAVFCLNSVRIGTTCII

SEQ ID NO: 138107 - protein, 108 aa, Glycine max
  Coding DNA Sequence Number=SeqID_46422
MVQRRRRRSEQVATTTTTGGVRLMFEGANLRCASLQWSLEVKKILSGQVPKFQNARPRVASFFVSSTKLRLHDVYRKVFEANLMGVWPLSVTTLVARLNSSLKACNRV

SEQ ID NO: 138108 - protein, 59 aa, Glycine max
  Coding DNA Sequence Number=SeqID_46423
MKEAPDSIVKVEVIQHSNFSKYEKLMQKLWSMTTTRVLVEGGGGMGSGDLDDIGCLFEI

SEQ ID NO: 138109 - protein, 314 aa, Glycine max
  Coding DNA Sequence Number=SeqID_46424
  Gene Ontology: Mol. function=oxidoreductase activity; Cellular component=cytoplasm; Biological process=metabolic process
  Homolog annotation: Hit_ID=A5C199; Match level="QueryCoverage=100%, HitCoverage=100%, E-value=1e-132, Identity=68%"; Hit description =Putative uncharacterized protein
  Pfam annotation: Domain name=Epimerase; Domain location=39-307; Score= -64.0; E_value=0.021; Accession=PF01370.12; Description=NAD dependent epimerasedehydratase family
  Pfam annotation: Domain name=KR; Domain location=37-176; Score=-96.3; E_value=0.093; Accession=PF08659.1; Description=KR domain
  Pfam annotation: Domain name=adh_short; Domain location=37-181; Score= 27.1; E_value=2e-07; Accession=PF00106.16; Description=short chain dehydrogenase
  Pfam module annotation: Pfam domain module=Epimerase::KR::adh_short; Domain location=39-307::37-176::37-181
MGHKEKSKDRKEKRLQQISLLRTIPYSDHQRWWSKETVAVVTGGNRGIGFEICRQLAGHGVTVVLTSRDESVGVESAKFLQEGGLTEVACNQLDILDPSSINQFAHWLKENYGGLDILVNNAGVNFNQGSENNVENARNVIDTNYYGTKSMIEAMIPLMKPSAAGARIVNVSSRLGRLNGKRNRVENDALREQLSDDESLTEELIDGMISNFLQQVEDGSWRSEGWPHSFTDYSVSKLAVNAYTRFLARKFSERPEGEKIYINCYCPGWVKTALTGYSGSVTIEQGADTAVWIALVPDQAITGKFFAERREINF

SEQ ID NO: 138110 - protein, 75 aa, Glycine max
  Coding DNA Sequence Number=SeqID_46425
  Homolog annotation: Hit_ID=A9PCX7; Match level="QueryCoverage=69%, HitCoverage=23%, E-value=8e-10, Identity=61%"; Hit description =Putative uncharacterized protein
MLFTLINSILTTSNGYTGHVMTFEVGAVLEDANWQAPVYCFDENEKEKNIPILGSAVRGGSLGSLMREIPTGETM

SEQ ID NO: 138111 - protein, 262 aa, Glycine max
  Coding DNA Sequence Number=SeqID_46426
  Gene Ontology: Mol. function=transcription factor activity; Cellular component=nucleus; Biological process=regulation of transcription, DNA-dependent
  Homolog annotation: Hit_ID=Q9FH54; Match level="QueryCoverage=54%, HitCoverage=57%, E-value=9e-24, Identity=45%"; Hit description =Ethylene-responsive transcription factor ERF114
  Pfam annotation: Domain name=AP2; Domain location=85-136; Score=78.4; E_value=2.3e-20; Accession=PF00847.11; Description=AP2 domain
MEGRSISHSSEREEEYGLFPIYSERSQQDMSAMVSALTQVIGGSNSDSLHMHEGLLTSSHNNTSTQNTNEQSQVQQQEQGSVRRRHYRGVRQRPWGKWAAEIRDPKKAARVWLGTFETAEAAALAYDEAALRFKGSKAKLNFPERVQGTASEFGYLTNQHMSSSSTNSNPVAPHLTTQETYSPSHFQYAQQQFMSGESNSFSNQDMLRFYGGDNMFVSSQQSASSSSSTALSQQQQEELLKFSMQFGGSSHSNHSGNWRGGH

SEQ ID NO: 138112 - protein, 298 aa, Glycine max
  Coding DNA Sequence Number=SeqID_46427
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A7NZX5; Match level="QueryCoverage=30%, HitCoverage=17%, E-value=5e-37, Identity=78%"; Hit description =Chromosome chr6 scaffold_3, whole genome shotgun sequence
  Pfam annotation: Domain name=Glyco_hydro_1; Domain location=1-276; Score=-220.7; E_value=1.3e-07; Accession=PF00232.9; Description =Glycosyl hydrolase family 1
MQLLRVLPKGKLSAGVNHGVNYYNNLINELMANGLQPYVIVFHCDVPQALKDEYGGFLSPHNVDDFRDYAKLCFKEFGNRVKHWITLNEPRSVTNNNVHRIIPSWALCHLIILADPLFLFLLTSEGQDEYENDGFIVDEDEEEDEEEDRTESDDKPQKKKKSKEKRAKSLRRDTEEEPFGLSDEEEFVGSGKVGRTTEEKLKHSLFGDDEGMLSASQKGLIGITLNSDWYVPVSKEKSDQDVACRGLDFMFGWVTNLRKDIIEGHTGKNFIEENSWKYALLDERQREKKLISFVREKN

SEQ ID NO: 138113 - protein, 952 aa, Glycine max
  Coding DNA Sequence Number=SeqID_46428
  Gene Ontology: Mol. function=alpha-mannosidase activity; Cellular component=lysosome; Biological process=carbohydrate metabolic process
  Homolog annotation: Hit_ID=A7PGY3; Match level="QueryCoverage=96%, HitCoverage=91%, E-value=0.0, Identity=65%"; Hit description =Chromosome chr17 scaffold_16, whole genome shotgun sequence
  Pfam annotation: Domain name=Alpha-mann_mid; Domain location=319-393; Score=106.4; E_value=8.8e-29; Accession=PF09261.2; Description=Alpha mannosidase, middle domain
  Pfam annotation: Domain name=Glyco_hydro_38; Domain location=41-315; Score=379.1; E_value=7e-111; Accession=PF01074.13; Description =Glycosyl hydrolases family 38
  Pfam annotation: Domain name=Glyco_hydro_38C; Domain location=455 -946; Score=373.7; E_value=2.9e-109; Accession=PF07748.4; Description= Glycosyl hydrolases family 38 C-termi
  Pfam module annotation: Pfam domain module=Alpha-mann_mid::Glyco _hydro_38::Glyco_hydro_38C; Domain location=319-393::41-315::455-946
MENTALCVLWFILLLLGCVISSESKYIRYNTTSTIVPGKLNVHLVPHTHDDVGWLKTIDQYYVGSNNSIQGACVQNVLDSLVPALLADKNRKFIYVEQAFFQRWWREQSDAVQNIVKELVNTGQLEFINGGFCMHDEAATHYIDMIDQTTLGHQFIKEEFGVTPRIGWQIDPFGHSAVQAYLLGAEVGFDSLFFARIDYQDRAKRKDEKTLEVVWRGSKSLGSSAQIFSGAFPENYEPPSNFYYEVNDDSPIVQDDVSLFDYNVPERVNEFVAAAISQDGRVHALYSTPSIYTDAKHAANEAWPIKTDDFFPYADRVNAYWTGYFTSRPAIKGYVRLMSGYYLAARQLEYFKGKSALGPNTDSLAEALAIAQHHDAVSGTEKQHVANDYAKRLSIGYTEAEKVVAVSLACLTEGATKTGCKNPQTKFQQASSDCPLLNISYCPASEVDSSNGKNLVIVVYNPLGWKREDIIRIPVVNENVVRDSSGKKIQSQLVPILDDFLGLRNYHTVAYLGVSPTVKPKYWLAFSAAVPPLGFSTYYVSYAKKEATISDRDTAYQSWNKSDTITVGLKNLKLVYSVKEGKLTKYINSRSKVKEPLEQAYKFYTGYGNDGTETAQASGAYIFRPDGSPSPIKSNGKSPLTVFRGPIVHEVHQKISPWIYQVGPIPIDDGDGKEIATEIKTNLASNKTFYTDSNGRDFIERVRDYRKDWHLEVNQPVAGNYYPINLGIYLKDKSKEFSILVDRAVGGSSIIDGQLELMVHRRLLQDDSRGVAEALNETVCIHDKCTGLTVLGKYYFRIDPVGEGARWRRSFGQEIYSPLLLAFTESEGHWGDSHVTTFSGIDSSYNLPDNVAIVTLQDLGDGKVLLRLAHLYEIDEDKYLSVKATVELKKVFPNKQINKITEVSLSANQERDEMERKRLVWQVKGSPPEPKVYGVKFIANKSALLLPFTLDI

SEQ ID NO: 138114 - protein, 725 aa, Glycine max
  Coding DNA Sequence Number=SeqID_46429
  Gene Ontology: Mol. function=nucleoside-triphosphatase activity; Cellular component=chloroplast; Biological process=nucleotide -excision repair
  Homolog annotation: Hit_ID=P35100; Match level="QueryCoverage=100%, HitCoverage=75%, E-value=0.0, Identity=85%"; Hit description=ATP -dependent Clp protease ATP-binding subunit clpC homolog, chloroplast precursor
  Pfam annotation: Domain name=AAA; Domain location=65-291; Score=39.7; E_value=5.4e-09; Accession=PF00004.20; Description=ATPase family associated with various cellular activities (AAA)
  Pfam annotation: Domain name=AAA_2; Domain location=437-612; Score =366.5; E_value=4.4e-107; Accession=PF07724.5; Description=ATPase family associated with various c
  Pfam annotation: Domain name=AAA_5; Domain location=441-600; Score =19.2; E_value=9.9e-05; Accession=PF07728.5; Description=ATPase family associated with various
  Pfam annotation: Domain name=NACHT; Domain location=440-608; Score= -34.9; E_value=0.031; Accession=PF05729.3; Description=NACHT domain
  Pfam annotation: Domain name=ResIII; Domain location=43-166; Score= -31.4; E_value=0.021; Accession=PF04851.6; Description=Type III restriction enzyme, res subunit
  Pfam annotation: Domain name=Sigma54_activat; Domain location=411 -604; Score=-184.1; E_value=0.052; Accession=PF00158.17; Description =Sigma-54 interaction domain
  Pfam annotation: Domain name=Torsin; Domain location=393-645; Score= -163.2; E_value=0.0035; Accession=PF06309.2; Description=Torsin
  Pfam annotation: Domain name=UVR; Domain location=312-347; Score =54.8; E_value=3e-13; Accession=PF02151.10; Description=UvrBuvrC motif
  Pfam module annotation: Pfam domain module=AAA::AAA_2::AAA _5::NACHT::ResIII::Sigma54_activat::Torsin::UVR; Domain location=65 -291::437-612::441-600::440-608::43-166::411-604::393-645::312-347
MVGESADSVTATVGSGSSGNKMPTLEEYGTNLTKLAEEGKLDPVVGRQPQIERVTQILGRRTKNNPCLIGEPGVGKTAIAEGLAQRIANGDVPETIEGKKVITLDMGLLVAGTKYRGEFEERLKKLMEEIKQSDEIILFIDEVHTLIGAGAAEGAIDAANILKPALARGELQVVLSPDMFKMDFLLADSDLEVNIICKEGERMSLCIGATTLDEYRKHIEKDPALERRFQPVKVPEPTVDETIQILKGLRERYEIHHKLRYTDEALVAAAQLSYQYISDRFLPDKAIDLIDEAGSRVRLQHAQLPEEARELDKEVRQIIKEKEEAVRNQDFEKAGELRDREMDLKAQISTLVEKGKEMSKAESEAGDASPVVTEADIQHIVSSWTGIPVEKVSTDESDRLLKMEETLHKRVIGQDEAVKAISRAIRRARVGLKNPNRPIASFIFSGPTGVGKSELAKALAAYYFGSEEAMIRLDMSEFMERHTVSKLIGSPPGYVGYTEGGQLTEAVRRRPYTVVLFDEIEKAHPDVFNMMLQILEDGRLTDSKGRTVDFKNTLLIMTSNVGSSVIEKGGRKIGFDLDYDEKDSSYNRIKSLVTEELKQYFRPEFLNRLDEMIVFRQLTKLEVKEIADIMLKEVFERLKVKDIELQVTERFRDRVVEEGYNPSYGARPLRRAIMRLLEDSMAEKMLAREIKEGDSVIVDVDSDGNVIVLNGSSGAPESLPEALPV

SEQ ID NO: 138115 - protein, 108 aa, Glycine max
  Coding DNA Sequence Number=SeqID_46430
MDWGILLEKDRAGKHISLRRFKASSDFLKTKSRKLQNQWWRLNRGIEKKEQQKRNRRKTSTMVLVGAPRLYQRGVDLTKCEKINKDGRRRWWHVVALMALEKSGLDRR

SEQ ID NO: 138116 - protein, 128 aa, Glycine max
  Coding DNA Sequence Number=SeqID_46431
MVVQPKNTPHCMYIERANTQVHNVGGIVVLDETVVELQHAVAGGEVEVAEMGDRMRQAVRAPVIGEVAATLEEAVDVVRGSGEGEVVVVGKGDGVDEGGEERVDGVFVGKTQRELGLGADLHENDRGS

SEQ ID NO: 138117 - protein, 225 aa, Glycine max
  Coding DNA Sequence Number=SeqID_46432
  Gene Ontology: Mol. function=kinase activity; Cellular component =intracellular; Biological process=intracellular protein transport
  Homolog annotation: Hit_ID=A7P260; Match level="QueryCoverage=88%, HitCoverage=62%, E-value=6e-55, Identity=49%"; Hit description =Chromosome chr19 scaffold_4, whole genome shotgun sequence
  Pfam annotation: Domain name=VHS; Domain location=22-128; Score=17.4; E_value=8.3e-07; Accession=PF00790.10; Description=VHS domain
MSENLMGKVNALGERLKIGGVEEDSRHADKLVGEATSEALHEPEWAGILHICDFINADQLNTAELVRVIKKRVVAKSPPRVQYLAFVLLESLVKNCDKAFLEAWGESTIELRYLPVYAETYKSLKSRGIGFPSRDNESLAPVFTPRSATASADADVSLAHLMQHDDIHVQSFTSEQIKETFDVARNSIELLSVFFNAAGCVKESSIPDVHRIVETGIMKQCFSRP

SEQ ID NO: 138118 - protein, 67 aa, Glycine max
  Coding DNA Sequence Number=SeqID_46433
MGMGSASSIKPMWKMVTSVREDDVKECHNSHHNYACHNIHNCKENGPRFSFPSLGSDIFSRFCMDAF

SEQ ID NO: 138119 - protein, 532 aa, Glycine max
  Coding DNA Sequence Number=SeqID_46434
  Gene Ontology: Cellular component=integral to membrane; Biological process=transport
  Homolog annotation: Hit_ID=A7P899; Match level="QueryCoverage=89%, HitCoverage=85%, E-value=1e-173, Identity=63%"; Hit description =Chromosome chr3 scaffold_8, whole genome shotgun sequence
  Pfam annotation: Domain name=C4dic_mal_tran; Domain location=96-301; Score=-86.8; E_value=0.056; Accession=PF03595.8; Description=C4 -dicarboxylate transportermalic acid transport protein
  Pfam annotation: Domain name=DUF580; Domain location=186-528; Score =203.1; E_value=6.8e-58; Accession=PF04515.3; Description=Protein of unknown function, DUF580
  Pfam module annotation: Pfam domain module=C4dic_mal_tran::DUF580; Domain location=96-301::186-528
  Subcellular localization annotation: CTP_CleavageSite=30; ConfidenceScore=5.12e-01
MGSSEDPNNKGDFPYESPASQPFLSKPSSSSSAVEEESETFLSSSSFLLFLLSTFAFGIFSIIHRNNNYPSLSSFTFDPTTSSCVLNPSSNSSSSVSTWLSLLQTTSSSPSSKLVKALIWTLVITFVLSVPLCWALLLLLKHYTKQIVYASIPFFIAIPIFLNVYWFVACTLGASCSNAFPLAYRVLVMVFVFLVIGIIVWILVVNWHRVELTVSIIGVASHALSRNMALFGVLPCLTVGLVLYFVPIVVFMVFARFNGKIVVKNLKPGYACEWKEDSWVPAYYALAILTTLWSAAAMVEAQVYVISGTIANWYFSKEHQTPRRSIRTPLRNAFGPSSGTICLSGLLVCVVRMVRSAVDSARQEDTPGIVNLVLQCCVNALLTAVDFLNKFTINFAAITGEAYCSSARMTYELLRRNLLSAVFVETISSRILAGIVFVFSASYTIVACVILKAGTNLGSDSYFVAAMAWVLLIVVLGYLVHVLDNVIDTVYICYAIDRDRGEVCKQDIHEVYVQLPISRSLRQSVTTRTLGV

SEQ ID NO: 138120 - protein, 136 aa, Glycine max
  Coding DNA Sequence Number=SeqID_46435
  Homolog annotation: Hit_ID=A7PGY2; Match level="QueryCoverage=27%, HitCoverage=9%, E-value=9e-12, Identity=76%"; Hit description =Chromosome chr17 scaffold_16, whole genome shotgun sequence
  Subcellular localization annotation: CTP_CleavageSite=65; ConfidenceScore=5.57e-01
MTQSPPKFKPSNYSFTSLHFSSKITSHRSLFPTPHHRHPVTSLLAIGRLRVDCRDPWERGRKKIPSGRVWGWGPGGSWGRRRGARKYSPPGTNEEIDDLYNARDVVMKRMVKDEYFNMDDKKWDDIVEDGIKHSRV

SEQ ID NO: 138121 - protein, 761 aa, Glycine max
  Coding DNA Sequence Number=SeqID_46436
  Gene Ontology: Mol. function=identical protein binding; Cellular component=cellulose and pectin-containing cell wall; Biological process=negative regulation of catalytic activity
  Homolog annotation: Hit_ID=A7P7W9; Match level="QueryCoverage=96%, HitCoverage=99%, E-value=0.0, Identity=63%"; Hit description =Chromosome chr3 scaffold_8, whole genome shotgun sequence
  Pfam annotation: Domain name=PA; Domain location=350-452; Score=64.8; E_value=2.9e-16; Accession=PF02225.13; Description=PA domain
  Pfam annotation: Domain name=Peptidase_S8; Domain location=98-599; Score=54.0; E_value=5.1e-13; Accession=PF00082.13; Description =Subtilase family
  Pfam annotation: Domain name=Subtilisin_N; Domain location=8-89; Score=75.7; E_value=1.5e-19; Accession=PF05922.7; Description =Subtilisin N-terminal Region
  Pfam module annotation: Pfam domain module=PA::Peptidase _S8::Subtilisin_N; Domain location=350-452::98-599::8-89
MLAVVVEQVHIVYMGDRMSQSEQQLVEDSHLDILLRILGSKVAARRSILYSYKHGFSGFAAVLSQPQAKLIADFPGVVRVIPNKILSLHTTRSWDFLHVKQDIVTGALSRGQSGRGTIIGIMDTGIWPESESFRDEHMDNPPLHWRGICQEGESFDHSHCNSKIIGARWYIKGYEAEIGKLNTSDGVEYLSPRDASGHGTHTSSTAAGVAVENASFMGLAKGLARGGAPSAWLAIYKICWSTGGCSSADILAAFDDAIFDGVDILSASLGSDPPLPTYVEDALAIGSFHAVAKGISVVCSGGNSGPYPQTVINTAPWLVTVAASTIDREFSSRIILGNNQTLQGQSLYTGKDLSKFYPIVFGEDIAASDSDEESARSCNSGSLNSTLAKGKAILCFQSRSQRSATVAIRTVTEAGGAGLIFAQFPTKDVDTSWSKPCVQVDFITGTTILSYMEATRNPVIKFSKTKTVVGRQLSPEVAFFSSRGPSSLSPSVLKPDIAAPGVNILAAWSPASSARLVSDAENEDETELHPLNFNIESGTSMACPHITGIVALIKTIHPTWSPAAIKSALVTTASLKNEYKEYIWAEGAPHKQADPFDYGGGHVDPNKVTDPGLVYDMKNSDYIRFLCSMGYNNTAISILTGFPTKCHKSHKFLLNMNLPSITIPELKQPLTVSRTVTNVGPVKSNYTARVVAPIGISVIVEPSTLAFSSKRKKMKFKVTFSSKLRVQSRFSFGYLLWEDGLHEVRIPLAVRSAVHEFCGQI

SEQ ID NO: 138122 - protein, 494 aa, Glycine max
  Coding DNA Sequence Number=SeqID_46437
  Gene Ontology: Mol. function=drug transporter activity; Cellular component=membrane; Biological process=multidrug transport
  Homolog annotation: Hit_ID=A7P7W5; Match level="QueryCoverage=81%, HitCoverage=81%, E-value=1e-152, Identity=61%"; Hit description =Chromosome chr3 scaffold_8, whole genome shotgun sequence
  Pfam annotation: Domain name=MatE; Domain location=112-276; Score =48.2; E_value=3e-11; Accession=PF01554.9; Description=MatE
  Subcellular localization annotation: CTP_CleavageSite=62; ConfidenceScore=5.84e-01
MALKLSSLSLHSSLRHQHPNSSHSNHRIPLRFFAPSLPPTSCLSGAASVSTFHRTLFAVTVRAFQSQDESKSSDVFEEEEKDEEISRQGEKKELAKQSIWSQIKEIVMFTGPATGLWICGPLMSLIDTAVIGQRSSIELAALGPATVVCDYMSYVFMFLSIATSNMVATALAKQDKEEVQHHISVLLFIGLSCGVGMLLFSRLFGASLITAFTGPKNAHVVPAASNYVKTKIRGLAWPALLVGWVAQSASLGMKDSLGPLKALAAATVINFAGCILLCTYLGYGIVGAAWATMVAQVVAAYMMIQNLNMKGYNALAFSIPTGKEILMILGLAAPVFLTLMSKVVSIWGEPLSQTAQSFMPELIYGVNRSLSKARLLLKSLVTIGAMLGLLLGIVGTSVPWLFPYVFTPDRMVIQEMHKVLIPYFIALAITPPTHSLEGTLLALSSRFGLLGCWFSLALFQWARFSIALRRLLSPKGILYSEDTDQYKLRKLRTA

SEQ ID NO: 138123 - protein, 367 aa, Glycine max
  Coding DNA Sequence Number=SeqID_46438
  Gene Ontology: Mol. function=farnesyl-diphosphate farnesyltransferase activity; Cellular component=integral to membrane; Biological process= lipid biosynthetic process
  Homolog annotation: Hit_ID=O22107; Match level="QueryCoverage=97%, HitCoverage=94%, E-value=0.0, Identity=89%"; Hit description =Squalene synthase
  Pfam annotation: Domain name=SQS_PSY; Domain location=44-296; Score =337.8; E_value=1.9e-98; Accession=PF00494.10; Description =Squalenephytoene synthase
MGSLGAILKNPDDFYPLLKLKMAARNAEKQIPPEPHWAFCYTMLHKVSRSFALVIQQLGTELRNAVCIFYLVLRALDTVEDDTSIETDVKVPILIAFHRHIYDRDWHFSCGTKEYKVLMDQFHHVSTAFLELGKNYQEAIEDITKRMGAGMAKFICKEVETIDDYDEYCHYVAGLVGLGLSKLFHASGSEDLAPDDLSNSMGLFLQDLKYEENSVKAVQCLNDMVTNALMHAEDCLTYMAALRDPPIFRFCAIPQIMAIGTLALCYNNIEVFRGVVKMRRGLTAKVIDRTTTMADVYGAFFDFASMLESKVDKNDPNATKALSRLEAIQKTCRESGLLSKRKSYIVKDESGYGSTMQLAMPSCLSEH

SEQ ID NO: 138124 - protein, 88 aa, Glycine max
  Coding DNA Sequence Number=SeqID_46439
  Homolog annotation: Hit_ID=A7QLQ6; Match level="QueryCoverage=37%, HitCoverage=9%, E-value=7e-09, Identity=93%"; Hit description =Chromosome chr18 scaffold_121, whole genome shotgun sequence
MVTMITGEIANFVAYIYAPAVLVTPLGALSIIVRNGFGRWGYWGVYPALWDQLLLSSMHHKSKLRVLSKKYGIWPLNQVGFYPVLIYP

SEQ ID NO: 138125 - protein, 382 aa, Glycine max
  Coding DNA Sequence Number=SeqID_46440
  Gene Ontology: Mol. function=hydrolase activity, hydrolyzing O -glycosyl compounds; Cellular component=extracellular region; Biological process=carbohydrate metabolic process
  Homolog annotation: Hit_ID=Q8GTJ2; Match level="QueryCoverage=97%, HitCoverage=64%, E-value=1e-128, Identity=59%"; Hit description =Endoxylanase precursor
  Pfam annotation: Domain name=Glyco_hydro_10; Domain location=22-318; Score=105.7; E_value=1.4e-28; Accession=PF00331.11; Description =Glycosyl hydrolase family 10
  Subcellular localization annotation: CTP_CleavageSite=83; ConfidenceScore=5.08e-01
ARKRKVLVQAVDEEGNPLPNATISFVQKRPGFPFGSSMSSSILNNKLYQDWFTSRFTVTTFGNEMKWYSTENVQGKEDYSVADAMLQFAKQHNIAVRGHNIFWDDPHFQPSWVPSLSPPQLNSAVEKRVRSVVSRYRGQLIAWDVVNENLHFSFFEDKLGQAFSGRIFNEAHNIDGQTTLFLNEYNTIEDSRDGVSSPAKYIQKLKQIQSYPGNAGLPIGIGLEAHFPAQGINFPYLRASIDNLAATRLPIWITELDVASQPKQSQYFELALRELHGHPMVRGLVMWTGPSPEGCYRICLVDNNFRNLPAGKVVDKLLSEWRLSKLSGMTDQNGFFEANLFHGDYEIEVSHPVMKNYTFTQRLQVTPTDDSKETKQFVQLSM

SEQ ID NO: 138126 - protein, 180 aa, Glycine max
  Coding DNA Sequence Number=SeqID_46441
  Gene Ontology: Mol. function=DNA binding; Cellular component=nucleus
  Homolog annotation: Hit_ID=A7PNH7; Match level="QueryCoverage=82%, HitCoverage=52%, E-value=9e-42, Identity=60%"; Hit description =Chromosome chr1 scaffold_22, whole genome shotgun sequence
MQENKADGTFNLAKIWLLWLATADHNLEPYFKRKRRKSEEHNLGKKVNNRKNEYSKVMLLQDKPVELASKTNLHSALPSSMATYPRMSHHMDQSQQIQYDGICSPLKQLMEQNAQAFNQITANLSTYKLQDNIDLFCHTRHNINTILNNMSEMPGIMSQMPPLQVTINEDLASSILPNRT

SEQ ID NO: 138127 - protein, 124 aa, Glycine max
  Coding DNA Sequence Number=SeqID_46442
MNACVEGNKRQLPPWMMQKVGASATATHVSDSVETNSSTKKGDIIKANATKKDTHKSEPSNLRAKCEVKGRKKLDQQEGKVTQKKRKGDKSKDRDKRSSIQQQQQQQQRLIPLGGVGYMDQLPP

SEQ ID NO: 138128 - protein, 325 aa, Glycine max
  Coding DNA Sequence Number=SeqID_46443
  Gene Ontology: Mol. function=zinc ion binding; Cellular component =intracellular; Biological process=regulation of transcription
  Homolog annotation: Hit_ID=A7P7Y4; Match level="QueryCoverage=65%, HitCoverage=100%, E-value=2e-83, Identity=70%"; Hit description =Chromosome chr3 scaffold_8, whole genome shotgun sequence
  Pfam annotation: Domain name=zf-B_box; Domain location=111-160; Score= 37.4; E_value=5.3e-08; Accession=PF00643.15; Description=B-box zinc finger
  Pfam annotation: Domain name=zf-B_box; Domain location=164-209; Score= 47.7; E_value=4e-11; Accession=PF00643.15; Description=B-box zinc finger
  Pfam module annotation: Pfam domain module=zf-B_box::zf-B_box; Domain location=111-160::164-209
RQDPDPFLIRLYKAFDLVSLLILPPKNGHINQIMTPEKQILLGLLLAKHVSLESDANTSTNTTTSLTVEDRTLLVKEAVAQGLKGERRIEEEEEERRRRAFEGINIKKLKIMRTLCDVCESAAAILFCAADEAALCSACDHKLQIHMCNKLASRHVRVGLADPTDVPRCDICENAPAFFYCEIDGSSLCLQCDMIVHVGGKRTHGRYLLLRQRAQFPGDKPAQMEELELQPMDQNESRRDESQSLKLKTRDSQQNHSVSPFPRQENNIDGHGKMDKKLIDLNTRPLRLNGSAPNNQEQCMDILRGNNHESASVPPVESFKQESEK

SEQ ID NO: 138129 - protein, 661 aa, Glycine max
  Coding DNA Sequence Number=SeqID_46444
  Gene Ontology: Cellular component=integral to membrane
  Homolog annotation: Hit_ID=A7PNG5; Match level="QueryCoverage=99%, HitCoverage=96%, E-value=0.0, Identity=64%"; Hit description =Chromosome chr1 scaffold_22, whole genome shotgun sequence
  Pfam annotation: Domain name=C2; Domain location=422-507; Score=50.5; E_value=6.1e-12; Accession=PF00168.21; Description=C2 domain
  Subcellular localization annotation: CTP_CleavageSite=55; ConfidenceScore=5.82e-01
MILQHASPISHFHFSPLSSLCPGNSNTPFPFSRRRRKRLFANSGSRKFRRKCTVRFCAVPSSDNNHPNWNADFANSARRTATTFVLKRISNNNNNNNNNNNNDNDVIVTELQAPPPSVQLGSNFTGFSEDPIVDKLRTQLGVIHPIPSPPINRNVIGLFVFFFFVGVVFDKLWTWRRRRSKNNSGGGEDGLGVWPQVPTSFSLLLEKDLQRKESVEWVNMVLGKLWKVYRGGIENWIIGLLQPVIDNLKKPDYVQRVEIKQFSLGDEPLSVRNVERRTSRRVNDLQYQIGLRYTGGARMLLMLSLKFGIIPIVVPVGVRDFDIDGELWVKLRLIPTEPWVGAVSWAFVSLPKIKFELSLFRLFNLMGQRFLTKLLTEDLPKLFVRPKKIVLDFQKGKAVGPVAVGVKSGETQEGNKDSVGELSVTLVDARKLSYIFYGKTDPYVILSLGNQVIRSKKNSQTTVIGPPGMPIWNQDFHMLVSNPRKQKLFIQVKDVLGFADLTIGTGEVDLGSLKDTVPTDRIVVLQGGWGFLGKRSSGEILLRLTYKAYVEDEEDDKTEVYAIYTDVSDDELSDSEVNGTNEKDERDSAYETDKESFMDVLAALIVSEEFQGIVASETGFSKVLDSGSNAGPRVSKSQVPNVEPIPSSSDNSEGFGGIIIL

SEQ ID NO: 138130 - protein, 41 aa, Glycine max
  Coding DNA Sequence Number=SeqID_46445
MVGEKKKEIPVSDNNRVPSSPSSDLSSICGGEISTVVLHLG

SEQ ID NO: 138131 - protein, 80 aa, Glycine max
  Coding DNA Sequence Number=SeqID_46446
MGGRMFELIGLTEEMGELIGSAEVMVDLSRLTHLFEEWLDCEDDGSREEKVHHLGNHKWRKLECATLRMRIDFHQIIRGT

SEQ ID NO: 138132 - protein, 936 aa, Glycine max
  Coding DNA Sequence Number=SeqID_46447
  Gene Ontology: Mol. function=metal ion binding
  Homolog annotation: Hit_ID=A5B3L6; Match level="QueryCoverage=99%, HitCoverage=68%, E-value=1e-143, Identity=42%"; Hit description =Putative uncharacterized protein
  Pfam annotation: Domain name=PHD; Domain location=286-335; Score =28.8; E_value=5.6e-06; Accession=PF00628.20; Description=PHD-finger
MIQNADMRLESGTCNVCSAACSSCMHPNRALMGSKAEEFSDENCRLGEVNQYCDESDRSSLGSRACERLKHGVSETSHKPSVSSTHDSLSENAENSQALSEKYQDSKCLESLDDSTSCISRTSNANLASSCHQINTDRINISCSSTSVSHLVAEGSGNGPTVDISSLSECCMENVDSSLTKERVPIIVPGEKSLADKENLNNGTAKVSIEICPKSEEDTENNVDVAEDDDHKYSAHDGLHEKVEELIKSSGRAEPQSEDESDESDVVEHDIYACILSIILRPVVKVCDICGDAGREDLLAICSRCSDGAEHTYCMREMLEKVPEGDWLCEECKCAEETANRKLDIEEKKNHKVSSTSQISGKRPSQSMEIATAAKRQALESSTGSPKASSPKRIVPLSRESSFKSMDKEKMKSGQQKIPMHNHLGGDDTELARSLSAGPRSQNARSTLLKSNSFNNNSKPRVKLVDEVVPQKQKGVVEHISKNMETPAGMISKSMSFKLSNLGRSNAVESKVKMISSKPGTTQDLKASRHAKDSASFDRKFLSKIDRPVICSTMVSSVVSTSKGDPKLTPHGETAKPSTVNNNREFKVNQDGKLYSLSKSMNNTSSKSPEPQVSSDRTSTSVDETQQDKLPRSQDTANQVDKAKDSSIDHVMSGVTNASKSSFCRKCKDFGHATECCTVSGTQEFGAESSVIATSSSKEEMHEGNRLKAAIQAALLRRPEIHKRKEAPDQTNEFPTSSTGLKREVTSQKQVLVSSTLKNSISAEESNMKQEIIVNSTVETSKCPSANDLKQVKFCRTDFCSQLRKSDSVGPTSGKPVVRDLPNNAMEISSILSKMSVIPEYEYIWQGVFKVHRNGMPPDLYTGIQAHLSACASPKVHEVVKKFLPEVSLNEVSRLSIWPSQFHQGGAKEDNIALYFFAKDIERQGYEYHSFIDSRL

SEQ ID NO: 138133 - protein, 561 aa, Glycine max
  Coding DNA Sequence Number=SeqID_46448
  Gene Ontology: Mol. function=catalytic activity; Cellular component =plastid; Biological process=cellular metabolic process
  Homolog annotation: Hit_ID=A7P7Y8; Match level="QueryCoverage=52%, HitCoverage=70%, E-value=2e-75, Identity=53%"; Hit description =Chromosome chr3 scaffold_8, whole genome shotgun sequence
  Pfam annotation: Domain name=ATP-synt_C; Domain location=13-78; Score= 56.6; E_value=8.6e-14; Accession=PF00137.12; Description=ATP synthase subunit C
  Pfam annotation: Domain name=ATP-synt_C; Domain location=92-157; Score=86.1; E_value=1.1e-22; Accession=PF00137.12; Description=ATP synthase subunit C
  Pfam annotation: Domain name=DUF1731; Domain location=416-450; Score =20.5; E_value=4.9e-05; Accession=PF08338.2; Description=Domain of unknown function (DUF1731)
  Pfam annotation: Domain name=Epimerase; Domain location=134-389; Score=-63.4; E_value=0.019; Accession=PF01370.12; Description=NAD dependent epimerasedehydratase family
  Pfam module annotation: Pfam domain module=ATP-synt_C::ATP-synt _C::DUF1731::Epimerase; Domain location=13-78::92-157::416-450::134 -389
  Subcellular localization annotation: CTP_CleavageSite=25; ConfidenceScore=5.21e-01
MAPFSGDETAPFFGFLGAAAALVFSCMGAAYGTAKSGVGVASMGVMRPELVMKSIVPVVMAGVLGIYGLIIAVIISTGINPKAKSYYLFDGYAHLSSGLACGLAGLSAGMAIGIVGDAGVRANAQQPKLFVGMILILIFAEALALYGLIVGIILSSRAAKDFPGIKIAEEPEWKDSIQGSTGVVNLAGLPISTRWSPEVVELINSAPDDIRPKVFVSATAVGYYGTSETQVFDEQSPSGKDYLAEHKHKPHITKVYTHKYPRGAIHPTVTTHPKGINHPIVTIHPKGARGHDPWEQSQPTIMIRPRGAREWESTALKVNGGVRVALIRIGVVLGKDGGALAKMIPMFKLFAGGPLGSGTQWFSWIHLEDIVNLIYETLSNPSYKGVINGTAPNPVRLAELCDQLGHALGRPSWLPVPDFALKAVLGEGATVVLEGQKVLPTQAKKEQRVVKNPRSNCDTSEKKESTPNGNSLIEGQKSTRNDPTGDPIHAEPPTSAGKSRIYKPNMKKYALSGKKIPHVGQYRTDAEPSRPRQRGPRMVLHCEAQAQSQKRESKPTNAGKE

SEQ ID NO: 138134 - protein, 376 aa, Glycine max
  Coding DNA Sequence Number=SeqID_46449
  Gene Ontology: Mol. function=nucleic acid binding
  Homolog annotation: Hit_ID=Q5Z807; Match level="QueryCoverage=99%, HitCoverage=97%, E-value=3e-49, Identity=34%"; Hit description=Zinc finger protein-like
  Pfam annotation: Domain name=zf-CCCH; Domain location=2-25; Score =30.5; E_value=6.3e-06; Accession=PF00642.15; Description=Zinc finger C-x8-C-x5-C-x3-H type (and similar)
MRDICRNFQRGSCQYGERCRYLHVQQQRKPNVNGFGGQSSSYQQQNTNPFGFGSGSQQQQQQKGNPFGFGKQNSSQLNGGPHSEHKPNQYKPFENKWNRQSSKPQQNGVKSENNSKQTDHICTDPENCKRQIAVDFEQEKPLWILTCYSHCKGAPCDIVGDISYEELRASAYEDAKRGMNLQSIVEKERNILNSKLVEFQKLLSEPYQIPISSSLGSPTPQSIVANANANPFSTSQSNGPLSVSSFSQLSTPLNMGFERPSAPLTNTLTKPGFFGSGGNSLASNNAANLNSSAVFGVQSGPYSTPVDLNMFPGSTQQTLTAFNNSDPTTMFQTTPDVQLSNMSQVEKVSVDPSIWLKEKWNPGEIPEEAPPDTFVR

SEQ ID NO: 138135 - protein, 496 aa, Glycine max
  Coding DNA Sequence Number=SeqID_46450
  Gene Ontology: Mol. function=transferase activity; Biological process= D-ribose metabolic process
  Homolog annotation: Hit_ID=A7PB74; Match level="QueryCoverage=83%, HitCoverage=100%, E-value=1e-153, Identity=69%"; Hit description =Chromosome chr16 scaffold_10, whole genome shotgun sequence
  Pfam annotation: Domain name=PfkB; Domain location=125-470; Score =22.1; E_value=5.9e-08; Accession=PF00294.15; Description=pfkB family carbohydrate kinase
  Subcellular localization annotation: CTP_CleavageSite=51; ConfidenceScore=5.49e-01
MSLSLLRIYSSPHLLSSSLFFPTPPLSSFLPKLPNAPRTPHIVLCHRRDASSASKQRVPEDTEYEQPMRTSYDDDEEEEEEFLGSLVLPERWDVLGLGQAMVDFSGMVDDNFLKNLGLEKGTRKVVNHEERGRVLQAMDGCSYKAAAGGSLSNTLVALARLASRSQKVPAINVAMTGSVGSDLLGGFYREKLRRANVQFLSAPMKDGTTGTVIVLTTPDAQRTMLAYQVQYTTNVIFQQDILGILKFLLPLLANSMSSINSVDANISVLRFQGTSSTVNYDASLASAVSKTNILVVEGYLFELPDTIKAITKACEKARTNGALVAITASDVSCIERHFDDFWCQITHMEIIGNCVDLVFANGDEARALCNFEAKESAASAARYLSHFVPLASVTDGPTGSYIGVKGEAVYIPPSPCVPVDTCGAGDAYASGILYGLLRGISDLRSIGSLAAKVAATVVGQQGTRLRISDAVKLAESFEFQLDSSSSVGTDHNISSV

SEQ ID NO: 138136 - protein, 400 aa, Glycine max
  Coding DNA Sequence Number=SeqID_46451
  Gene Ontology: Mol. function=binding
  Homolog annotation: Hit_ID=Q5TJC4; Match level="QueryCoverage=92%, HitCoverage=99%, E-value=1e-110, Identity=61%"; Hit description =Impaired sucrose induction 1-like protein
  Pfam annotation: Domain name=CDC14; Domain location=78-335; Score= -126.4; E_value=0.087; Accession=PF08045.2; Description=Cell division control protein 14, SIN comp
MHFNFIDDYYRDGKKGVVTEIEELTKRKGKGEMYLKKPLWSETGKDDGGSAKTEEEDHGDGAVSEVVKSLQQQRVYREVTLALRTGLRDARAEFSFLRVRALRSILKFLRSVAESGSTIDLFNQTQSIPQLQGLFCSLLHSVKYVFVHCSLLFAVVPVLFHHSLKESGDDDYNEKKIKLTSPSTDAEVALALRVLEGCCLLHPQSTALAHQHNAIQVLMNILSTRGVLEQGACLDALISLMVDSSSNQMDVLIDVPLDAYQIDFEKCSGIMEVADLLRDKQLDENLSPSMLLKTAKLPHKDKEMTIGLLVTVLQNIYDTYWNVMERALLKCGEFLLLLIGHVNGRDAPPLATIHEDTRRLLGEKSASLIWAASQFGSTLDPEQRLTALQIQARRVLESLD

SEQ ID NO: 138137 - protein, 191 aa, Glycine max
  Coding DNA Sequence Number=SeqID_46452
PPPDLRGGSTVRAQPKDKAGRQVWITRTNMTTLTQIWMALLLSKILPSDHNSDLPLLKWIAPTRHPVDPEKSNRALGFPTLIAGLCQFYEVLVAPSKVIRPPINKAFIEKYCTPRLAQGEAPQQPGDGQQQATDALPPLLEYWARDRQVVITHLAQDVKDALLGGSLGDAGLTGASSKRGRQMESPPMFIR

SEQ ID NO: 138138 - protein, 201 aa, Glycine max
  Coding DNA Sequence Number=SeqID_46453
MAPRKLASKRSRKDKAAEGTSFAPEYDSHRFRSAEHQQRFEAIKGWSFLRERRVQLRDDEYTDFQEEIVRRRWASLVTPMAKFDPDIVLEFCANAWPTVEGWIPFDADALSQFLGYPLVLEEGQECEYGQRRNQADGFDEEAIAQLLCIPGQDFARTAAGRRVRIMRTNMTTLTQIWMTLLLSNIQPSDHNSDLPLPKCQL

SEQ ID NO: 138139 - protein, 94 aa, Glycine max
  Coding DNA Sequence Number=SeqID_46454
VDSRGSPKVGVEEVKDANAPILVPTDEEAVGLAKLADRPDHEVDDPLYLMTLIIPQIFLKPLQASDLDKYAIREFRCVWIPRATVHPEIWTIAV

SEQ ID NO: 138140 - protein, 143 aa, Glycine max
  Coding DNA Sequence Number=SeqID_46455
ANAGRIGATGAKKKEGDTHAVTSAPAWVKLPQASHGTHQYAQHHASFSAHAGNFSNAAPAQPRAPAPIQRGAPLSSGSNHDSPGRQCPLWFQFQHDENLSPEANSRIHPTPNDVRRPLAVPHRQPNGCDNSREDLPIPFPKVV

SEQ ID NO: 138141 - protein, 54 aa, Glycine max
  Coding DNA Sequence Number=SeqID_46456
MRVHIIWYQSSEIHDAILPRKGPVTKAMSKRLQGDWARVAEEGPRVLMSLRVDF

SEQ ID NO: 138142 - protein, 85 aa, Glycine max
  Coding DNA Sequence Number=SeqID_46457
ATNHRGQVQIHECLYQLSISYQSQGYTPFACPTPDQFKAEVAWPGDWPEAQAGEAPAEAPSDAEEARMDKEMTDLLGFLGGSGAT

SEQ ID NO: 138143 - protein, 218 aa, Glycine max
  Coding DNA Sequence Number=SeqID_46458
GGPLGTSTLSFRGLHVLTFRGLHALAFGGLHALAFKGLHVLAIRGLHVLAFRGLHVLASRGLHVLTFRGLHTLIFRGLYVFPLRGLHVLAFGGQHALAFRGQHVLAFGGQHTPSPLEGYAAPTVRIQPEREAITQLLCIPGQDFTRAAAKGRVRIMRTNMTTLTQIWMTLLLSNIPSSDRNTDLPLRKDRAHKAPSGPEAVRQGPGAFSSGYGLVSVL

SEQ ID NO: 138144 - protein, 97 aa, Glycine max
  Coding DNA Sequence Number=SeqID_46459
MVQVCTIKFRTAYPNFMKIQWLQCEGFYSKLRCNIEIPNGENAQNWVANMVLKFHDDPTVNEPKIVVFLRQVWWTAGKRKGFERRKGKTKMRPKRAT

SEQ ID NO: 138145 - protein, 165 aa, Glycine max
  Coding DNA Sequence Number=SeqID_46460
  Homolog annotation: Hit_ID=A5AK77; Match level="QueryCoverage=52%, HitCoverage=10%, E-value=2e-10, Identity=38%"; Hit description =Putative uncharacterized protein
MTRGNPVDLQPFDPKIDRKFHRLVRHSVHLVHSVHFEHSEHSVEGDSEYSDFEHFTTNFHTKNMVQPPPRERTLREMVAPDFTYESLCIQYPDEGVPYVLKTGLIHLLPKFHGLAGEDPHKHLKEFHIFCYTMKPPDVQEDHIFLKAFPYSLEGVAKHRLYYLAP

SEQ ID NO: 138146 - protein, 118 aa, Glycine max
  Coding DNA Sequence Number=SeqID_46461
  Subcellular localization annotation: CTP_CleavageSite=57; ConfidenceScore=5.35e-01
MEAREIVSFLDTTFGQHGTQRMFFKKATRTLRRFAKVRGSKTKPTGMYISPVESPTVATYPSAGGRRVTRGMRVPRKEYAQSRHQRLFEENVGKTGKDAIYELLSDRFGSCIYARGRY

SEQ ID NO: 138147 - protein, 173 aa, Glycine max
  Coding DNA Sequence Number=SeqID_46462
  Homolog annotation: Hit_ID=UPI00006A2D9E; Match level="QueryCoverage =84%, HitCoverage=85%, E-value=8e-14, Identity=17%"; Hit description =UPI00006A2D9E related cluster
MKGTVHEPQANLGADQKLSPVDGGPLGTSTLTFKGLHVLAFRGLHILTFRGLHVLAFRGQHVLTFRGLHVLAIRGLYILTFRRLHALTFRGLHALAVRGLHVLAFRGIHVLLFRGLHALAFRGLHILAIRGLHALTFRGLHVLAIRGLHAFTFRGLHVLAIRGLHALTFRGLH

SEQ ID NO: 138148 - protein, 148 aa, Glycine max
  Coding DNA Sequence Number=SeqID_46463
MTVTLLLKGGPWVLVTLTVERTTRPRLERTTRPHHQRAARPHLERTTCPRLERATRPHLGGLDVLALRGLHVLTIRGLHALTSRGLHVLALRGLHALTLGTSYPHRQRTTRPRLERTTHPHHQRAARPHLQRTTCPRLERATRPHLGY

SEQ ID NO: 138149 - protein, 103 aa, Glycine max
  Coding DNA Sequence Number=SeqID_46464
MTGLPMILLSESDLTNPLCEAKLHDESRLIQRCFDDIKDDDNGDEKKLKGKLKNTSRFKRKVDFKDQESRFKDQASKNQDSRIKLPRIKIKIQDSRFKNQEKT

SEQ ID NO: 138150 - protein, 102 aa, Glycine max
  Coding DNA Sequence Number=SeqID_46465
MVGYTPSSFTDLVFASERIKVGLKRGKFNHPAWTNEKTGANEKAITPAKVHQPPFLRGYDSNATCAYHGGVLGHSIEHCITSKRKLQSLIDAGWLKFEKNRL

SEQ ID NO: 138151 - protein, 154 aa, Glycine max
  Coding DNA Sequence Number=SeqID_46466
DRAHKTPSGPEEVQQGPGVSSSGHGPLESYKVPVPPARSCHRDIGKNHTHKDTQWTRRSPIGPCGFQLWLRASVVLQGAHSPRQGHIIIGIAPARHPVDSKNSMEYLSPPARASGPLLIELSSRSTASPGRRREKHHSSLRMASSRQQTHRHNL

SEQ ID NO: 138152 - protein, 39 aa, Glycine max
  Coding DNA Sequence Number=SeqID_46467
MTLGVEFNVESLTCRDWNTSSKVSKRCKKEKDYLYKHEV

SEQ ID NO: 138153 - protein, 135 aa, Glycine max
  Coding DNA Sequence Number=SeqID_46468
MLEVVSNPWRFTVGNWLCDSDLVSPTGIERVLTEKDLLADSYSDLEASILDEKEFFLLKVISTFPELSCLICSIVGTAQGIDGVALSIPIFREELLHPIYFLGRDTTLDAQVFMTLYWILYIKAAGIDPSFMSRP

SEQ ID NO: 138154 - protein, 99 aa, Glycine max
  Coding DNA Sequence Number=SeqID_46469
MGQLQRQAFCKAYASADCEIVGRNPGMPTGRKEAISFLWVLSLHDKSCQGSENLNTRVGTSKAKQKWSSRSTKEVFGGKGKGLGKIKANGLLFLTSWRF

SEQ ID NO: 138155 - protein, 139 aa, Glycine max
  Coding DNA Sequence Number=SeqID_46470
MVQSNTNQKSGRRNTFAPPGSVPVEKWMHQGLIRFNKGIMEVGGSSGTKQIGPQEANRYSYRNNYKGKNPMTRTQWRRFQRQKKLAQQNLQTGQYKEVSRRPVKERLLPPVDEDKMEDEDLLDSEPDFDVICVVSYLAI

SEQ ID NO: 138156 - protein, 138 aa, Glycine max
  Coding DNA Sequence Number=SeqID_46471
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=98%, E-value=5e-09, Identity=33%"; Hit description =UPI00006A17C9 related cluster
  Subcellular localization annotation: CTP_CleavageSite=66; ConfidenceScore=5.17e-01
GEIGIAVAGQNARVKSCPGMHSSCVIASLSGCACTVGPPPISGGGPGTVWMSSTLKMRTRSPQKVRACSPLKARRCSPLEMRACSPLLARTCSPFKVRACSPLTVRACNPLMVRTCSPLKARTCSPLKARTCSPLNSE

SEQ ID NO: 138157 - protein, 219 aa, Glycine max
  Coding DNA Sequence Number=SeqID_46472
MVISPGATRPAHGTTEYTDFPGEIVCPAGGHHWVIPMAKFDPDIVLEFYANAWATEEGVRDMRCYRPAPGIPLVLEEGQECEYGQRRNRSDGFDEEAIAQLLCIPGQDFARTATGRRVRIMRTNMTTLTQIWMTLLLSNIQPSDHNSDLPLPKCQLVYAILTRMSIHVAQLIADAIYIFAGMAPTRHPLDPDKSNRALGFPALITGLCQSFGVPVAPSK

SEQ ID NO: 138158 - protein, 122 aa, Glycine max
  Coding DNA Sequence Number=SeqID_46473
MQSQGFALSLEPEIGPSAARVSTKESCVDPSGNDPDTGDSDKYGLYIEENHHRLVALERLYERFTTVHNIPLLHDQVKVGFDEVRDANAPIPVPTEEVKLVGQTLNTFLAWTTYLVKRLSEQ

SEQ ID NO: 138159 - protein, 133 aa, Glycine max
  Coding DNA Sequence Number=SeqID_46474
MGEVEEIQEKMKVDMEAMKERMATMMALMSMRKIMEANVVTIAATSTVAKVKPDAPIWPQPNESSNLRYADFEPWLGYATEGQTIGGIPLENTSEGPQYHPQIHLLHSTTSKNPHAMAKMGKLDHLEERLRAN

SEQ ID NO: 138160 - protein, 90 aa, Glycine max
  Coding DNA Sequence Number=SeqID_46475
MRLPGKESLLMKSPITLTEILDVSISFLNEHLEETLGRMMQAPLELVGLGSSSSMDSFASWKINGSGMEKEEREETPLQGEDESRRSSPP

SEQ ID NO: 138161 - protein, 26 aa, Glycine max
  Coding DNA Sequence Number=SeqID_46476
MAYMSYPNFVREPLLDDVRPFFGPCG

SEQ ID NO: 138162 - protein, 64 aa, Glycine max
  Coding DNA Sequence Number=SeqID_46477
IVPARHLVDPKKANRVLELPALNTGLYQFKGVPVAPSRVIRLPTNRAFIKKCCAPRRAQGETPQ

SEQ ID NO: 138163 - protein, 253 aa, Glycine max
  Coding DNA Sequence Number=SeqID_46478
MARRDKLWSFCTLLSSRGGGPDDMRRQNLVIPHPFAIQTRSCPMARRDKLWSFCTLLSSRGGGPDDMRRQNLVIPHPFAIQTQSCPMARRDKLWSFCTLLSSRGGGPDDMRRQNLVIPHPFAIQTQSCPMARRDKLWSFCTLLSSRGGEPDDMRRQNLVIPHPFAIQTQSCPMERRDKLWSFCTLLSSRGGGPDDMRRQNLVIPHPFAIQTQSCPMARRDKLWSFCTLCQSRPISPLTRGDFHHLPHLQDLLF

SEQ ID NO: 138164 - protein, 230 aa, Glycine max
  Coding DNA Sequence Number=SeqID_46479
  Homolog annotation: Hit_ID=Q5QJQ3; Match level="QueryCoverage=38%, HitCoverage=70%, E-value=2e-45, Identity=96%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFPGVLNIWGLGDMEGIILISTGTELEFVIMVIAVSCSAPLTSITKIDAQVRGGETRQDYKDTRRFPLEAPSCALLFRPCRLPDTCPAFSLREAWRFLIAHAVGISVRCRSFAPSWAVCTNPPVQPDRCALSGYYRLESNP

SEQ ID NO: 138165 - protein, 81 aa, Glycine max
  Coding DNA Sequence Number=SeqID_46480
MEIEATLRRNKAERRRKLLQDRTVASILEEKAQSSDSTSFDSLSSRESTIYLPEAFFMADEHQQRVTLEDYSCSSVPQFFT

SEQ ID NO: 138166 - protein, 123 aa, Glycine max
  Coding DNA Sequence Number=SeqID_46481
  Subcellular localization annotation: CTP_CleavageSite=41; ConfidenceScore=5.32e-01
MAEPSQKRKGSSSTAAADAHRRHGPSEASTAPIHPSLSSPRSSTLFSSNDQHLRYLSQFSSRIILDPKYLDVEFFNDETFDCYQVFQNSGLVDFMSLKLPHYPELVKVFYCNLKIQDGIISSE

SEQ ID NO: 138167 - protein, 81 aa, Glycine max
  Coding DNA Sequence Number=SeqID_46482
MDSGRFQVSVPGNSYPSVAGDDTEGPPKGFVGVYHQLLALQWHIRGKARSHLDCGGEFHVSPPRFKRHVHDQFGVVGSQWV

SEQ ID NO: 138168 - protein, 231 aa, Glycine max
  Coding DNA Sequence Number=SeqID_46483
VQALKSELGKAKLAKEKFKLAATHIRKECAGLREENAIPARALEQETKRARKEEYGRNKFRGALWGSNSELKLRREERDQSRAHSMVLKEELVACSRSKRSLSQRLCETETNMLAIIAKYQEELGLAAAHEHRIADEYAQVYAEKEARGRVIDSLHQEATMWMDRFALTLNGSQELPRLLAKAKAMADTYSAPEEIHGLLGYWKNTITKRAARDPYRTRSKSRTMGDQEET

SEQ ID NO: 138169 - protein, 106 aa, Glycine max
  Coding DNA Sequence Number=SeqID_46484
MFVEVLAIKIAIPWVMGFSQAHAFTKRKKHDLRHPYRTRARVRVMGEVEEVQEQMKADTEALKKQMATMMGAMMSIKEIMEVNVAAIAVISTIVEVDLTSHMASTK

SEQ ID NO: 138170 - protein, 75 aa, Glycine max
  Coding DNA Sequence Number=SeqID_46485
  Homolog annotation: Hit_ID=A5AV98; Match level="QueryCoverage=92%, HitCoverage=9%, E-value=1e-12, Identity=52%"; Hit description =Putative uncharacterized protein
MTIADNIKITLPKADSAKKFMGLVGEYSHIADKSLARTLMSTLTTMKFDGSCTMQEHVIEMTNIATRLKTLFNLF

SEQ ID NO: 138171 - protein, 75 aa, Glycine max
  Coding DNA Sequence Number=SeqID_46486
MPPTVPVNHYSDPEGQHNRIRILWCYPMLITGGTTRPVKDRSASPAEGTSRPVHTGGGPIDPTQGPTTSFLTATT

SEQ ID NO: 138172 - protein, 38 aa, Glycine max
  Coding DNA Sequence Number=SeqID_46487
  Gene Ontology: Mol. function=structural constituent of ribosome; Cellular component=ribonucleoprotein complex; Biological process =translation
  Homolog annotation: Hit_ID=A4W6D9; Match level="QueryCoverage=100%, HitCoverage=43%, E-value=4e-12, Identity=94%"; Hit description=30S ribosomal protein S20
  Pfam annotation: Domain name=Ribosomal_S20p; Domain location=1-38; Score=-11.3; E_value=0.026; Accession=PF01649.9; Description =Ribosomal protein S20
MMRTFIKKVYAAIATGDKAAAQNAFNEMQPIVDRQAAK

SEQ ID NO: 138173 - protein, 417 aa, Glycine max
  Coding DNA Sequence Number=SeqID_46488
  Gene Ontology: Mol. function=isoleucine-tRNA ligase activity; Cellular component=cytoplasm; Biological process=tRNA aminoacylation for protein translation
  Homolog annotation: Hit_ID=Q83MH2; Match level="QueryCoverage=100%, HitCoverage=44%, E-value=0.0, Identity=85%"; Hit description =Isoleucyl-tRNA synthetase
  Pfam annotation: Domain name=Anticodon_1; Domain location=261-417; Score=192.5; E_value=1.1e-54; Accession=PF08264.4; Description =Anticodon-binding domain
  Pfam annotation: Domain name=tRNA-synt_1; Domain location=1-217; Score=-111.7; E_value=7e-14; Accession=PF00133.13; Description=tRNA synthetases class I (I, L, M and V)
  Pfam module annotation: Pfam domain module=Anticodon_1::tRNA-synt_1; Domain location=261-417::1-217
MDQKGLRAQSLKEIKGVQWIPDWGQARIEAMVANRPDWCISRQRTWGVPMALFVHKESEQLHPDTLELMEKVAQRVEQDGIQAWWDLDPRDLMGDDADHYVKVPDTLDVWFDSGSTSFSVVDARPEFDGHAPDMYLEGSDQHRGWFMSSLMISTAMKGKAPYRQVLTHGFTVDGQGRKMSKSIGNTVAPQDVMDKLGADILRLWVASTDYSGEMAVSDEILKRAADSYRRIRNTARFLLANLAGFNPATDCVSPEEMVVVDRWAVGRALAAQQDIVQSYENYDFHEVVQRLMHFCSIEMGSFYLDVIKDRQYTAKGDSLARRSCQTALWHIAEALVRWMAPIMSFTADEIWGYLPGERPQYVFTEEWYQGLFGLAQDEALNDAYWAELLKVRGEVNKVIEQARSDKRIGGALEATVT

SEQ ID NO: 138174 - protein, 41 aa, Glycine max
  Coding DNA Sequence Number=SeqID_46489
  Homolog annotation: Hit_ID=A6T4L5; Match level="QueryCoverage=100%, HitCoverage=6%, E-value=6e-16, Identity=97%"; Hit description=2,4 -dieonyl-CoA reductase, FMN-linked
MATLNGEVSQEQLEYYELRAKGGTGLITVENICIDFPFASN

SEQ ID NO: 138175 - protein, 156 aa, Glycine max
  Coding DNA Sequence Number=SeqID_46490
  Gene Ontology: Mol. function=transferase activity, transferring acyl groups, acyl groups converted into alkyl on transfer; Cellular component=chloroplast; Biological process=branched chain family amino acid biosynthetic process
  Homolog annotation: Hit_ID=P15875; Match level="QueryCoverage=98%, HitCoverage=29%, E-value=1e-73, Identity=90%"; Hit description=2 -isopropylmalate synthase
  Pfam annotation: Domain name=HMGL-like; Domain location=15-156; Score= 68.3; E_value=2.5e-17; Accession=PF00682.10; Description=HMGL-like
MTMSQQVIIFDTTLRDGEQALQASLSVKEKLQIALALERMGVDVMEVGFPVSSPGDFESVQTIARTIKNSRVCGLARCVEKDIDAAYESLRVADAFRIHTFIATSPMHIATKLRSTLPEVIERAVHMIKRARNYTDDVEFSCEDGGRTPIDDLCRM

SEQ ID NO: 138176 - protein, 251 aa, Glycine max
  Coding DNA Sequence Number=SeqID_46491
  Gene Ontology: Mol. function=acetolactate synthase activity; Cellular component=chloroplast; Biological process=branched chain family amino acid biosynthetic process
  Homolog annotation: Hit_ID=Q6D0H0; Match level="QueryCoverage=94%, HitCoverage=41%, E-value=1e-104, Identity=74%"; Hit description =Acetolactate synthase isozyme III large subunit
  Pfam annotation: Domain name=TPP_enzyme_M; Domain location=15-150; Score=241.2; E_value=2.4e-69; Accession=PF00205.13; Description =Thiamine pyrophosphate enzyme, centra
MRSYNPTLQGHKGQIKRALQTLLAAHKPVIYVGGGAITSGCEAELLQLAEQLNIPVTTSLMGLGAFPGTHRQCVGMLGMHGTYEANMTMHNADLIFGIGVRFDDRTTNNLAKYCPNATVMHIDVDPTSISKTVSADIPIVGDARQTLTQMLELLAQSEAKQELDSLRDWWQSIEGWRSRKCLEFDRNSDKIKPQAVIETICRLTHGEAYVTSDVGQHQMFAALYYQFDKPRRWINSGGSAPWALACRRHSA

SEQ ID NO: 138177 - protein, 794 aa, Glycine max
  Coding DNA Sequence Number=SeqID_46492
  Gene Ontology: Mol. function=penicillin binding; Cellular component =integral to membrane; Biological process=peptidoglycan-based cell wall biogenesis
  Homolog annotation: Hit_ID=Q2NVV7; Match level="QueryCoverage=74%, HitCoverage=99%, E-value=0.0, Identity=80%"; Hit description =Penicillin-binding protein 3
  Pfam annotation: Domain name=Mur_ligase; Domain location=574-655; Score=67.9; E_value=3.4e-17; Accession=PF01225.16; Description=Mur ligase family, catalytic domain
  Pfam annotation: Domain name=Mur_ligase_M; Domain location=665-794; Score=117.8; E_value=3.3e-32; Accession=PF08245.3; Description=Mur ligase middle domain
  Pfam annotation: Domain name=PBP_dimer; Domain location=66-222; Score= 219.4; E_value=8.6e-63; Accession=PF03717.6; Description=Penicillin -binding Protein dimerisation domain
  Pfam annotation: Domain name=Transpeptidase; Domain location=260-555; Score=383.8; E_value=2.8e-112; Accession=PF00905.13; Description =Penicillin binding protein transpeptidase domain
  Pfam module annotation: Pfam domain module=Mur_ligase::Mur_ligase _M::PBP_dimer::Transpeptidase; Domain location=574-655::665-794::66 -222::260-555
MSGAGKTLKSRKQEDKASFVSWRFALLCGCILLALGGLLSRVAWLQVISPDKLVKEGDLRSLRVQEVPTARGMISDRAGRPLAVSVPVNAIWADPKELTEHGGVTVDSRWKALSDALSIPLDQLAARVNANPKGRFIYLARQVNPAIGEYVKKLKLPGIYLRQESRRYYPAGQVTAHLIGFTNIDGQGIEGIEKSFDKWLTGEPGERTVRKDRYGRVIEDISSVDSRAAHNLTLSIDERLQALVYRELNNAVAFNKAESGTAVLVDVNTGEVLAMANSPAYNPNNLSNTPKDVMRNRAITDIFEPGSTVKPMVVMTALQRGVVKENSVLNTVPYRVNGHEIKDVARYNELTLTGVLQKSSNVGVSRLALAMPSSALVETYARFGLGKPTNLGLVGESSGLYPQKQRWSDIERATFSFGYGLMVTPLQLARVYATIGSYGINRPLSITKVDPPVAGERVFPEDLVKTVMHMMESVALPGGGGVKAAIKGYRIAIKTGTAKKVGPDGRYVNKYIAYTAGVAPASRPRFALVVVINDPQAGKYYGGAVSAPVFGAIMGDRNLRDLLAPWVPGAPARPLRDMTLDSRAAAAGDLFIAVAGHHADGRRFIPQAIAQGVAAVIAEAEGEASDGDIREMHGVPVIYLAQLPQRLSALAGRFYQQPAEKLKLIGVTGTNGKTTTTQLIAQWANLLGETGAVMGTVGNGLYGQLVPSENTTGSAVDVQHILHDLVGQGATVAAMEVSSHGLVQHRVAALPFAAAVFTNLSRDHLDYHGDMQGYESAKWLLFSEHQVGEAIINA

SEQ ID NO: 138178 - protein, 293 aa, Glycine max
  Coding DNA Sequence Number=SeqID_46493
MGGRTISWFPRWKEGKEGVLFSCGRYPNIPLHRRKKCMSPFLVRDFGAQNSKTIQRIHKAWETPLKKDQELRGIRNGIIGGYHEWLKVHIRGLDWLTKLKVVSEESFEAPEQDEEVQALKSELGKAKLAKEKFKLATTHIRKECAGLREENATTARALEQETKRARKEEYGWNKFRGALWGSNSELKLRREERDQSRAHSMVLKEELVACSRSKRSLSQHLCETETNMLAIIAKYQEELGLATIHEHRIADEYAQVYAEKEARGRVIDSLHQEATMWMDRFALTLNGSQELPR

SEQ ID NO: 138179 - protein, 125 aa, Glycine max
  Coding DNA Sequence Number=SeqID_46494
  Homolog annotation: Hit_ID=Q2HW90; Match level="QueryCoverage=72%, HitCoverage=18%, E-value=2e-11, Identity=38%"; Hit description =Putative uncharacterized protein
MGTNQNGKRFYQVKVKSLDVTSLKELGRLMGPFQRQAFRKVYGKILDLTATEVITEVVVSLAQYYDQPLRCFTFGDFQMVPTIEEFEEILGCPLEGRKPYLFSGFLPSLSKMQLWLEIQQKSWIA

SEQ ID NO: 138180 - protein, 253 aa, Glycine max
  Coding DNA Sequence Number=SeqID_46495
  Homolog annotation: Hit_ID=A4PP05; Match level="QueryCoverage=46%, HitCoverage=31%, E-value=2e-10, Identity=33%"; Hit description=IMP dehydrogenase/GMP reductase, putative
ALRDVSITERYAWGMAALVHMYDQLSDASMSHSRQLWQLHHTGAGNKYCWIYEHFPSVAESTADQDYDKASPRACRWIATKKTVKSIRTPSYRERLDRLRISDVCWIPYGEHREFGYTQTIPAPPVDSWVSYDDIHDMWMYYEDHIVPAGHALDPLPHGHAPQSRVVPQAPQTDIPRVPEPGASSTSAEEPKHAVEVCDDIAERLERHLSLGVVTPGSSTHEVVEECLRLARSVIQDHLVYVRCRRRRRTDQA

SEQ ID NO: 138181 - protein, 23 aa, Glycine max
  Coding DNA Sequence Number=SeqID_46496
DSVEFFIVLRRSSPFFIRSSFFN

SEQ ID NO: 138182 - protein, 96 aa, Glycine max
  Coding DNA Sequence Number=SeqID_46497
MVILRLVSTKRNEFDNIRMMLVVVSYLYFPFISNKRQVKRGNRHTLISSGDHLFVGMRPSFNHFEEVPPEGGAFWRKQPSSPGRAGWQAPPSFTYK

SEQ ID NO: 138183 - protein, 172 aa, Glycine max
  Coding DNA Sequence Number=SeqID_46498
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPFSPTAAPYPVTIVLSPN

SEQ ID NO: 138184 - protein, 101 aa, Glycine max
  Coding DNA Sequence Number=SeqID_46499
MEGSHQSTHYPKEKLPKIITHKWKFGNLLEAPNTLPVKDLFVTKLESNEVLLSPIALKVVGPFLLNSNSSRDGTNPPSNSLYGNQQGNKETSNNQRPKKMK

SEQ ID NO: 138185 - protein, 132 aa, Glycine max
  Coding DNA Sequence Number=SeqID_46500
  Subcellular localization annotation: CTP_CleavageSite=34; ConfidenceScore=5.31e-01
MCPAPSSLGAMRSDCLVQFRGSILNLFRSPMNCVFIHVSSTFEFGAMRSDCLVQFSILNLFQSPMNCVFVHVSSTFEFGAIRSDCLVQFSILTLFQSPMNCVFVHVSSTFEFGAMRSDCLVQFSILNLFGAP

SEQ ID NO: 138186 - protein, 146 aa, Glycine max
  Coding DNA Sequence Number=SeqID_46501
  Homolog annotation: Hit_ID=A0ST23; Match level="QueryCoverage=30%, HitCoverage=91%, E-value=1e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPVTTLKAIQDVKFKGIYYWMIVRSSYCSPYIMGTELEFVIMVIAVSFGKPVVPAALMNRPTRGERRFAYWALFRFLAH

SEQ ID NO: 138187 - protein, 52 aa, Glycine max
  Coding DNA Sequence Number=SeqID_46502
DFTLYALGSYNAQWNAQGLLMISTRCVRIQKKESEKFKVVFVIGSAVDRLCG

SEQ ID NO: 138188 - protein, 94 aa, Glycine max
  Coding DNA Sequence Number=SeqID_46503
MTRGNPSDLQPFDPKIDRTFYRLVRHHLIPFEHPEYSVIGDFEHYCFEHSDFEHSENMAQSPSRERTLREMVAPDFTYESLCIQYPDEDVPYVL

SEQ ID NO: 138189 - protein, 158 aa, Glycine max
  Coding DNA Sequence Number=SeqID_46504
  Gene Ontology: Mol. function=motor activity; Cellular component=cell projection
  Homolog annotation: Hit_ID=UPI00016621D1; Match level="QueryCoverage =82%, HitCoverage=40%, E-value=4e-14, Identity=36%"; Hit description =UPI00016621D1 related cluster
MTDPLNDSIFCFLIGVDPSVLEPIAFRGLHILAFRGLHTLTFKGLHVLSFKGLHVLAFRGLHVLTFRGLHALAFRGLHVLTFRGLHVLTFKGLHVLTFRGLHILTFRGLHALTIRGLHVLAFRGLDVLPFKGLHILPFRGLHVLSFRGLHALPFRGLH

SEQ ID NO: 138190 - protein, 147 aa, Glycine max
  Coding DNA Sequence Number=SeqID_46505
MGTNQNGKRFYQVKVKGPDVTSLKELGRLMGPLQRQALPQSVRKDSRFDRSGEFEEILGCPLGGRKPYLFSEFLPSLSKIAAVVEDSAKELDHMKQTRNGVVGLPRKYLEGKARDMANQEKWGPFADILALLIFGLSSFRTWTVWWT

SEQ ID NO: 138191 - protein, 172 aa, Glycine max
  Coding DNA Sequence Number=SeqID_46506
MASIMEAMLKLQKTLEDNATATASNAVREAEPVLQPAINLGRDRNTTVFGRRYSPQAYPYGLPPDFTPRSAPEDVSQAPTFEGQIPPYANYLLQEDGEGDAHLGPLLPLKDPAPHELPQPNIVRHVPSSPAPVKESVPFAEDKGKIDSLEERLRAVEGLGNYPFSDLADLCL

SEQ ID NO: 138192 - protein, 275 aa, Glycine max
  Coding DNA Sequence Number=SeqID_46507
  Gene Ontology: Mol. function=structural constituent of ribosome; Cellular component=ribonucleoprotein complex; Biological process =translation
  Homolog annotation: Hit_ID=P02358; Match level="QueryCoverage=36%, HitCoverage=74%, E-value=6e-45, Identity=91%"; Hit description=30S ribosomal protein S6 [Contains: 30S ribosomal protein S6, fully modified isoform; 30S ...
  Homolog annotation: Hit description=ribosomal protein S6, non -modified isoform]
  Pfam annotation: Domain name=Ribosomal_L9_C; Domain location=194-269; Score=44.9; E_value=2.9e-10; Accession=PF03948.5; Description =Ribosomal protein L9, C-terminal domain
  Pfam annotation: Domain name=Ribosomal_L9_N; Domain location=150-180; Score=28.7; E_value=2.1e-05; Accession=PF01281.10; Description =Ribosomal protein L9, N-terminal domain
  Pfam annotation: Domain name=Ribosomal_S6; Domain location=1-75; Score=118.0; E_value=2.7e-32; Accession=PF01250.8; Description =Ribosomal protein S6
  Pfam module annotation: Pfam domain module=Ribosomal_L9_C::Ribosomal _L9_N::Ribosomal_S6; Domain location=194-269::150-180::1-75
VPGMIERYTAAITGAEGKIHRLEDWGRRQLAYPINKLHKAHYVLMNVEAPQEVIDELETTFRFNDAVIRSMVMRTKHAVTEASPMVKAKDERRERRDDFANETADDAEAGDSEEAPLRKVSPSGIPHCQFVLEHRSVQEEAGFHRQAWCQMPVKAGYARNFLVPQGKAVPATKKNVEFFEARRAELEAKLADVLAAANARAEKINALGTVTLASKAGDEGKLFGSIGTRDIADAVTAAGVKWRRAKFACQTAFCAPPVSTKLTSRFTAKYSRKWL

SEQ ID NO: 138193 - protein, 29 aa, Glycine max
  Coding DNA Sequence Number=SeqID_46508
PPCLYSNVRFWAATACAGGDLSFFLKICS

SEQ ID NO: 138194 - protein, 276 aa, Glycine max
  Coding DNA Sequence Number=SeqID_46509
  Gene Ontology: Mol. function=sodium:dicarboxylate symporter activity; Cellular component=integral to membrane; Biological process =dicarboxylic acid transport
  Homolog annotation: Hit_ID=A4WF09; Match level="QueryCoverage=69%, HitCoverage=67%, E-value=6e-79, Identity=73%"; Hit description =Na+/Ca+ antiporter, CaCA family precursor
  Pfam annotation: Domain name=Na_Ca_ex; Domain location=1-136; Score =93.7; E_value=5.6e-25; Accession=PF01699.15; Description =Sodiumcalcium exchanger protein
  Pfam annotation: Domain name=Na_Ca_ex; Domain location=138-251; Score= 62.0; E_value=2.1e-15; Accession=PF01699.15; Description =Sodiumcalcium exchanger protein
  Pfam module annotation: Pfam domain module=Na_Ca_ex::Na_Ca_ex; Domain location=1-136::138-251
ADRLVFAASILCRLTGVPPLVIGMTVVSVGTSLPEIIVSVSASLHGQLDLAVGTAIGSNIVNILLILGLAALLHPFRVHSDVLRRELPLMLIPRLLAGCVFYDGILSGHDSLTREQVAELPREGTLPVALLWLGVALIIMPMATRMVVDNATVVANYFAISELTIGLTVIAIGTSLPELATAIAGARKGEDDIAIGNIIGSNIFNIAIRDICSALLAAATTDWQRRRRAVDGWIYRMDGDAVLALASSLWKAGKDVLEIEREGLAQLDQYINQGIL

SEQ ID NO: 138195 - protein, 138 aa, Glycine max
  Coding DNA Sequence Number=SeqID_46510
  Homolog annotation: Hit_ID=UPI0000ECBAF8; Match level="QueryCoverage =29%, HitCoverage=48%, E-value=2e-15, Identity=97%"; Hit description =UPI0000ECBAF8 related cluster
SEQESARGSFQGETPGIFIVLSGFATSDLSVDFCDARQGGGAYGKTPATRPFYADTARRSRTTERSESVSEEAEERPIRKPPLPARMQAWHWPSFYNVVTGKTLALPNLIALQLIPLSPAGVIAKRPAPIALPNSCAA

SEQ ID NO: 138196 - protein, 130 aa, Glycine max
  Coding DNA Sequence Number=SeqID_46511
MSEIEEVQEQMKEVNAATVVLQNKHSFPPYGLPPNYTPPNVAHTPDENVDNSEPMPIESQQPQSDHAHVSQPMGETHEAPRDHNLVDFELHVGYAAEGQAFCSVPLPNTLGAPQYLPQPQALQSPCFYLS

SEQ ID NO: 138197 - protein, 118 aa, Glycine max
  Coding DNA Sequence Number=SeqID_46512
MGCPFPPASSCRRGIGIVPARQGLGVASSKYGSLSVLGSACHPQQGHQAPLPIELSSRNIAPPGRRSVNTTSALGWPVAGNRHTATTSRVHAKLIHKKVRALPTTHGRAIGDQLQSQR

SEQ ID NO: 138198 - protein, 16 aa, Glycine max
  Coding DNA Sequence Number=SeqID_46513
MGTYNALQTYDYYAST

SEQ ID NO: 138199 - protein, 40 aa, Glycine max
  Coding DNA Sequence Number=SeqID_46514
MEEARGGALTAQQYWFCRSNKPSSNRFQDVVIDYRLPVLV

SEQ ID NO: 138200 - protein, 135 aa, Glycine max
  Coding DNA Sequence Number=SeqID_46515
  Homolog annotation: Hit_ID=UPI00006A2D9E; Match level="QueryCoverage =88%, HitCoverage=75%, E-value=4e-11, Identity=17%"; Hit description =UPI00006A2D9E related cluster
MDTSEPYNGAMKGTSTLTFRGLHALTFRGLHVLAIRGLHVLAFRGLHILTFRGLHTLSFKGLHVLVFRGLHTLAFRGLHILAFRGLHALAFRGLHVLPFIGLHALTFRGLHVLTFIGLQNLTFIGLHAVTFRGLH

SEQ ID NO: 138201 - protein, 119 aa, Glycine max
  Coding DNA Sequence Number=SeqID_46516
  Gene Ontology: Mol. function=protein transporter activity; Cellular component=membrane; Biological process=protein secretion
  Homolog annotation: Hit_ID=Q64R40; Match level="QueryCoverage=94%, HitCoverage=31%, E-value=2e-30, Identity=58%"; Hit description =Putative multidrug resistance protein
RTIEEGQLVQNGTPLVNIVRDEQKWITANYTESQLKSISLGTKVKIEIDALAGKTFEGEVAAISEATGSKYSAVPVDNSTGNFVKVQQRIPVRINFTASNTPKDLAMLRVGMNAIIRVQ

SEQ ID NO: 138202 - protein, 90 aa, Glycine max
  Coding DNA Sequence Number=SeqID_46517
  Subcellular localization annotation: CTP_CleavageSite=42; ConfidenceScore=5.36e-01
MQNYQHAKRCDSAKARTNRKRVMQQKRHDHAQSSSQPTVNCTSEYNSSVSNFMTPFEDCQSPTNQPVINTEGNDYNSDFQFQMLLYMFLS

SEQ ID NO: 138203 - protein, 131 aa, Glycine max
  Coding DNA Sequence Number=SeqID_46518
MTLTYKNRRITRPFRLARFGDDADAGSRQARQGASAGVGGCRGWLNYAASEQIVLRVHHMRCEIPHRCVREKIPHQAPFAIQLRNCWEGRSVRASSLLRQLAKGGCAARRLSWVTPGFSQSRRCKTTASEL

SEQ ID NO: 138204 - protein, 139 aa, Glycine max
  Coding DNA Sequence Number=SeqID_46519
DKVSASSSSRALIEEVAQPFFIYAKRNYFLFYSTGNGASRSIPKAGNAESRIRQYKKRQRKTSQKPVLRQTQLGSKLGFAIPSRASISSLKGDSGKDRIGRRVSRTNKIRVERGKLAKLDKIGMGIGTCIDVPDRLMLP

SEQ ID NO: 138205 - protein, 218 aa, Glycine max
  Coding DNA Sequence Number=SeqID_46520
MSWRGHNTSQCPTTKTMIMRSQDIYSNQDEATMSPSSSESEEAKGEESSEEIYHHEEGQPLMVKEECKEVSVSSKRLVKKESHFEIKTNIKETSPLRQPPHLLRCKKTLVSTATPLGLEVIPQVKELLDEGIIRHQIPTISDMMNLLSVATLFCKISHAPNVFMIHVHRDSLGRNNQHKNIEKGVEGRRPKYEEPRDLRSNPFQGGGDDAILPPRVLG

SEQ ID NO: 138206 - protein, 75 aa, Glycine max
  Coding DNA Sequence Number=SeqID_46521
MWVQAIGLFAQATCAPEFGLKRSFSQKILVLHICRFFHSSLLQGCENKTTIDTSKPYTGAMKGTMHKPQANLAAD

SEQ ID NO: 138207 - protein, 136 aa, Glycine max
  Coding DNA Sequence Number=SeqID_46522
MVVIIKKGENDGIISSEVHGVSMIIDQSLFFSLTKLPSQGAPFEGTIVDDWKFDYSSHDARCMVCDDQAEMTGRLLTGSLTFDCPVMHYIIVRILLPCSSNLAQASDEDLILMWAFLTGRQIDWAHLVGYRMHKAL

SEQ ID NO: 138208 - protein, 350 aa, Glycine max
  Coding DNA Sequence Number=SeqID_46523
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=56%, HitCoverage=28%, E-value=3e-47, Identity=44%"; Hit description=DNA polymerase
MEPAIAKGLYNNVKGYNLKSFDERIIPEPILDEFLKIGLISPEDVTNAAGYAKANIIFYFKNREVGDIAKPLNKQSIPLTFDDGSPISKSEIYASVFSSIFKLIDIYDGFGVVRIAIRAHFEENIPGPLQPLKEELLEEALSECIKPSSGEIDISNLPVKSLSSTSRKYPKNITVPRKSGNISLRPFLVADTETIINKNSQHVPYAVGVMVVNPGIPVSRRERIDTYFSEDYSSRVFPTFEERSCQMLKSFIFRVAAITRQNRSAKTIYFHNLGRFDGIFLLKHLALYHPNYTVTPLMRDNRLYEVAVYSKKRLLFTFRDSLHLLPGKLDDLAKNLCPELGSKGSISYED

SEQ ID NO: 138209 - protein, 332 aa, Glycine max
  Coding DNA Sequence Number=SeqID_46524
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q39432; Match level="QueryCoverage=84%, HitCoverage=36%, E-value=3e-97, Identity=58%"; Hit description=DNA polymerase
  Pfam annotation: Domain name=DNA_pol_B_2; Domain location=57-332; Score=-38.6; E_value=8.9e-06; Accession=PF03175.4; Description=DNA polymerase type B, organellar and viral
  Subcellular localization annotation: CTP_CleavageSite=52; ConfidenceScore=5.00e-01
MRSVSWLLIRGFPLVGVKGSILTSAKITLQESSQPLKKGAAKCSKSFIFRVAAITRQNRSAKTIYFHNLGRFDGIFLLKHLALYHPNYTVTPLMRDNRLYEVAVYSKKRLLFTFRDSLHLLPGKLDDLAKNLCPELGSKGSISYEDVRLESLSIMKESLLEYMEQDILLLGGIMQSFQDIYYKAYQADIVNKLTIASLALSLFREKYYDYNKHRIHIPNQNEDTFIRRGYYGGHTDAYLPYGTNLYYYDVNSLYPFVMKEFSMPGGTPVWHSDLEYMTLDNMLGFIEAYVECPKSINKPFLPYGDNKDGTLIFPTGTFVGVTIVRSSSMLET

SEQ ID NO: 138210 - protein, 123 aa, Glycine max
  Coding DNA Sequence Number=SeqID_46525
MAERRKKLLQDRTVAFILEEETHFSNLLSPDSPSSRESATQLPEVITMAEEHDQRITLEDYSSSSVPQIFTRIARPEVQANNINYPHSLIHLIQGNLFQGLPNEDLYAHLATFIEICNIVKIA

SEQ ID NO: 138211 - protein, 130 aa, Glycine max
  Coding DNA Sequence Number=SeqID_46526
MCLPHGLRDICMISLGLSVLNEYESGVIDILTRSVRHIGWCIVGRQAIWQEGMLVLNLRIMGAAHGGIGFTLAIVLVAAIATALASIIFFMLIMASIIVAICSFMASMSAFIYSCTSSTSPITLALARVR

SEQ ID NO: 138212 - protein, 42 aa, Glycine max
  Coding DNA Sequence Number=SeqID_46527
MEKEKDEWRCHFKWKMSLEEAHHPMIQTTNPRSSPSFSTKWA

SEQ ID NO: 138213 - protein, 69 aa, Glycine max
  Coding DNA Sequence Number=SeqID_46528
MGVDVSSVGACRPRIFFINGFLCFLEDEWQWNGERKRESPLIQDQFQDSPLSVLRCHETCKSMKDMRKV

SEQ ID NO: 138214 - protein, 59 aa, Glycine max
  Coding DNA Sequence Number=SeqID_46529
  Subcellular localization annotation: CTP_CleavageSite=17; ConfidenceScore=5.05e-01
FSSFPPSWKTFALKCPRSSPGSSTTSFLFLLACLVIKLWGGDQLDILCLLKVAVHEESP

SEQ ID NO: 138215 - protein, 75 aa, Glycine max
  Coding DNA Sequence Number=SeqID_46530
MMGDASKFNHISPKKSGHVTYGDNNKGRILKIGKIGVIMEENLCRNLPIGGRATRDSRDACSTKGIRAESPPTFI

SEQ ID NO: 138216 - protein, 216 aa, Glycine max
  Coding DNA Sequence Number=SeqID_46531
  Homolog annotation: Hit_ID=Q2HW90; Match level="QueryCoverage=81%, HitCoverage=35%, E-value=4e-20, Identity=32%"; Hit description =Putative uncharacterized protein
MEPIASLAQYYDQPLRCFIFGDFQLSPMGEEFEEILGCPLGGRKPYLFSGFYPSLARISKKVQISAQELDRQRQVENGVVGIPRKYLEVKARILADKGEWTPFIDILTLLIFEGVLFPNVDGLVDLAAIDVFLAYHNHKESPVVAMLADLYDTFDRRCEESNARIVCCTPALYVGLVSHLFLQEGRPVYPLQGYRSCVEKGKANWDQLLASMGGVC

SEQ ID NO: 138217 - protein, 176 aa, Glycine max
  Coding DNA Sequence Number=SeqID_46532
  Homolog annotation: Hit_ID=Q2HTA0; Match level="QueryCoverage=91%, HitCoverage=23%, E-value=3e-14, Identity=35%"; Hit description=IMP dehydrogenase/GMP reductase, related
  Pfam annotation: Domain name=DUF1723; Domain location=17-66; Score =48.7; E_value=2e-11; Accession=PF08330.1; Description=Protein of unknown function (DUF1723)
MVARTGLSPLIACSVDTGDRGLICSFVERWHRETSTFHLPVGEVSIMLDDVASLLHLPIFGDFHTFQPLHIDEAVLMLVELLMISPEVAMDEIGHCTGPYVRLSGLRDIYQHRCQTQHWTAAAHALCDLTQTRRYAWGAAGLVHMYDQLNDVSISTNRQVAVLDISALSISCGVQC

SEQ ID NO: 138218 - protein, 149 aa, Glycine max
  Coding DNA Sequence Number=SeqID_46533
MTQELVARGDTLQLSAPRHSVTPSVIDEQRRMWSSAPFPEMSAFSDGDFSSLTSYPELRRSKSLAFVGRPIIFVILTLRSRDMHPCIIQRRRGPMIRGRYLTVIRTLVSSRGGGPDDTRRYLTVIRTLLSSRGGGPDDKQSPSLVILHP

SEQ ID NO: 138219 - protein, 125 aa, Glycine max
  Coding DNA Sequence Number=SeqID_46534
  Homolog annotation: Hit_ID=Q2HW90; Match level="QueryCoverage=60%, HitCoverage=14%, E-value=1e-10, Identity=45%"; Hit description =Putative uncharacterized protein
MANQEEWVPFMDVLALLIFGVVLFPNMDGLVDLAAIDAFLAYHHSKESPVVAILADLFDTFDRRCEKSSARIICCLPALFVWLVSHLFQQDIRHPCPLRSHRSCVEKRRVDCDQDLAGIGGRTIN

SEQ ID NO: 138220 - protein, 171 aa, Glycine max
  Coding DNA Sequence Number=SeqID_46535
MADALATLVSMFQLTPHGDLVPYIEFWCRGKPLTLLPSGRGSGTVSLGISISSDMNHHDSPAMRGCQRGEPMIRKLTVFENAYCQWADAPEDPEAGNASVKRLADIWSQPLNDYQPMHPESWMRSCALTFGGKARQGHRDKWTVWLGFDCTNNMVEYKACALTLTPMSSYS

SEQ ID NO: 138221 - protein, 114 aa, Glycine max
  Coding DNA Sequence Number=SeqID_46536
MEMNQQSPSSDNSQGWFHGLSVTMHHQKRKTLDEASLLSSESETQHEHRSTSTPYCGSNVFQGYFDDAKESRVKQSFKQRFKNQVSRIKNQESRIIKIKIQDSRFKNQEKTHSR

SEQ ID NO: 138222 - protein, 56 aa, Glycine max
  Coding DNA Sequence Number=SeqID_46537
GEIRVMVVRMIRTRLPVSVWAKSCPGMHSSCTIASFSGCARTVGPPSRLRGWPRNR

SEQ ID NO: 138223 - protein, 75 aa, Glycine max
  Coding DNA Sequence Number=SeqID_46538
MMAHQYISCGSILVEAQRSIKNNSRVQDKNQEEFKTQEESLETRIKIQGSRSQESRSRFKTQDSRMKRRLNQDKY

SEQ ID NO: 138224 - protein, 146 aa, Glycine max
  Coding DNA Sequence Number=SeqID_46539
  Homolog annotation: Hit_ID=A5AV98; Match level="QueryCoverage=76%, HitCoverage=17%, E-value=6e-23, Identity=42%"; Hit description =Putative uncharacterized protein
MTVADSIKTSLPKTDNAKEFMRLVGESSQTDDKSLVGTLMSILTTIKFDGLRTMHEHVIEVTNIVSRLKTLGMTVNENFLVQFMFNSLSSNMLVQEETGLKNQGSHSVYYVSHQGNQGAEKKFMKKHDKGKGSLKINDDSLQIQKK

SEQ ID NO: 138225 - protein, 58 aa, Glycine max
  Coding DNA Sequence Number=SeqID_46540
MMLHNLNRKAPASWIIVKEFNLNAIEFYLGAYLNGALKGLDDAPQPKSKAPARVDCRQ

SEQ ID NO: 138226 - protein, 111 aa, Glycine max
  Coding DNA Sequence Number=SeqID_46541
MSPHSWGGLCVNENAIHGGSEKGLENGDLHKAITTHGCKLVGGGCVNANAIHGAPKKGVRELRIALTNHYAWLHTRLENGELHKAITTHGSKLVGGGCMNENAIHGAPETG

SEQ ID NO: 138227 - protein, 91 aa, Glycine max
  Coding DNA Sequence Number=SeqID_46542
MGILRNQDIIFFSSINSKRKGEKGMSEWIVIIKKGEIVEVMSSKVILMMPKNQESSKIQRFKNQVSGIKIQDSRIIKIKIQDSIFKNQEKT

SEQ ID NO: 138228 - protein, 65 aa, Glycine max
  Coding DNA Sequence Number=SeqID_46543
MMNVLSGATLFCKITRTPNIFMVCVHRDPLGVEGKSPEYEEPRDLRSNPFQGGGNDAILLRKGIG

SEQ ID NO: 138229 - protein, 151 aa, Glycine max
  Coding DNA Sequence Number=SeqID_46544
MVACHQAKVPENQCMTLISSSRLARVAGDRDLSFLGFHKLPNDGCQAPHKDQRMLSIKQRSPKISQKVQKTVPCPCMLSSVLSYNSKRRVRITIRYLRVSCVQNDQTWSLLVIGHNVSKCKGVRITVRYLRVSCVQNDQTWSLRAIGHNCV

SEQ ID NO: 138230 - protein, 239 aa, Glycine max
  Coding DNA Sequence Number=SeqID_46545
  Gene Ontology: Biological process=transposition, DNA-mediated
  Homolog annotation: Hit_ID=Q1J7G7; Match level="QueryCoverage=17%, HitCoverage=71%, E-value=7e-12, Identity=74%"; Hit description =Transposase
WNSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPEVTNWVVLRPEGHAPVGHFAIGGGARYQLLFPLVRVNFELGVIMVIAVSFGKPVVPAALMNRPTRGERRFAYWALAECILAYYVGTDEGVSEVLHVAEKKGCTGASAEYVIQDIFRFLAH

SEQ ID NO: 138231 - protein, 168 aa, Glycine max
  Coding DNA Sequence Number=SeqID_46546
  Homolog annotation: Hit_ID=A4WCV9; Match level="QueryCoverage=100%, HitCoverage=100%, E-value=1e-88, Identity=85%"; Hit description =Putative uncharacterized protein
  Pfam annotation: Domain name=DUF462; Domain location=3-165; Score =425.1; E_value=1e-124; Accession=PF04315.3; Description=Protein of unknown function, DUF462
MNRTHHYEQLIEIFDGCFADDFNTRLIKGDDEPIYLPADAEVPYNRIVFAHGFYASARRELVDFGYWYCPDGRDAATQGQFEDVEVKPQALEWLFCVAAGFPFNVSCDNLEGDFEPDRILFQRRVHAQVMEYLEKGIPERPARLIKALQNYYHTPEITAECFPWPEDL

SEQ ID NO: 138232 - protein, 129 aa, Glycine max
  Coding DNA Sequence Number=SeqID_46547
MSLVAIFSMRYIASSGVFNLIFPPVEASNSCLDYGLNLSIKILSCISSENPLVGVFLVEAKLHDKSKNNSRVQDKNQEEFKTQEESLESRIKIQGSRSQESRSRFKTQDSRIKRRLNHDKYEKFFSKIE

SEQ ID NO: 138233 - protein, 34 aa, Glycine max
  Coding DNA Sequence Number=SeqID_46548
MEKPRHHAYLNSSGSAIQETQSYHYSRLVRTICT

SEQ ID NO: 138234 - protein, 399 aa, Glycine max
  Coding DNA Sequence Number=SeqID_46549
  Homolog annotation: Hit_ID=Q6WAY4; Match level="QueryCoverage=80%, HitCoverage=62%, E-value=1e-33, Identity=28%"; Hit description =Putative uncharacterized protein
MGTNQNGKRLYQVKVKSLDVTSLKELGRLMGPLQRQAFRKVYGKILDLTAAEVFTKAVVSLAQYYDQPLRCFTFGDFQMVPTIEEFEEILGCPLGGRKPYLFSGFLPSLSKIAAVVGDSARELDRMKQTRNGVVGLPQKNLEGKVRDRASQEKWGPFADILALLIFGVVLFPNVDGLVDLAAIDAFQWWLSWHICLIHLTGDVRKTVHGLSVVYPLSVCGRVDWDQHLARIGGNAINWFPRWKEGKEGVLFSCGDYPNVPLIGTRGCINYNPALAIRQLGYPMRGAPIAESLSPFLVRDLGAQSLKVIQRVHKVWRSPLKKDKELRGIRNGVIGGYHGWLRVHTRGLDWLSKLKVINEENFEAPEEDEEVQALKLELGKARLAKEKFKSAATHIRKERT

SEQ ID NO: 138235 - protein, 251 aa, Glycine max
  Coding DNA Sequence Number=SeqID_46550
  Homolog annotation: Hit_ID=Q2HW90; Match level="QueryCoverage=78%, HitCoverage=40%, E-value=2e-14, Identity=30%"; Hit description =Putative uncharacterized protein
MKQKHILALLIFGVVLFPNVDGLVDLAAIDAFLAYHHSKESPIVAILADLFDTFDRRCEKNSTRIVCCLPALCVWLISHLFQQDTRHPCPIQSYRSCAEKGRVDWDQHLTGIGGSTINWFPRWKEGKEGVLFSCGDYPNVPQLGYPMRGAPTEESLSPFLVRDLGAQGLKVIQRIHKAWRSPLRKDKELRGIRNGVIGGYHGWLRIHTRGLDWLSKLKVIDEENFEAPEEDEEVRALKLELGKARLAKEKF

SEQ ID NO: 138236 - protein, 329 aa, Glycine max
  Coding DNA Sequence Number=SeqID_46551
  Homolog annotation: Hit_ID=Q6WAY6; Match level="QueryCoverage=60%, HitCoverage=32%, E-value=2e-23, Identity=36%"; Hit description =Putative uncharacterized protein
VVQKVHKAWRSPLRKDKELRGIRNGIIGGYHEWLRVHTRGLDWLSKLKVINEENFEAPEEDEEVQALKLELGKARLAKEKFKSAATNIRKECTELREENAATARALEQETKRARNEEHGRDKYRGALWGSNNELKLRREERDQSREWVPFADVLALLIFGVVLFPNVDGLVDLAAIDAFLAYHHSKESPVVAILADLFDTFDRRCEKNSAWIVCCLPALCVWLVSHLFQQDIRHPCPLQSYRSCVKKRRVDWDQYLAGIRGRTINWFPRWKEGREGVLFSCGDYPNISLIGTRGCINYNPALSIRQLGYPMRGAPTEESLSPFLVRDSA

SEQ ID NO: 138237 - protein, 214 aa, Glycine max
  Coding DNA Sequence Number=SeqID_46552
VDCDKEDREEHSHAIIQGAPGPTPNSGCLLDPVWGASGGPGLPRQIMLLRSLALRACCCLLPTGEGRAAVWWMHYEDHIVPTGEVCVVPGACSSDYIDWFFRISHPFMTPGHAVDPLPHGHAPQPRVVPQAPQTDIPRVPEPRASSTSAEEPRHVLEVCDDIAERLERHLSLGVVTPGSSTHEVIEECLRLVRSVTQDHLVYVRCRRRRRTDQA

SEQ ID NO: 138238 - protein, 126 aa, Glycine max
  Coding DNA Sequence Number=SeqID_46553
MTQELVARGDTLRLSAPRHSVTPSVIDEQRPMWSFAPFPEMSASSGGDFFKSHKLSRTIGGGPNDTRRYLTVICTLLSSRGGGPDDKQRPMWSFCTLVSSRGGGPDDKQRPMWSSTPLCHPEAAAR

SEQ ID NO: 138239 - protein, 189 aa, Glycine max
  Coding DNA Sequence Number=SeqID_46554
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=27%, HitCoverage=50%, E-value=8e-24, Identity=100%"; Hit description=LacZ protein
MKHFTDTLISANIGTKAGTGPPLEVDGIDKLDLRQARRRQRPGSQAQDYRQPVRRDLRRRVAETRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138240 - protein, 107 aa, Glycine max
  Coding DNA Sequence Number=SeqID_46555
  Homolog annotation: Hit_ID=A0ST23; Match level="QueryCoverage=25%, HitCoverage=55%, E-value=2e-08, Identity=100%"; Hit description =Putative reverse transcriptase
ANWSSTAVAAALELVDPPGCRNSIETVCILVQSSIIGAYRIKLIDTVDLEGGPVGKPVVPAALMNRPTRGERRFAYWALAECILAYYVGTDEGVSEVLHVAGEKRLH

SEQ ID NO: 138241 - protein, 56 aa, Glycine max
  Coding DNA Sequence Number=SeqID_46556
CISSTRQILALVTRRDDYTNARLLNHNNEVLYRRIERLEHQMNPNAGDLMVATEGQ

SEQ ID NO: 138242 - protein, 54 aa, Glycine max
  Coding DNA Sequence Number=SeqID_46557
  Subcellular localization annotation: CTP_CleavageSite=36; ConfidenceScore=5.16e-01
MPHLLAKKVRKASIAARSTNPSTFGKKTPPKINNARMSMNEAHSPLPAKDFCHG

SEQ ID NO: 138243 - protein, 105 aa, Glycine max
  Coding DNA Sequence Number=SeqID_46558
MIESFQQQQQMSVLELYVEKDVAGSSMFHAANSVTSCGRNVSHHESELPSPISNLHDDEDDDDYLASNSYIEESFDEDDSDDGISDTDDEVTDIVEPVSIVHPTE

SEQ ID NO: 138244 - protein, 141 aa, Glycine max
  Coding DNA Sequence Number=SeqID_46559
MWLRLDDSSTSRCRQHAWSLVAEAKVMNVCFISGNHTTWKPAPRWKSYFNGSWTGGSSKDVTGSRSKYPPTAPKPTPFSYQSNKAVPWKYTPPAFGERAATEVDSLSAKVTNITGLSGVTRGGQVFAPPHSVELPSKGKHP

SEQ ID NO: 138245 - protein, 80 aa, Glycine max
  Coding DNA Sequence Number=SeqID_46560
GLVDKPSGGRHVLQRFGPTRPTRLDGINRSPSMIGKRVALGLYHFGKGDWWILPGDITVIWLATRDAKRSSYVIGIRVNS

SEQ ID NO: 138246 - protein, 89 aa, Glycine max
  Coding DNA Sequence Number=SeqID_46561
MRGVATNVYLWKTSKKPKEPVMKNIPDSGVVFKFEEGRQKWGSCSYVPSIEEEIRPTQFFLKGESSDSFFLEDGPFKALDLKMIHFYLV

SEQ ID NO: 138247 - protein, 69 aa, Glycine max
  Coding DNA Sequence Number=SeqID_46562
MARACSPLKVRTCSPLMARACSPLKVRTCSPMKIDCPFERGDNSCDLILSFANLSGNSLKVYVLFDLVT

SEQ ID NO: 138248 - protein, 153 aa, Glycine max
  Coding DNA Sequence Number=SeqID_46563
MAPKKLSLKRSRKDAAAAETSAAPEFDSHRFRSAKHQDNKYTDFQEEIARRCWTSLVTPMAKFDPDIVLEFYANAWPTEEGVQDLRSWVRGQWIPFDADALSRFLGYPLVLEEGQECEYGQRRNWADGFDEEAIAQLLCIPGQDFARTVAGRR

SEQ ID NO: 138249 - protein, 53 aa, Glycine max
  Coding DNA Sequence Number=SeqID_46564
MAKSLVGHPFAGRLTKDEKIVVADMTKSLGFVFDECNENCIPGCYKPTMSVPY

SEQ ID NO: 138250 - protein, 93 aa, Glycine max
  Coding DNA Sequence Number=SeqID_46565
  Homolog annotation: Hit_ID=A1R3P9; Match level="QueryCoverage=95%, HitCoverage=36%, E-value=6e-10, Identity=40%"; Hit description=Two -component system response regulator
  Pfam annotation: Domain name=Response_reg; Domain location=2-93; Score=46.7; E_value=8.3e-11; Accession=PF00072.15; Description =Response regulator receiver domain
MATALVIEDDDDIRRLLEVVLSQAGYTVAAAATGTEGLEALGALAPDLLLVDVGLPDIEGYDVVRQARSQMSGHIVMLSARSQEADVQLGLEA

SEQ ID NO: 138251 - protein, 58 aa, Glycine max
  Coding DNA Sequence Number=SeqID_46566
ELPPEPAVDALDFLEGDEDPLPEVDSPEEVMSASEADSTEDSGPGEMAISGGSSSPDV

SEQ ID NO: 138252 - protein, 96 aa, Glycine max
  Coding DNA Sequence Number=SeqID_46567
PIPLKIIEATRSNISQYIGFAEMIAKLKIIIFKKLQPSPLTNVQLFLSKQVLKALMITKHLKLGAKQVMPPHLKGKNHNSQLQIMGGIIPVTSLEC

SEQ ID NO: 138253 - protein, 164 aa, Glycine max
  Coding DNA Sequence Number=SeqID_46568
EVLWGGGLDQKKIAWVKWDYWLMEQEPLREKYPRLYNISCQQQKLIQDMGCQSANVWEWKLEWRRHLFEWRSQFLSITTSNRWEVTKTMGGSGALFGEGHCFDNEIDTAGVFLNEVQDMAIQQHGPDVWEWTADPTGTVRMMQFSFFGPGLGTLRKASQNILIT

SEQ ID NO: 138254 - protein, 63 aa, Glycine max
  Coding DNA Sequence Number=SeqID_46569
MVKVGTSYVPINVSFSPKVGPGLPAVPPVQLLTGWCVTAKAPPDISAGKCSGHAACNHHTRRA

SEQ ID NO: 138255 - protein, 155 aa, Glycine max
  Coding DNA Sequence Number=SeqID_46570
MAKFDPDIVVEFYANAWPTEEGVRDMRSWVRGQWIPFDADALSQFLGDPLVLEEGQECEFSQRRNRVDGFDEEAIAQLLCVPGQDFARTAAGKRVWIMRTSMTTLTQMWMALLLSNVLPTDHNSDLPLPKCQLVCHPPGTLKTRINLTGPWGFQC

SEQ ID NO: 138256 - protein, 55 aa, Glycine max
  Coding DNA Sequence Number=SeqID_46571
MTFQSFEVVSIASIDSLSRQPRLFDAAMMVARVMLGHDYEPGMGLGKNNSGRTSL

SEQ ID NO: 138257 - protein, 313 aa, Glycine max
  Coding DNA Sequence Number=SeqID_46572
  Gene Ontology: Mol. function=inorganic phosphate transmembrane transporter activity; Cellular component=integral to membrane; Biological process=phosphate transport
  Homolog annotation: Hit_ID=Q1H375; Match level="QueryCoverage=100%, HitCoverage=97%, E-value=1e-131, Identity=76%"; Hit description =Phosphate ABC transporter, permease protein PstC
  Pfam annotation: Domain name=BPD_transp_1; Domain location=90-311; Score=61.1; E_value=3.6e-15; Accession=PF00528.13; Description =Binding-protein-dependent transport s
  Pfam annotation: Domain name=BacA; Domain location=80-245; Score= -171.3; E_value=0.073; Accession=PF02673.9; Description=Bacitracin resistance protein BacA
  Pfam module annotation: Pfam domain module=BPD_transp_1::BacA; Domain location=90-311::80-245
MATQAMQAPAQLTISPRLAKNIRRNVKERIIELILMLAALVAVATTFAIVGVLLYESLSFFKTVSVVEFFTDTQWTPLFEDAHYGIMPLVSGTLTTSAIALAVAVPIGTISAIFLSEFASHKTRETIKPILELLVGVPTVVFGYFALFFVTPLLQSIYPDLPSFNMLGAGIVMGIMIIPYIASMSEDAMRAVPMSMREGSYAMGATRFQTAIRVVTPAAVSGIVAAYILAISRAVGETMVVAIAAGQQPNLTFNPLDSAATITAYIVQVAMGDLPHGSIGYQSIFAAGLVLMAMTLSFNIVGHWVRKKYRESY

SEQ ID NO: 138258 - protein, 260 aa, Glycine max
  Coding DNA Sequence Number=SeqID_46573
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLGSKLKASGMDPVCTFKGQSSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138259 - protein, 84 aa, Glycine max
  Coding DNA Sequence Number=SeqID_46574
  Subcellular localization annotation: CTP_CleavageSite=38; ConfidenceScore=5.56e-01
MKAHTKFNNSTIPKIGLTHKSPQWSRQLSQRALRGRARARLTGALSKGGKVDKSGAFAPTYPPLERKSDLRSSFLCMNQAILFT

SEQ ID NO: 138260 - protein, 290 aa, Glycine max
  Coding DNA Sequence Number=SeqID_46575
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIITSHRIVEWNGVMVVVCVAPPGMSRAAANVISKRSSILSGQVCIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138261 - protein, 125 aa, Glycine max
  Coding DNA Sequence Number=SeqID_46576
  Subcellular localization annotation: CTP_CleavageSite=42; ConfidenceScore=5.11e-01
MVKVGTSYVPINVSFSPKVGPGLPGINRDTRIYFSGSDLSVTGMLFGSKGWLRVLMLQAYRLPSYLEGPGTAFVPFMRVNFQLGVSGFIAVLPVQLRRGEIVIRSQFHKHTSRNISAASVKRGAR

SEQ ID NO: 138262 - protein, 217 aa, Glycine max
  Coding DNA Sequence Number=SeqID_46577
  Gene Ontology: Mol. function=oxidoreductase activity; Cellular component=membrane fraction; Biological process=electron transport
  Homolog annotation: Hit_ID=Q01234; Match level="QueryCoverage=100%, HitCoverage=100%, E-value=1e-111, Identity=93%"; Hit description =Oxygen-insensitive NAD(P)H nitroreductase
  Pfam annotation: Domain name=Nitroreductase; Domain location=7-193; Score=245.8; E_value=9.2e-71; Accession=PF00881.15; Description =Nitroreductase family
MDIISVALKRHSTKAFDPTKKLTAEEAEKIKTLLQYSPSSTNSQPWHFIVASTEEGKARVAKSAAGTYVFNERKMLDASHVVVFCAKTAMDDAWLERVVDQEEADGRFNTPEAKAANHKGRTYFADMHRVDLKDDDQWMAKQVYLNVGNFLLGVGAMGLDAVPIEGFDAAILDEEFGLKEKGFTSVVVVPVGHHSVEDFNATLPKSRLPLSTIVTEC

SEQ ID NO: 138263 - protein, 70 aa, Glycine max
  Coding DNA Sequence Number=SeqID_46578
MIIEKSIHVAFDETNSKRPRKEILDDITDSLEDIHIHEKGHKDKGDENSRDSQFNENQTNEDLPKEWRTS

SEQ ID NO: 138264 - protein, 83 aa, Glycine max
  Coding DNA Sequence Number=SeqID_46579
MPISPCRCISEGSRPQDTQWTRRSPTGPWGFQLWDRAHKTPSGPEEVQQGPGVSSSGYGPLDRARKTPSGPEKVQQGLGVAKL

SEQ ID NO: 138265 - protein, 80 aa, Glycine max
  Coding DNA Sequence Number=SeqID_46580
MDPKRIKVIHEWPTPPSVEERINEFQEPLDLRSNPFQGGGNDAILPPKGIDRRLQEDWTKDAREGPRVLMSLRIDFGPMG

SEQ ID NO: 138266 - protein, 211 aa, Glycine max
  Coding DNA Sequence Number=SeqID_46581
MDNEEGMQEQMKADLSALKDQMASISEVMLKLQKTIEDKATATASSTVREAEPVLQPALNPGRDRNTTVFGRRYSSQAYPYGLPPDFTPRATPEDLSQAPTFEGQLQPYNDYLGQDNEEGDTHLSPLLHLKDPSPHELPQPNIVHHIPASPTPVKESVPFVEDKGKIEALEERLRAVEGLGNYPISSFLPSSKYRTLISTKGRHVRKGIFG

SEQ ID NO: 138267 - protein, 181 aa, Glycine max
  Coding DNA Sequence Number=SeqID_46582
  Gene Ontology: Mol. function=4 iron, 4 sulfur cluster binding; Cellular component=nitrate reductase complex; Biological process =nitrate metabolic process
  Homolog annotation: Hit_ID=A6T9P1; Match level="QueryCoverage=100%, HitCoverage=35%, E-value=1e-100, Identity=98%"; Hit description =Cryptic nitrate reductase 2 beta subunit
MDWKLALPLHPEYRTLPMVWYVPPLSPIQSVADAGGLPSNGNILPAVESLRIPVQYLANLLSAGDTGPVLRALKRMMAMRHYKRSQTVEGVTDTRAIEEVGLSVEQVEEMYRYLAIANYEDRFVIPTSHRELAEDAFPERNGCGFTFGDGCHGSDTKFNLFNSRRIDAIDVGDVRRHGEGE

SEQ ID NO: 138268 - protein, 270 aa, Glycine max
  Coding DNA Sequence Number=SeqID_46583
MDFQEEIARRRWTSLVTPMAKFDPDIVLEFYANAWPTEEGVRDMRSWVRGQWIPFNADALSQFLGDPLVLEEGQEYEFGQRMNRADGFDEEAIAHLLCIPGQDFARTAAGRRVRIMRTSKTTLTQMWMTLLLSNVLPSDHNSDLPLPKCQLVYAILTRMSVHVAQLIADAIYLFAGMPPTRHPLDLDKSNRALGFPALITGLCQSFGVLVTPSKAWSGMMQAPLELVGLGSSSSMDSFAPWKMNGSGMEKEEREETPLQGEDESRRSSPP

SEQ ID NO: 138269 - protein, 136 aa, Glycine max
  Coding DNA Sequence Number=SeqID_46584
MAPRKLASKRSRKDKAAEGTSSAPEYDSHRFRSAEHQQHFEAIKGWSFLRERRVQLRDDEYTDFQEEIVHRRWASLVTPMAKYDPDIVLEFYANAWPTEEGVRDMRSWVRGQWIPFDADAIGQLLGYPLVLKRARV

SEQ ID NO: 138270 - protein, 139 aa, Glycine max
  Coding DNA Sequence Number=SeqID_46585
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=81%, HitCoverage=96%, E-value=2e-24, Identity=55%"; Hit description =Putative uncharacterized protein
  Subcellular localization annotation: CTP_CleavageSite=25; ConfidenceScore=5.49e-01
MTMITPSSKLTLTKGNKSWYRAPPRGRRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGDRYTCQR

SEQ ID NO: 138271 - protein, 83 aa, Glycine max
  Coding DNA Sequence Number=SeqID_46586
MSNLKSTELALKNLEVQVGQLAKQIADKSSNNFVANKEQNPKEECKAMMTRSKRFVEAEDEDSVVHKKKIADKKGMLDQVASE

SEQ ID NO: 138272 - protein, 75 aa, Glycine max
  Coding DNA Sequence Number=SeqID_46587
EPVQVIEVSSSEEDPEEDPEELPPEPAVDALDLPEDDEDPLLDVDFPEDIMSASEADSTKGSGPGGIANSEDSSS

SEQ ID NO: 138273 - protein, 141 aa, Glycine max
  Coding DNA Sequence Number=SeqID_46588
  Gene Ontology: Mol. function=aspartic-type endopeptidase activity; Biological process=DNA integration
  Homolog annotation: Hit_ID=Q69FA4; Match level="QueryCoverage=75%, HitCoverage=7%, E-value=3e-22, Identity=51%"; Hit description=Gag -pol polyprotein
  Pfam annotation: Domain name=zf-CCHC; Domain location=56-73; Score =24.8; E_value=0.00026; Accession=PF00098.14; Description=Zinc knuckle
MSAKANMVQDKPFHKMYANKIDHNNKNKYKYNNPRVAPSNPIPRALASNHSFKKKGACFVCGQPGHLAPQCRYRIVRNENPPKPRPNLVEGDDIIVAFISQVNVVTNGMEKNKFILVIRELLQFKERGKFFSSSHLGKHWL

SEQ ID NO: 138274 - protein, 68 aa, Glycine max
  Coding DNA Sequence Number=SeqID_46589
MAEAVKPVNNVDASNPTPPTTIFAKPLPDVSKIEECVRTLLDMHGAVFALSTPKPAADADANQLQQWV

SEQ ID NO: 138275 - protein, 63 aa, Glycine max
  Coding DNA Sequence Number=SeqID_46590
HLDVTLTSSVGPECVELISIVQRAISGCTGSVKYNLHDLKRDVVTSGTTSVIGIRISVRILGQ

SEQ ID NO: 138276 - protein, 100 aa, Glycine max
  Coding DNA Sequence Number=SeqID_46591
MVSPQGRNTWAVDDLVPYVKKLAIISEEQERITEPMSHGRRREPVEAEEYSQQMMERGHGMYYTPATFSQYLSQMYHYPFEGHHTDTSASEHSFGGVAKT

SEQ ID NO: 138277 - protein, 179 aa, Glycine max
  Coding DNA Sequence Number=SeqID_46592
  Homolog annotation: Hit_ID=Q6UUU1; Match level="QueryCoverage=48%, HitCoverage=55%, E-value=1e-18, Identity=61%"; Hit description =Putative uncharacterized protein
  Subcellular localization annotation: CTP_CleavageSite=39; ConfidenceScore=5.62e-01
TAGIRRGIHSRAMKTFQFAQSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFRFTGVIPLYGR

SEQ ID NO: 138278 - protein, 202 aa, Glycine max
  Coding DNA Sequence Number=SeqID_46593
  Gene Ontology: Mol. function=aspartic-type endopeptidase activity; Cellular component=small subunit processome; Biological process=DNA integration
  Homolog annotation: Hit_ID=A5AFV0; Match level="QueryCoverage=98%, HitCoverage=16%, E-value=9e-19, Identity=31%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQTSHDMIAHVGKARAAVEELRKFLVADSLEEVNRKLDKFYMVLILRSLHSDFDHVRDQVLAGDQVPSMDSLITRLLRVPHLSKDENPTDSVETSAMVASRGRGGGRNSRGGRNGRGGRPHCTYCKRMGHTQENCYSLHGFPDKVAQVSRSEKVESKFSDEEYQEYLKLKSERPSNQAQSSSVPCFSTACISQSIE

SEQ ID NO: 138279 - protein, 140 aa, Glycine max
  Coding DNA Sequence Number=SeqID_46594
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=62%, HitCoverage=74%, E-value=7e-25, Identity=67%"; Hit description=LacZ protein
  Subcellular localization annotation: CTP_CleavageSite=34; ConfidenceScore=5.40e-01
MSPLPISSTTGTTALSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138280 - protein, 66 aa, Glycine max
  Coding DNA Sequence Number=SeqID_46595
MYKDNWTQPWPMGSEIYPEVHENPRAFFSSSSPIFLEPLAHGSSDWSLPREDCITNFIGKCTESLK

SEQ ID NO: 138281 - protein, 109 aa, Glycine max
  Coding DNA Sequence Number=SeqID_46596
  Subcellular localization annotation: CTP_CleavageSite=52; ConfidenceScore=5.22e-01
MSRASSFSVSALPGDTQDLGVIGAVQCQNSNRAYLGKVPHPRPVRLLFYSFLARSRWAGPRFTLCLSRKCLGAPPLANFLVGNQEGMVYQIRTTRSIIFAYCNDLAFVP

SEQ ID NO: 138282 - protein, 63 aa, Glycine max
  Coding DNA Sequence Number=SeqID_46597
MGGCGRPVKATRGADFGAPFDSRLLLWASREPHGASVGDLGDVSGGAIAQTKLDQSRPNPGIV

SEQ ID NO: 138283 - protein, 88 aa, Glycine max
  Coding DNA Sequence Number=SeqID_46598
  Homolog annotation: Hit_ID=A5AZ88; Match level="QueryCoverage=78%, HitCoverage=6%, E-value=6e-08, Identity=34%"; Hit description =Putative uncharacterized protein
MVFPADFVVMDVDEDHEVRIILGCPFMLTASYVVDMGRKKLEMGFEDQRINFDLFEENKSVPDQNVCLQVMEGDKEVLKLKDKVDITH

SEQ ID NO: 138284 - protein, 127 aa, Glycine max
  Coding DNA Sequence Number=SeqID_46599
  Gene Ontology: Biological process=transposition, DNA-mediated
  Homolog annotation: Hit_ID=Q1J7G7; Match level="QueryCoverage=25%, HitCoverage=45%, E-value=3e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMGGKQQHGGFMTIR

SEQ ID NO: 138285 - protein, 266 aa, Glycine max
  Coding DNA Sequence Number=SeqID_46600
  Homolog annotation: Hit_ID=Q6UUU1; Match level="QueryCoverage=22%, HitCoverage=40%, E-value=3e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLGNARVFPVTTLNSIGAGGGASCRAPRDWLWGEGAGPAAEKTAGAPRECSLAPQSGPHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138286 - protein, 160 aa, Glycine max
  Coding DNA Sequence Number=SeqID_46601
MAPRKLASKRSRKDKAAEGTSSAPEYDSHRFRSAEYQQRFEAIKGWSFLRERRVQLRNDEYTDFQEEIVRRQWASLVTPMAKFDPDIVLEFYANAWPTEEGVRDMRSWVRGQWIPFDADAISQFLGYPLVLEEGQEDFARTTAGRRVRIMRTNMTTLTQI

SEQ ID NO: 138287 - protein, 55 aa, Glycine max
  Coding DNA Sequence Number=SeqID_46602
NASTSSNSSSEKDIANMCLMVDSMDDSSTIEETEEFQKARDSLWYLDSGCSKHMT

SEQ ID NO: 138288 - protein, 148 aa, Glycine max
  Coding DNA Sequence Number=SeqID_46603
  Subcellular localization annotation: CTP_CleavageSite=51; ConfidenceScore=5.55e-01
MATPPASPPPPPPPALASASLSTLKRTRKATRLRSLATRPPGAERPVVHVDLAIGKADSPHKKKLRTHLGIVTGDKAEFDIPEASDANKDSVDDTVCEKYGISKEKLAQFCQTRRNPLWEDVRKKAQAIQKQNIAPHVLSRGGYEYLE

SEQ ID NO: 138289 - protein, 67 aa, Glycine max
  Coding DNA Sequence Number=SeqID_46604
MSDGFCGTHLQIMVRTRGLGRALGQVTGRGLGRGDRDDSDDAPQRRRPTASAQRQRVAVTVDHVDEL

SEQ ID NO: 138290 - protein, 363 aa, Glycine max
  Coding DNA Sequence Number=SeqID_46605
  Gene Ontology: Biological process=cell redox homeostasis
  Homolog annotation: Hit_ID=A8GBL6; Match level="QueryCoverage=95%, HitCoverage=99%, E-value=1e-102, Identity=51%"; Hit description =Putative uncharacterized protein
MDPSRHCRGVMTHQPLIAEVPNQQHTLTAIVEQDALRRARLLVAQSAAGTAQEDREAMEQGIAPLLSASYCRTLEAEPMLDPAGLQILWEPSDDGAALWYYGQLLAVIPGWSLYQDKQVSFSAGCIKENRLTAPLGSASTNDYYARAEQQRHFWRDWHDGQQWDRVQSELLQRYQAQFGESVKYYAIDQGNWPPMAISQHWHNGVWYFFTLGMSIRPMPQVDYLFDELAPQYRRVELAMAVDGEVMTEANAVQMASALAEFAHLPWARLTWIGEGHTLASEVAPVGFESFLLANGLAGENAQLRLPKRDGDRPNLLWATPITEAERLFAQADDRGGQQLLQRLLAQGSDHVFRPRQEVVESAP

SEQ ID NO: 138291 - protein, 172 aa, Glycine max
  Coding DNA Sequence Number=SeqID_46606
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=50%, HitCoverage=72%, E-value=3e-24, Identity=68%"; Hit description=LacZ protein
MEKTALPRPSHFPVKYLPGIFQEISAPFPFFSCHMKHFTDTLISANIRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138292 - protein, 62 aa, Glycine max
  Coding DNA Sequence Number=SeqID_46607
EAGCFGLFLLCGAGYRQSTNDLKTWQMSTPGRNTQHSIMGFPYDSAEFTIRPIVQIMFPSVQ

SEQ ID NO: 138293 - protein, 228 aa, Glycine max
  Coding DNA Sequence Number=SeqID_46608
MAPKKLSAKRSRRDAAAEGTSAAPEDDEYTDFQEEIARRHWTSLVTPMAKFDPNIVLEFYANAWPTEEGVWDMRSWVRGQWITFDADALSQFLGDLLVLEEGQECEFSQRRNRADGFDEEAISQLLCTPGQDFARIAARRRVRIMAHQHDHLDTDVDAPQAADAPPPPHQADPAGSLGIGAGQGFAPFACPTPDQFRVEVAWPRDWPEAQAGEVPARAPGDAEEACMD

SEQ ID NO: 138294 - protein, 197 aa, Glycine max
  Coding DNA Sequence Number=SeqID_46609
MTRVMRIMKLAKYRLKAQVEKDKAPKWRTMKAQVEKDEGPETETLSRQLITYQGNPCGVYLDLSSFTGSGVYPDLSSFTGSGVYPDLSSFTGSGVIQISVACIKRSAPNLRGNTSGKRQEGIHYTKAYIESIKHERTTIKERNTMREKREQEKENSEAPQRNMKKKSDTPDDANLSMSGSFDTGYEGLDDATSGEGR

SEQ ID NO: 138295 - protein, 303 aa, Glycine max
  Coding DNA Sequence Number=SeqID_46610
IVGRAFAEPLILRIGHAYQQVSDWHTLRPEGWALADKAVAITLAALQAGRGGRGIAVQDGGAGGMSRNGKQGDSEITQSELEELSGTLLVDLATTLPTNQWGGGRYCGGNAHAVATFGSTALAGPCRPVIFMGMSGEQKLLHRITHRLGKDGLEFAGHRELQFAQRGVHQREELRVILAHHAAVDFPRLLFPDHHPVVRVARLGAFAVQQRIVHVERRRPTGLQHLEGFAMVLGADHEHVHLVIDVIAFQVTFVGGAGGGYHILAAQVGEALDPAVLGRHQLDLDVDEAIGKRHLFLPLCGDA

SEQ ID NO: 138296 - protein, 102 aa, Glycine max
  Coding DNA Sequence Number=SeqID_46611
SPTGNLVPLDFEIEATLRRNRAERRRKLLQDRAIAYILEEEAQSSDSTSSDSLSSRESAIYLPEASVMADEDQQRVTLRIILVAQCRNSLQVLRILKSKLTT

SEQ ID NO: 138297 - protein, 90 aa, Glycine max
  Coding DNA Sequence Number=SeqID_46612
MTPVNRKAGTGERTREPPGGNAGIFIVLSGFATTDLSVRFRDACQGGGAYGKTALPRPSHFPVKYLPGIFQEISAPFVSHFRSPQSNDRA

SEQ ID NO: 138298 - protein, 123 aa, Glycine max
  Coding DNA Sequence Number=SeqID_46613
MVISSFLKISKNLAKWHSFSFLEGTTGYDVVINLESTDVVIHLANRIVAYPAGFIEDVLVRVGELIFPVDFYVLNMCRNLPFGGSATRDSRERLPRKEYARSRHQRLFEKNIEKTGKDVVFKL

SEQ ID NO: 138299 - protein, 87 aa, Glycine max
  Coding DNA Sequence Number=SeqID_46614
MVKVGTSYVPINVSLFAKKLQSVPGTTRTTPKERAIIYQAYRYRHLELSFLFSMKFGVVSAHNSAHKHTSRKHQRASVSLGCLRRCS

SEQ ID NO: 138300 - protein, 123 aa, Glycine max
  Coding DNA Sequence Number=SeqID_46615
  Homolog annotation: Hit_ID=A0ST23; Match level="QueryCoverage=21%, HitCoverage=55%, E-value=2e-08, Identity=100%"; Hit description =Putative reverse transcriptase
TDGVVRNGKKHRRTSALASVAAAQLLGRAIGAGLFAITPAGERGMCCKAIKLGNARVFPVTTLRLKSDILRIKLIDTVDLEGGPVGKPVVPAALMNRPTRGERRFAYWALAECILAYYVGTDE

SEQ ID NO: 138301 - protein, 118 aa, Glycine max
  Coding DNA Sequence Number=SeqID_46616
MCRFRIGSKIPLAIYTLGVVAKYLDVCTCIRNTGMCTCAIFGSQDALSMHVEECLVRVNVHKEKMAPRKLASKRSRKAKAAEGTSSTPEYDSHRFRSAVHQQRFEAIKGWSFLRERRV

SEQ ID NO: 138302 - protein, 259 aa, Glycine max
  Coding DNA Sequence Number=SeqID_46617
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLNSIEHPDEKISPLEAYYKAEALLRKASPKLLQATELDVARGARYQLLFPLVRVNFELGVIMVIAVSSECILAYYVGTDEGVSEVLHVAGEKRLHRCVSRICDTGYIPLPRSLTRYARSFDCGERKWLTNGAEISWKMPGRYLTGK

SEQ ID NO: 138303 - protein, 181 aa, Glycine max
  Coding DNA Sequence Number=SeqID_46618
  Gene Ontology: Biological process=transposition, DNA-mediated
  Homolog annotation: Hit_ID=Q1J7G7; Match level="QueryCoverage=17%, HitCoverage=45%, E-value=4e-11, Identity=100%"; Hit description =Transposase
VLQWLLFLSAVPPVQLLTGWCVTAKAPPDISAGKCSGHAARRVPFAIQAAQLLGRAIGAGLFAITPAGERGMCCKAIKLEQLELSYIAGAYGTVIAYGVCGGARYQLLFPLVRVNFELGVIMVIAVSFGKPVVPAALMNRPTRGERRFAYWALAECILAYYVGTDEGVSEVLHVAGEKRLH

SEQ ID NO: 138304 - protein, 142 aa, Glycine max
  Coding DNA Sequence Number=SeqID_46619
  Homolog annotation: Hit_ID=A2YV59; Match level="QueryCoverage=69%, HitCoverage=29%, E-value=6e-07, Identity=31%"; Hit description =Putative uncharacterized protein
MERTPRALAMWMAGLTLAFAISIALAQKVDLLCDRCGMEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPI

SEQ ID NO: 138305 - protein, 140 aa, Glycine max
  Coding DNA Sequence Number=SeqID_46620
MEKRPTRTRRWPICLTSWEGVEIHDWEIPKIHGENVNPYPRKQKKKRRKISNQRKKEKENFQSKRKQKRREGKFPIKGKKRGKEIPNQRVGESKKKRKKIPNQRMGERKKEKEKKERKLLIKDRKKIEEMCREVFGPDNI

SEQ ID NO: 138306 - protein, 143 aa, Glycine max
  Coding DNA Sequence Number=SeqID_46621
MYPLLFSVKPKEWEESKEFSDCVVLNSLTREKGDTEEFRRLVLCSFGKGRRETQKEFRRLVLGEFFLAKGEENEKMNSTSFQGLEKPENFRKLLVQRRRKSSKRFKACKGLYENKCSRYLTCKTKPCFYRLFMSGQENHSEEL

SEQ ID NO: 138307 - protein, 77 aa, Glycine max
  Coding DNA Sequence Number=SeqID_46622
MASGTPVMLLVFSKQDCFWRKKIRSPGRAERQPPPHFPINRQKGVVLRVPDSPGYAFQLFWVKKIVSMKKIPAEELP

SEQ ID NO: 138308 - protein, 28 aa, Glycine max
  Coding DNA Sequence Number=SeqID_46623
MEKNEETTMEEKRKAKQKRIGEAPSTRE

SEQ ID NO: 138309 - protein, 89 aa, Glycine max
  Coding DNA Sequence Number=SeqID_46624
AFSCISGPIYLESSIQYPCGVGLHHGIYSTWFASRRPTTGGRAEVAWPRDWPEAQEGEAPAEASGDAEEARIDEEMMDLLNFLGGSRAT

SEQ ID NO: 138310 - protein, 121 aa, Glycine max
  Coding DNA Sequence Number=SeqID_46625
MDTYVSPLTAQITEIEVTKPTLFEVALERSPPICASSSSISVVFKSKGERKDIELVEEEQARIGADPSSGTSNKSENYKEEAWKKTQKHKPKRVESVNADAEAFGDDSKIVIALCIVKLKQ

SEQ ID NO: 138311 - protein, 112 aa, Glycine max
  Coding DNA Sequence Number=SeqID_46626
MTLLAEEEDRIIEAHEEAPPSLPQFERQRSPKSHLKCPPCIRTHIKAEFDQMHISWECNLHYNQDMLRLTYLDLLLLREPLHLHMVVRYQHLTPQWVLHGMCRETFLTLLIY

SEQ ID NO: 138312 - protein, 76 aa, Glycine max
  Coding DNA Sequence Number=SeqID_46627
  Subcellular localization annotation: CTP_CleavageSite=35; ConfidenceScore=5.13e-01
MPVPSLQHPRGSNPRRHLMVPIRTRNITRASRLIPGMMQSYPARALARRLQVDWARDPRKGPRVLMSLRVDFEPMG

SEQ ID NO: 138313 - protein, 97 aa, Glycine max
  Coding DNA Sequence Number=SeqID_46628
MYQYPFEGHHTDTSASEHSFGGVIEIQPHFSWPTMTHSQQHDAPMATPNASFAPQWNVPGTIPDMGDLLGVDLRQEFSAKAEQVEAGRHRGRRNPDR

SEQ ID NO: 138314 - protein, 183 aa, Glycine max
  Coding DNA Sequence Number=SeqID_46629
MEAIKEQMATMMKAMMSMKKIMEANAVIVAAISAVAKVNPTSPSGLKQMNHPTSNMVGKDLGSMGGPHDVQIQNEHAFPSYGLPLNYTPPNVAYTPNKNTHEIPHHNLADFEPWLGYTTEGQAVGGIPLQNPLEGPQYHPQLHLLHSTAVKSPHDYGRNGKVGSSRGKAQGPLKEAKIMPLLT

SEQ ID NO: 138315 - protein, 120 aa, Glycine max
  Coding DNA Sequence Number=SeqID_46630
MSEVEEVQEQIKADMEAMKEKIATMREAMMSMKNIMEANAVTVAATRAVTKVNPMPPSDLNQMNHPTSDMVDKDLGSTDGPMMCKHAFPPYGSPPKEDVNNSAPILIESQQPQTDHAHVS

SEQ ID NO: 138316 - protein, 66 aa, Glycine max
  Coding DNA Sequence Number=SeqID_46631
  Homolog annotation: Hit_ID=UPI0000ECAFAB; Match level="QueryCoverage =40%, HitCoverage=33%, E-value=6e-07, Identity=88%"; Hit description =UPI0000ECAFAB related cluster
LEECGLWGVHSPNRHIAKLALAVVLQRRDWENPGPEWRMAPDAVFSPYASVRYFTPHMVHSQYNLL

SEQ ID NO: 138317 - protein, 229 aa, Glycine max
  Coding DNA Sequence Number=SeqID_46632
  Gene Ontology: Mol. function=nucleoside-triphosphatase activity; Cellular component=intrinsic to membrane; Biological process=innate immune response
  Homolog annotation: Hit_ID=A5BHM3; Match level="QueryCoverage=91%, HitCoverage=39%, E-value=6e-33, Identity=38%"; Hit description =Putative uncharacterized protein
NLPNAKEELELTRNSVKERVEEAIKRTEKIEPAVEKWLKDVEKVLEEVHMLQGRISEVSKSYFRRQCQYFLTKKIERKIQKMTQLNHDSKFEPFSKIAELPGMKYYSSKDFVLFKSTESTYKKLLEALKDKSACTIGLVGLGGSGKTTLAKEVGKKAEELKLFEKVVMVTVSQTPNIRSIQVQIADKLGLKFEEESEEARAQRLSETLIKHTTLLILDDIWEILDFEAI

SEQ ID NO: 138318 - protein, 277 aa, Glycine max
  Coding DNA Sequence Number=SeqID_46633
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
LAPGLPRYQQGHQDLFILRSDLPSQVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSINIGTFNIDFKTGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138319 - protein, 152 aa, Glycine max
  Coding DNA Sequence Number=SeqID_46634
  Subcellular localization annotation: CTP_CleavageSite=84; ConfidenceScore=5.66e-01
MPSSALASNLPRLSLPLFRTKHLYPKTSSAQKYFGSGVSFKRVLAISSKDLFFLSTTPFCWGVLGAEKLCSMPCSSLSQHALSRVSEGEAHGCAFQRRKDARSRHQRLFVGNVGKNQRKPVKMKILSSGVVFTFEEGISTSHVCLKGQQPIF

SEQ ID NO: 138320 - protein, 102 aa, Glycine max
  Coding DNA Sequence Number=SeqID_46635
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=95%, HitCoverage=76%, E-value=1e-18, Identity=57%"; Hit description=LacZ protein
  Subcellular localization annotation: CTP_CleavageSite=32; ConfidenceScore=5.05e-01
MTMITPSSKLTLTKGNKSCPGDPLVLERPPPRWSSNSPYSESYYNSLAVVLQRRDWENPGVTQLNRLAAHPPFASWRNSEEARTDRPFSTVAQPEWRMGRAL

SEQ ID NO: 138321 - protein, 126 aa, Glycine max
  Coding DNA Sequence Number=SeqID_46636
GAEDDVSLCVLSGFSSYRQQKVYTDNHSGISARQRDSKVTMTNLVSAKDDGGEDDISQCVLSGFSSYRLKKVYTDNHSGISDRQRESKVAEDEVSLYVLSGFSSYRQQKVYTDNHSGISARQRDSK

SEQ ID NO: 138322 - protein, 119 aa, Glycine max
  Coding DNA Sequence Number=SeqID_46637
MDKSLKVGEDKWRKRERRGMRPTWAFQILPPEGGCFWRKQPGSPQQVELAWASWEGRGSAFLALHIHLKLLREIVSVKKIQAEALPQRFRNVSVGDFVKIFNRSSSFIVRSSLFFDLQP

SEQ ID NO: 138323 - protein, 30 aa, Glycine max
  Coding DNA Sequence Number=SeqID_46638
MEAKLKETDFHNIPCYVQILDAEGPPSQLK

SEQ ID NO: 138324 - protein, 284 aa, Glycine max
  Coding DNA Sequence Number=SeqID_46639
  Homolog annotation: Hit_ID=A5BGG4; Match level="QueryCoverage=34%, HitCoverage=8%, E-value=2e-10, Identity=39%"; Hit description =Putative uncharacterized protein
MFEDKELNIKILNCLTRTWEPKITTIKESKNLATMTMEALFGKLLDYEHELTQQSYAEETKKKRKGITLKVNVNSLGLMWIEEERWIEEDKGIMDIEREFPLLEMLRLKMYSLESSESGCIDVPLSINSSREEYKDSSSSEEDAKKFNLMKNGEKKGKKDKKQKKAYIAWDDSASTTFDSSSDEEIANICIMEKSMNDPSTSEEVEVNPNFEEILEAFNEMNKEAQRLAVLNKKLKSKLKLHINKLASTQGELNVLKQENEKIVSRCKAIACDDTSTSFNMDDY

SEQ ID NO: 138325 - protein, 142 aa, Glycine max
  Coding DNA Sequence Number=SeqID_46640
STLEDPRDGESDDMWGYLMVIRTFCHPEMASLMTCGDGESDDMRGYLMIICTFCHPETASLMTCGDGESDDMRGYLMVIRIFRQPEASKPVDTQRLTLSSAPLSSGDGESDDRRGFYFRHPETSKPDDAPDSSLLGRDDRVQ

SEQ ID NO: 138326 - protein, 70 aa, Glycine max
  Coding DNA Sequence Number=SeqID_46641
MEKTMKMRYNGGDSSSGMVIVATMCGGADDGGGVGNGDSNGGGIDNNDNGWNSGNDNNNNDGGDILAIYH

SEQ ID NO: 138327 - protein, 100 aa, Glycine max
  Coding DNA Sequence Number=SeqID_46642
MEDAPVSPHVALPPKDCRISPLLLIYFKAKFDIPEGLTAKKKVMSTVGTRWRQFKSSLTTRYVYAENDDEQNKDPSAKYGIDRNTWEEFAKTRHTPTWKV

SEQ ID NO: 138328 - protein, 46 aa, Glycine max
  Coding DNA Sequence Number=SeqID_46643
MSVTLRRKESMYIEARGKVSAQKGKSNVVAQSQNSSVSYVSGQNMA

SEQ ID NO: 138329 - protein, 87 aa, Glycine max
  Coding DNA Sequence Number=SeqID_46644
MKTTYLTLCLAPRSFSLEHVKCRRSWSSMRALEYGDRYPLFCVGSVKRLGKIVLVTARNHWAGDVKLFMVLLLYLQEKNVIAEGRAC

SEQ ID NO: 138330 - protein, 1139 aa, Glycine max
  Coding DNA Sequence Number=SeqID_46645
  Gene Ontology: Mol. function=DNA binding; Cellular component=nucleus
  Homolog annotation: Hit_ID=A7QAD6; Match level="QueryCoverage=98%, HitCoverage=56%, E-value=0.0, Identity=53%"; Hit description =Chromosome undetermined scaffold_70, whole genome shotgun sequence
  Pfam annotation: Domain name=HSA; Domain location=578-643; Score =32.0; E_value=2.1e-06; Accession=PF07529.4; Description=HSA
MHGCNSGSALLVNAEVDSMGGVVDGGVGIGLKTSPRRAAIEKAQAVLRLEYDAREERRRELEFLEKGGNPLDFKLGNAASVSVQSTSLTDQHQEQFVTSEAKGSFVLTASPHGDSVDSSARPGVPSLSEPNTADNLLLFDGENELLEGEKRSLHPNKSNNIAPSEQSSRIGGNQNAKETEDSAIFRPYARRNRSKPNHGPRGASRDVKGIISDTNKQKDHNVLSVSKPKPTGLNGEVLSKDPTSNNPLGNELVGARACQTASGNASVPEDNLDIGMNKNFKEDQRIIPSQDDIVQNPVVLASGEAKAVGERDLGNSGDLEPPPCAATKQPGNESCSGQPNGFGNIKLDRKGVPNGDQNFSAALSMKNFDSESSCAQTSLAIDVNNNNNMCSNAKNIDANKNTVEQTSEFEQKLYLTGCGVVKERSNTNAGESGVTSNNEHATGYENHSGSGNMVKSEEGIHTNSLGMQNKVKDSSNIKGPHHNESSVSNADKEKSVGLMGHPNCIREDNCERLKVPMDVSISTTQTAPVEKVATTASDCQPCSTHNLKLADKAHEDSILEEAKIIEVKRKRIAELSVRTLSSQIHRKSRWGFVLEEMTWLANDFAQERLWKITAAAQLSHQATFTSRLRFEKQSKHLGVKILSHNLAKAVMQFWNSIELLLDNDVPDCNCIDDSVESGNIDSNEASGDKRSNSKMVLETSKYLDGQNPRKQVALKVHSYALRFLKDSRSQGISSQAEAPTTPDKISDSGIVGMSWDDHLTEESLFYTVPPTAMEAYRKSIESHFLQYEKTGSSIQEEVETSMYDAATEFGLEEIAYDEDEGETSTYYLPGVYEASRSSKSFQKKHKNRIKSYSHKSSEIGTDLPYGHYSTGAQPSVLFGKRPASLNVGTIPTKRMRTASRQRVASPFAVISGTAQAQAKTDASSGDTNSFQDDQSALNVGSLIQKSLEVESVRDFEKQVPYDCGETSVKTKKKKPKNLGSSYDQGWQLDSVVLSEQRDHSKKRLDSHYFEPNGSSGLYGPHSVKKLKTTKQSFDNFDNVAPIANSIPSPAASQMSNMSNPSKFIRIISGGRDKGRKAKALKVSAGQPGSGSPWSLFEDQALVVLVHDMGPNWELVNDAINSTIQFKERCYGCRTEGHLQ

SEQ ID NO: 138331 - protein, 383 aa, Glycine max
  Coding DNA Sequence Number=SeqID_46646
  Gene Ontology: Mol. function=catalytic activity; Biological process =cellular metabolic process
  Homolog annotation: Hit_ID=A7Q5D6; Match level="QueryCoverage=10%, HitCoverage=25%, E-value=2e-08, Identity=70%"; Hit description =Chromosome undetermined scaffold_53, whole genome shotgun sequence
MEQLLYLNFTWKGREALGVAKPSVASYLSQEILAEQEADTVHGLPVQPPVKFNNMVVITLSMKLKEEHCSIGFPRPLTNQNKNPFSYGSMELCHSLEGNAGALTNFEVLDFLRAKGASKDPTKVIAKVAQSEYKLHAAPQLLSSNSHINNLPLLLTFTFVSPSSPRHSSPSSSLSPKLPSSFASASAAPFPFLSFPFKRMFLHVGLSQQVAIESSLEKGLVDRSDASDVDAKVDNMARCFRTNQRILVRKRNKDELGKTIGREQEEPPKSQIGRENGSKFSNWPNEREVLSAAKVAKKMKLKFTKEWIAYLRLPLPIDVYKEVIHKLCFRNLNIAEALYSETWCECHVRCLKVVMRSNVGLEGGKKHKWWNCKVHVPFFVFYE

SEQ ID NO: 138332 - protein, 482 aa, Glycine max
  Coding DNA Sequence Number=SeqID_46647
  Gene Ontology: Mol. function=RNA-directed DNA polymerase activity; Biological process=RNA-dependent DNA replication
  Homolog annotation: Hit_ID=A5BXE3; Match level="QueryCoverage=45%, HitCoverage=9%, E-value=1e-14, Identity=28%"; Hit description =Putative uncharacterized protein
EQLKQQLHQFDTLAQDKTLGEDEVKTMKSIQQELWEVSLAHESILRQKSRIKWLKEALLGKWLWDLASNQNQLWARILTSKYGGWADLNNGRDRPWHSQWWKDLRKLVKQPEFSPIHQHMEWKVGDGSLVKFWKDKTIKAFNRAIVIKWKWLMFHQPDQLWIRILISKYKGWRGLEEGSHKQTHSFWWSDLKSIMHHGSMAEVLKQFHWKLGSVSGKHGVLLKKKVGSGNSHGEETFLTMSWEGADPKGFFTTSTAYLCIKGHDKSNGTKLKTDMDNTENSPKSGVETKKESIDAKLCQYLWGYNNSSWECLPSSNTAGGLLCIWNNGSFLVDRRVLGRGFIMLEGLWCVLGDFNSIRHREERLSSSQTRDTPPSISEFNSWISNMALEEGHISSRKVLNLKKELNALEEGFTNGILSQDEVKLRKSLQEQLWNAAYAVESMLRQKARVKWLKEGDSNSNYFHRLINYRRRQNVIQGLFING

SEQ ID NO: 138333 - protein, 97 aa, Glycine max
  Coding DNA Sequence Number=SeqID_46648
  Homolog annotation: Hit_ID=A5C944; Match level="QueryCoverage=53%, HitCoverage=5%, E-value=2e-10, Identity=65%"; Hit description =Putative uncharacterized protein
MFPHDFLLRLVLENVLSEQRLCFVFENVLYVPKNVVENVLVDLNAKYEVEKFTGQNDFGLWRLKMRTLLVQQGLVEALDGEAKLEKMMGDGDKKALL

SEQ ID NO: 138334 - protein, 247 aa, Glycine max
  Coding DNA Sequence Number=SeqID_46649
RIQTLMCGSQLNIVVMQSLQNPVEVPWEASQFGLPDIGAKFYITHADLAEIISGDKCLNIAILQLWTIFMNECGRSKADQSLYGLLEPQSIQNAKERRQQCQQYIETWVKESQRQLYLGAYLHQARWQLFVLHPRENTVVWFCSLRKKPDINIKGAINSAMKTITSSFEGMSNQGAPRWVEPKSNVQSGGFECGYYVMHWMWCIVTAGLKDDWHKWFSDGSPLDVEAITTVRQKWATYFLTFRKSSC

SEQ ID NO: 138335 - protein, 77 aa, Glycine max
  Coding DNA Sequence Number=SeqID_46650
MALNEKLEEHLGASGNEKEQLISDDGVGVMSDTLWRKESMYIEARGKVSARKGKRARGSKGLQARLGLERVQHERGK

SEQ ID NO: 138336 - protein, 72 aa, Glycine max
  Coding DNA Sequence Number=SeqID_46651
MEQVDHRMDSPYPIHSERQDKMSNEELKLQDPRCRIQCPDILPENTGVAVQCKIKVKCRSEAAGSTMSDTMS

SEQ ID NO: 138337 - protein, 91 aa, Glycine max
  Coding DNA Sequence Number=SeqID_46652
CFYKIYPEVHENPRAFFSNSSSILLEPLAHGSSDCGADSILFWEVQPIGIVIDPLQNLKRFIPSRAKLGFPFSRESILPKMEPNPVTVIKN

SEQ ID NO: 138338 - protein, 160 aa, Glycine max
  Coding DNA Sequence Number=SeqID_46653
MEKNEETTMEEKVKMKTNGGPSMVIFNHGYVAEDKEEEDCISEDDKPLVFKKTKVAPPSNETFVPQVKKGEQSSIQDNVANDPPLTDIQLVRQQASIVQQNEAPPSPIHLDHFQHQGPPVVDPNLKAEDIARLCFPVVYAYNIQRTMGAEFQPPIDWTRF

SEQ ID NO: 138339 - protein, 77 aa, Glycine max
  Coding DNA Sequence Number=SeqID_46654
MPYQGPKDNAALGLILYDWSRYYTKDVTTKSHALKLGIEFDQNDAMFFYYKDMYENSRLASTSNYDQEDNSNPKRMA

SEQ ID NO: 138340 - protein, 362 aa, Glycine max
  Coding DNA Sequence Number=SeqID_46655
  Gene Ontology: Mol. function=metal ion binding; Cellular component =cytoplasm; Biological process=ubiquitin cycle
  Homolog annotation: Hit_ID=A9PEV7; Match level="QueryCoverage=99%, HitCoverage=72%, E-value=3e-71, Identity=40%"; Hit description =Putative uncharacterized protein
  Pfam annotation: Domain name=ZZ; Domain location=247-301; Score=5.4; E_value=0.05; Accession=PF00569.8; Description=Zinc finger, ZZ type
  Pfam annotation: Domain name=zf-C3HC4; Domain location=103-140; Score= 8.9; E_value=0.0088; Accession=PF00097.16; Description=Zinc finger, C3HC4 type (RING finger)
  Pfam module annotation: Pfam domain module=ZZ::zf-C3HC4; Domain location=247-301::103-140
  Subcellular localization annotation: CTP_CleavageSite=57; ConfidenceScore=5.04e-01
MEEEKQSGFYSPQFDPDTCESQAKFGHSGIPSSSSNLNLTSNSCNVGTSECLEQSGSAANEGDDGTIYYDGESDIIGTPAKGKKMPQEELSVQRKLSVADVTCTMCKQLLFHPVVLNCGHVYCQTCVINIDDEMLRCKVCQSPHPRGLPKVCLELDHFLEEQFPEEYGQRRDAIELKQIKVKPDTPSSCSLDNGKRVENIDWWSDPDPKVHIGVGCDFCGDMLSKFLYFIDLDRWRPLYVVACLLLTNGVLMCDFSVQMFPIIGDRYRCIDCKEKMGFDLCGDCYASRSKLPGRFNQQHTSEHKFKLVPPNIIHNMMLRLATAQLGEGSIDLESIANIEVTSDGAALFDDGEDNHNDSEATN

SEQ ID NO: 138341 - protein, 56 aa, Glycine max
  Coding DNA Sequence Number=SeqID_46656
MASRFGLISNIIPRKTELRLKARVFRLWAITEYKNPPNEASSLQMLLIDEKLLKMI

SEQ ID NO: 138342 - protein, 89 aa, Glycine max
  Coding DNA Sequence Number=SeqID_46657
MSGSWDRVVWFQESGRDGCRKMIPELEQSNEDAWMRSGIKLLSMCFKSVSITQATKNSKACLKKESTCDIKKMLVFALYNAIMFGCFKA

SEQ ID NO: 138343 - protein, 33 aa, Glycine max
  Coding DNA Sequence Number=SeqID_46658
MEEGYAVNKAPMKGQSHSLRRLKERDPQGQMDR

SEQ ID NO: 138344 - protein, 352 aa, Glycine max
  Coding DNA Sequence Number=SeqID_46659
MIMRGQDIYSSQDEAITSPSSSESEEAKGKESSEEIYPREEGQPLMVKEECKETLVSTTTPLGLDIIPQVKELLDEGLVRKSLNPYTLLVPKIGIIRHQIPKIGDMMNVLSGATLFCKITHAPNIFKIRVDRDSLGVEERTPDFQELMDLRSNPFQVGGNDTILFPKGIGGISNHLSSFSIPLPFIFKKQRTPFMKIQGLQAPHGATSVKRIEIFIQSIDPGAWNAIVKGPFIHTKESNGELVPKEWDEIEDNEKRKRQDDHNNNNFTCFECDNASTTFDSSIDEQVTNVCLMTKSMDDSSTIEETEVNPVNRAMIVYKWQTWRSDVDAKERNEEKDAIEGTKESYLGFGSS

SEQ ID NO: 138345 - protein, 748 aa, Glycine max
  Coding DNA Sequence Number=SeqID_46660
  Gene Ontology: Mol. function=DNA binding; Cellular component=nucleus; Biological process=regulation of transcription, DNA-dependent
  Homolog annotation: Hit_ID=A7QAB5; Match level="QueryCoverage=99%, HitCoverage=99%, E-value=0.0, Identity=59%"; Hit description =Chromosome undetermined scaffold_70, whole genome shotgun sequence
  Pfam annotation: Domain name=LisH; Domain location=12-38; Score=35.8; E_value=1.5e-07; Accession=PF08513.2; Description=LisH
  Pfam annotation: Domain name=SSDP; Domain location=74-276; Score= -95.5; E_value=0.024; Accession=PF04503.4; Description=Single -stranded DNA binding protein, SSDP
  Pfam annotation: Domain name=WD40; Domain location=482-520; Score =8.2; E_value=3.1; Accession=PF00400.23; Description=WD domain, G -beta repeat
  Pfam annotation: Domain name=WD40; Domain location=542-580; Score =38.2; E_value=3e-08; Accession=PF00400.23; Description=WD domain, G -beta repeat
  Pfam annotation: Domain name=WD40; Domain location=585-624; Score =23.8; E_value=0.00063; Accession=PF00400.23; Description=WD domain, G-beta repeat
  Pfam annotation: Domain name=WD40; Domain location=667-704; Score =14.1; E_value=0.53; Accession=PF00400.23; Description=WD domain, G -beta repeat
  Pfam annotation: Domain name=WD40; Domain location=710-748; Score =27.5; E_value=5e-05; Accession=PF00400.23; Description=WD domain, G -beta repeat
  Pfam module annotation: Pfam domain module=LisH::SSDP::WD40::WD40::WD4 0::WD40::WD40; Domain location=12-38::74-276::482-520::542-580::585 -624::667-704::710-748
MAQNQSNWEADKMLDVYIYDYLMKRKLHAAAKAFVTEGKVSTDPVAIDAPGGFLYEWWSVFWDIFISRTNEKHSEAAAAYIETQQTKAREQQLQMQQLQLMQQRSAQLQRRDPNHPSLGGSINAMNSEGMLGQPPASVLAMKMYEERMKHPHSMDSEASPTLIDPNRMALLKSAASHQGQLVHGNSGNMSTALQQGRAPLTTDIKGEVNLGATPKSLPMDTSVYRQAILHSKSGLGSAGLNQGVTGLPLKGWPLASGIDQLRPNLGVQIPKPNLTAQNQFVLASQQQQVLAQAQAQNNLGNSNYGDMDPRRLSGLPRGSLSAKDGQSTRNDGSICSQMQSDSPKMKIAQSQHSLSQQQEQLQQQSNRKRKSGAANSTGTGNTAAPSPTSSPSTHTPGDGLNTASSMQHVQKSMMMYGTEATGGLASSSNLLDDMDRFGDVDALDDNVESFLSNDGGDGGNLYGTVKQSPAEQQKESSKGFTFAEVGCRRTRNSKVTCCHFSSDGKWLASAGDDMKAEHGTLVSNLRLICQTTAVDIWNMDTLETESTPAEHKSVITDVRFRPNSSQLATASTDKSVRLWDTTNPSRCLQEYSGHSSAIMSLDFHPKKTELFCFCDGENEIRYWNINSSTCTRVTKGVSAQVRFQPRLGRYLAAASDKGVSIFDVESDTQIYTLQGHPEPVSYICWDGNGDALASVSSNLVKSLELWNMTENKSMTITTHENVISALAQSSVTGMVASASHDNYVKLWK

SEQ ID NO: 138346 - protein, 60 aa, Glycine max
  Coding DNA Sequence Number=SeqID_46661
MPKDRGTCLDFRDCHHQKGGDCRQRITLNVLMMPKFHMRLKALFETKKLKIFKMDDQDSL

SEQ ID NO: 138347 - protein, 180 aa, Glycine max
  Coding DNA Sequence Number=SeqID_46662
MQKLPFHILHIVPGDPSRNKEVPHNRATRPKPPVIEIHAGGRGRSAAVDAHGDLQAVSSPEESRDPGGGPHQKGKPNWRRRQRRRRRRALLDPSIGDAVEGGSERGKGRESPKNGILVNGCWLLGVWEREWHESLNVRLRSFEESQATLFCYWFEEDKCFGLLSGGSWRKPERLQFAANE

SEQ ID NO: 138348 - protein, 288 aa, Glycine max
  Coding DNA Sequence Number=SeqID_46663
  Pfam annotation: Domain name=zf-CCHC; Domain location=206-223; Score =29.5; E_value=1.2e-05; Accession=PF00098.14; Description=Zinc knuckle
TGCTLSALACDSLLPRWLLEVSGLLGLSGPDVLSEVNMPPRNRHASDSISDETSTQPQNVAPRDHGRGGSHGQGRHGRGGGMPNVEVPRATRGNPTLAQLTANMKNMHETLRQLAHADPQAFIDEESWIFRGLAMSSKVLGRKHGKGGNSRESRKRSHLKTSCGGHKAMVVSALEMILVSIIKASMEVDSHRSLKLAQLIVGARSIGCYQCGQVEHFARSCPMPSFQSSSNRVATPMVKMGHSSGGKGQGMTSEGQAHVFTLIRQDAQLHTPLYLPFLHMLLGEIHHH

SEQ ID NO: 138349 - protein, 74 aa, Glycine max
  Coding DNA Sequence Number=SeqID_46664
MEMELSNKKGSPRVNLGFIEPWTGDMFALGFDKPVELHRGLLRMSLGFCEPVKLTKCEAWVYRALDRGHVCPGF

SEQ ID NO: 138350 - protein, 119 aa, Glycine max
  Coding DNA Sequence Number=SeqID_46665
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=65%, E-value=2e-33, Identity=100%"; Hit description=LacZ protein
MKYIMNSVITVLYFNGMIFSVWKGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 138351 - protein, 110 aa, Glycine max
  Coding DNA Sequence Number=SeqID_46666
MVSPQGRNMWTVDDLVPYVEKITILSEEQEIIIEPVAHGPSSERRFPPQEFHMLQSSVETRGVDLRHEFSAEAEQLEAGRHRGRRNPDRQARRWDRPCGTSSRHHGYHNE

SEQ ID NO: 138352 - protein, 193 aa, Glycine max
  Coding DNA Sequence Number=SeqID_46667
  Gene Ontology: Mol. function=cyclin-dependent protein kinase inhibitor activity; Cellular component=nucleus; Biological process =cell cycle arrest
  Homolog annotation: Hit_ID=A7QAB2; Match level="QueryCoverage=98%, HitCoverage=99%, E-value=1e-29, Identity=42%"; Hit description =Chromosome undetermined scaffold_70, whole genome shotgun sequence
  Pfam annotation: Domain name=CDI; Domain location=145-192; Score =94.9; E_value=2.5e-25; Accession=PF02234.10; Description=Cyclin -dependent kinase inhibitor
  Subcellular localization annotation: CTP_CleavageSite=70; ConfidenceScore=5.10e-01
MGKYMKKSKIAGDVAAVIMEAPPPHSHLGVRTRAKTLALQNTSPDSSAYLQLRSRRLLKLPPTPPENPRRSAAETAANSRLAKTTSSRNAEKFASFDDDNNTECSFGENFLDAEPREERDSNAIHTPGSTTRPRTRQIIHEHIQRNIPTAYEMEEFFAYAEKQQQTIFMDKYNFDIVNEVPLPGRYEWVPVLH

SEQ ID NO: 138353 - protein, 451 aa, Glycine max
  Coding DNA Sequence Number=SeqID_46668
  Gene Ontology: Mol. function=small conjugating protein ligase activity; Biological process=regulation of protein metabolic process
  Homolog annotation: Hit_ID=A7R4U2; Match level="QueryCoverage=96%, HitCoverage=57%, E-value=3e-59, Identity=35%"; Hit description =Chromosome undetermined scaffold_777, whole genome shotgun sequence
MIQDASTYDAYNEHGMARGYKRRNLNIWELFLIEKIKTKVDVVWHNGEHTSGLDPHNLVPMNVINTHEFWPQQFVLEKGASDDSLNPSKQRWGVVLSIDAKEHTVKVHWRTVPTSETDNLAGDTMIETMSAYELIEHPDYSCCFGDIVFKVAQKLGYEADKDNAKLVTDLNVEVPRINWDQISYPNKSVDNNYLSCISNVTGFEDGDVEVKWATGLTTKLMAMYDVELISDPISLMIPSSPPSSLYLELRSLQVYLCPYRLHVMKIFKLISTKVQLQPPIPYEANVEELTPEMIGSQPLDKKGKDLLDYDGYRDNSEKHPGESSSSSLPQAAFELFSSIKASIFKTLGVTSLYGKFSPVPAFEEGSESGYLDKKDLDTCGLESKSESHPVSKMKSSEDITLYCEVIRTHERNDFPVSLDNKNNSDQLKQFDVIDNCSDHHFFHEGKGLTSS

SEQ ID NO: 138354 - protein, 84 aa, Glycine max
  Coding DNA Sequence Number=SeqID_46669
MMYAIQLGEVRHKTDVKESSLNQSLTATVSLKLNIGVTGGVVVNPRIGVEGPLEDQEGLLAAEEKIDPPLERVDLVKSVVISLE

SEQ ID NO: 138355 - protein, 190 aa, Glycine max
  Coding DNA Sequence Number=SeqID_46670
MADSLPDSSNSLSKLSASVSGCLDIDGIPSPLPWGHQYHPTARAAKWIHFDFKHEFLQMLENNLFSGATHEDLMQQLRKFIKLTDMSLVHIFYGGVVSSHNRTSLDASCGGNIMLKPPTNAIKMIEDMCSNPYNNLRDMRIMKRGMNQVEKDDSQTKLGKQMQALTIKIETLMRAQAQVPITTTLFSVGS

SEQ ID NO: 138356 - protein, 34 aa, Glycine max
  Coding DNA Sequence Number=SeqID_46671
MMFGEFLATVSPEFKTPMNGILIAEEEFFFDACV

SEQ ID NO: 138357 - protein, 50 aa, Glycine max
  Coding DNA Sequence Number=SeqID_46672
MDNGYGSYGYEGRFKGVLIMERGCAGDNYSGQNEIVRENSDNDSERIVTT

SEQ ID NO: 138358 - protein, 50 aa, Glycine max
  Coding DNA Sequence Number=SeqID_46673
MVDASTSKAESELDASSDDEDSQPEDVVNSNGKEGYAHELVVTTRGPKEE

SEQ ID NO: 138359 - protein, 99 aa, Glycine max
  Coding DNA Sequence Number=SeqID_46674
MGPKSTLRFMRTLRPSLASLAQSTWSLLSNALAGLAELEGGGGGGSPLRRGFSIVGIRRASKEEDEDKECEMETETETEGYWWKKYDSFGEVWSSPATR

SEQ ID NO: 138360 - protein, 135 aa, Glycine max
  Coding DNA Sequence Number=SeqID_46675
GNIKVAHKTLKSQNSQNNSSISDLVGNSCSLHVYIAVCVSGLQQLVLDEIYHSPEKSALEDLKDKIYVSSIFGQDVLDIVSDIVDPALCIVQQLQYFRAGCPGHCIRHRGSCSFNSSFDILSCLVHCAARSDSLT

SEQ ID NO: 138361 - protein, 56 aa, Glycine max
  Coding DNA Sequence Number=SeqID_46676
MKESSFIEEGMNELKYDSILMVFLVWNLCVAHVDPMGWSILARLGNLNAPSIVSSQ

SEQ ID NO: 138362 - protein, 153 aa, Glycine max
  Coding DNA Sequence Number=SeqID_46677
MLRNLADYIIIPFLTYGMLRNLTNYATMLPFDFRGVTETYGLCINIFLFSGMSWNFTNCLMMGAKHLTRTKQRSHVIKQRSLDEIRLSRPPWRMSGKLKSDMEKLVRNYPWNFDQRILILKDLNPQESPKNIDLRWCHFWLQGEDIPPECRTN

SEQ ID NO: 138363 - protein, 297 aa, Glycine max
  Coding DNA Sequence Number=SeqID_46678
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMRQSALKLEVSAINCFKFHFEFYSPSLILNLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138364 - protein, 159 aa, Glycine max
  Coding DNA Sequence Number=SeqID_46679
  Homolog annotation: Hit_ID=Q6WAY4; Match level="QueryCoverage=86%, HitCoverage=25%, E-value=6e-14, Identity=36%"; Hit description =Putative uncharacterized protein
MGTNQNGKRFYQVKVKSLDVTSLKELGRLMGPLQRQAFHKVYGKILDLAAAEVFTKAVVSLTQYYDHPLRCFTFGDFQMVPTIEEFEEILGCPLGGIKPYLFSGFLPSLSKVAAVIGDSAKELDRMKKIRNGVVGLPRKYLEDKARDMASQEKWGPFAD

SEQ ID NO: 138365 - protein, 77 aa, Glycine max
  Coding DNA Sequence Number=SeqID_46680
  Gene Ontology: Mol. function=structural constituent of ribosome; Cellular component=chloroplast; Biological process=translation
  Homolog annotation: Hit_ID=Q32703; Match level="QueryCoverage=48%, HitCoverage=88%, E-value=1e-10, Identity=83%"; Hit description =Putative uncharacterized protein
MPFFVHGSIFWCPRRRGTTPIHPELGGYSGEQISSGDDGVGPVAQRIRARGYEPRCRGFESLLAHNRPKKGKDFSLW

SEQ ID NO: 138366 - protein, 146 aa, Glycine max
  Coding DNA Sequence Number=SeqID_46681
MEGERLTPLSPIGRTASQKPGHPLAAKPVPFPYQNSHAVPWRYTPPREREEEATDVSSLSAKVTNITGLSGVTRSGRVFAPPDLPVQPADVKGKGKVGEEQDGKAPYASNKDIPAKGLPEKKEGKKEVSLEEASEFLRIIQQSEFK

SEQ ID NO: 138367 - protein, 68 aa, Glycine max
  Coding DNA Sequence Number=SeqID_46682
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=70%, HitCoverage=41%, E-value=5e-10, Identity=57%"; Hit description=CTV.20
MSIMVSSEHSWEDCQSANGDIPYENLSYGQLISYVQKVALKICQDDKIQRQLAKEKAQTKKDLGSFCE

SEQ ID NO: 138368 - protein, 74 aa, Glycine max
  Coding DNA Sequence Number=SeqID_46683
MSVKNLVKRLGVHDKTNHTIISQSGSQCFARMLQPYGINIGLKEHSNCVTPKAYIPKSPSGPLPPDSGLTQKTF

SEQ ID NO: 138369 - protein, 170 aa, Glycine max
  Coding DNA Sequence Number=SeqID_46684
  Homolog annotation: Hit_ID=Q6UUU1; Match level="QueryCoverage=35%, HitCoverage=40%, E-value=1e-18, Identity=78%"; Hit description =Putative uncharacterized protein
MNISFLDLSVIIFQPHILHESWHHHAYAFNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138370 - protein, 256 aa, Glycine max
  Coding DNA Sequence Number=SeqID_46685
SEFLIGGYVGARASLLSIAPLFVTMTQELVARGDTLRLSAPRHSVTPSVIDEQRPIWSYAPFPEMSASSGGDFFKSHKICHTDLRSCNMRRQIWSFRTPLPFRHSRVRWHAETKFGHSAPFCHPEAAGPMTCGDKIWSFRTPLPFRHSRVRWHAETKFGHSAPFCHPEAADPMTCGDKIWSFCTPLPFRHSRVRWHAETKFGHSAPFCHPEAAGPMTCGDKIWSFRTPLPFRHSRVRWHAETKFGHSAPFCHPEAA

SEQ ID NO: 138371 - protein, 163 aa, Glycine max
  Coding DNA Sequence Number=SeqID_46686
VLFPNMEGLVDLAVIDAFLTFHHGKESPVVAILAMYDTFDRGCPSIRYKEGRIGILSSCEGCPNVPLMGTRVTTTRGYSKEFARHGMRHEERTESLWEATVRDNEVKASEESDEVQALKAKLERARVVKEKFKAAIVSSSSEEVKGIITGQRHDLEGRAKGLP

SEQ ID NO: 138372 - protein, 18 aa, Glycine max
  Coding DNA Sequence Number=SeqID_46687
AETINPALSMPELKATNS

SEQ ID NO: 138373 - protein, 53 aa, Glycine max
  Coding DNA Sequence Number=SeqID_46688
MAAEWRRRKGNWRRHFKEKMSQEQAHHHRSSLIQDQVQDSPLSVLRCHEACKA

SEQ ID NO: 138374 - protein, 171 aa, Glycine max
  Coding DNA Sequence Number=SeqID_46689
  Gene Ontology: Mol. function=ATPase activity, coupled to transmembrane movement of substances; Cellular component=integral to membrane; Biological process=proteolysis
  Homolog annotation: Hit_ID=A6TH56; Match level="QueryCoverage=62%, HitCoverage=15%, E-value=5e-49, Identity=86%"; Hit description =Putative secretion ATPase
  Pfam annotation: Domain name=Peptidase_C39; Domain location=53-152; Score=44.8; E_value=3e-10; Accession=PF03412.6; Description =Peptidase C39 family
MSEYTNVSNGTNQQQELALYKAIVKIKDKQFEYDGKKLSLSNGLKAQAVVFLEERPLYMWMFTPGVTLMSLSKTAEHAGLKSRALSLDLDEIRQLKLPCVIHWGMNHYVVLTKVRKSSFVVHDPALGKRIIGIQEMSNNFTGIALELWPDQNFQQEKAKSRLRLLDLMRNI

SEQ ID NO: 138375 - protein, 335 aa, Glycine max
  Coding DNA Sequence Number=SeqID_46690
  Gene Ontology: Mol. function=RNA-directed DNA polymerase activity; Biological process=regulation of transcription, DNA-dependent
  Homolog annotation: Hit_ID=A5BT29; Match level="QueryCoverage=98%, HitCoverage=36%, E-value=6e-29, Identity=28%"; Hit description =Putative uncharacterized protein
MLSDNFSIDKETLRTNFYSPENEPQRRWFFQNYKGTNKKQIQDKFYKFVERVKVNVLFFDWFHAYSIKNDIDYPWKQDIIGDPSTNVITNWQVRYGEIIQSELPPTTKYQLPNIKDSNNKPVMATPFKTKDINEEVTSEDIKSLMEQANYTNKYLQILGETIKTKVVPKQKSIEETSPSIPIEKPLFKPFKVSEKAKRKIRELRKTKSLVEGVGDNHSELLNKIGSLLKVIPETPQTSENTSKMVTRSTSKLINVINEDSDQNSDNTTEIGSVSEKNINPINFKHWKTPSKLYYQRPTAPDLLLEERGENNFKSFSANNIYEWNIDAQTEYNIMN

SEQ ID NO: 138376 - protein, 83 aa, Glycine max
  Coding DNA Sequence Number=SeqID_46691
VDSRGSPSKLEGGGHMNENTIQGSPKKGENGELHYAITTHGSELEGGGHMNDNAIHGAPKRMRMENCTKQSLRIAPNSKVEDT

SEQ ID NO: 138377 - protein, 242 aa, Glycine max
  Coding DNA Sequence Number=SeqID_46692
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLKHPAQGKDVGWEAKPVLSCFFMFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138378 - protein, 125 aa, Glycine max
  Coding DNA Sequence Number=SeqID_46693
MDRARLVYGLVTHMDMNIGALILGQISSIAQSNSSRLGFPALINALYRARGVTSDSLTYESLSSAINLAYIKKNCWNLGDLTVNFRGARKARARLADVPSSSTPPPPSTSTTPAPAPPGPSTQGL

SEQ ID NO: 138379 - protein, 618 aa, Glycine max
  Coding DNA Sequence Number=SeqID_46694
  Gene Ontology: Mol. function=methyltransferase activity; Cellular component=cytoplasm; Biological process=peptidoglycan-based cell wall biogenesis
  Homolog annotation: Hit_ID=P60391; Match level="QueryCoverage=46%, HitCoverage=91%, E-value=1e-146, Identity=91%"; Hit description=S -adenosyl-L-methionine-dependent methyltransferase mraW
  Pfam annotation: Domain name=FtsL; Domain location=417-513; Score =211.0; E_value=2.9e-60; Accession=PF04999.4; Description=Cell division protein FtsL
  Pfam annotation: Domain name=Methyltransf_5; Domain location=109-398; Score=551.8; E_value=7e-163; Accession=PF01795.10; Description=MraW methylase family
  Pfam annotation: Domain name=MraZ; Domain location=19-59; Score=8.1; E_value=0.0077; Accession=PF02381.9; Description=MraZ protein
  Pfam annotation: Domain name=MraZ; Domain location=60-126; Score =68.9; E_value=1.6e-17; Accession=PF02381.9; Description=MraZ protein
  Pfam annotation: Domain name=PBP_dimer; Domain location=511-618; Score=77.3; E_value=5e-20; Accession=PF03717.6; Description =Penicillin-binding Protein dimerisation domain
  Pfam module annotation: Pfam domain module=FtsL::Methyltransf _5::MraZ::MraZ::PBP_dimer; Domain location=417-513::109-398::19 -59::60-126::511-618
NVNFASPVVQLLTRGETGMFRGATLVNLDSKGRLSVPTRYRDQLIENAAGQMERRVQRLLLGHASECQMDNAGRLLIAPVLRQHAGLTKEVMLVGQFNKFELWDETTWYQQAVNGLNIRPDGIYIDGTFGRGGHSRLILSQLGEEGRLLAIDRDPQAIAVAQTINDPRFSIVHGPFSALAEYVAERGLTGKIDGILLDLGVSSPQLDDAERGFSFMRDGPLDMRMDPTRGQSAAEWLQTADEADIAWVIKTFGEERFGKRIARAIVERNRIEPMTRTKELAEVIAAATPVKDKHKHPATRTFQAVRIWVNSELEEIELALKSSLDVLAPGGRLSIISFHSLEDRIVKRFMREQSRGPQVPAGLPMTEEQLRKLGGRQLRALGKLMPGEEEDERMIGRVTETLSKVKDSLGSNERHALPGVIGDDLLRFGKLPLCLFICIIVTAVTVVTTAHHTRLLTAQREQLVLERDALDIEWRNLILEENALGDHSRVERIATEKLQLQHVDPSQENIEVSTSRGMITDRSGRPLAVSVPVKAIWADPKELHDAGGITLDNRWKALSDALKMPLDQLASRVNANPKGRFIYLARQVNPDMADYIKKLKLPGIHLREESRRYYPSGE

SEQ ID NO: 138380 - protein, 46 aa, Glycine max
  Coding DNA Sequence Number=SeqID_46695
MYGCDNLSLFAQSMGCPKRLTEPNQLSYPNFVRGPLLDDMRPLFGP

SEQ ID NO: 138381 - protein, 31 aa, Glycine max
  Coding DNA Sequence Number=SeqID_46696
MKSLRGKEIALVKVQWGNDEEVGIAGARYAG

SEQ ID NO: 138382 - protein, 149 aa, Glycine max
  Coding DNA Sequence Number=SeqID_46697
  Subcellular localization annotation: CTP_CleavageSite=96; ConfidenceScore=5.35e-01
MASIIVAICSFMASMLAFTFSCTSSALPITLALTQISNTVHDIFVKVKQEVTGTSTALNVFGSRRSSDVTRSIFCPNFCKMVTSILQLDSMNLFVKARAWFNPITQGMAILIANTSSTFHKDERLGNTHAMHGKCNYEIEMPEETSFLS

SEQ ID NO: 138383 - protein, 56 aa, Glycine max
  Coding DNA Sequence Number=SeqID_46698
MAISEMKRKVKKKKIASYSSRFDEEMSKIGRFGGGGSLLVIDYMNTVIDYRPSVLV

SEQ ID NO: 138384 - protein, 234 aa, Glycine max
  Coding DNA Sequence Number=SeqID_46699
  Gene Ontology: Mol. function=nucleic acid binding
  Homolog annotation: Hit_ID=Q2AA09; Match level="QueryCoverage=70%, HitCoverage=52%, E-value=2e-10, Identity=31%"; Hit description =Retrotransposon gag protein
MEGLQLSAVSGVVVVVGLVEECHNCSAVVDFAAEVEEVYCKYLQHKLQATQLLQVAAWKGKGLTQYMERSMIDAASGGALGDMTPAEARNLIEKMASNSQQFSARNDAIVIRGLHEVATNSAASSETKKLEGKLDALVNLVTQLALNQKSVPVARVCGLCSSANHHTDLCPSMQQSGAIEQPEAYAANIYNRTPQPQQQNQPQQNNYDLFSNRYNPGWRNHPNLRWSSPQQQQQ

SEQ ID NO: 138385 - protein, 218 aa, Glycine max
  Coding DNA Sequence Number=SeqID_46700
MRGAPTEESLSPFLVRDLGAQGLKVIQRIHKAWRSPLRKDKELRGIRNDVIGGYHGWLRIHTRGLDWLSKLKVIDEENFEAPEEDEEVRALKLELGKARLAKEKFKSAATHIRKECTELQEENATTAKALEQETKRARKEEYGREKFQGALWGSNNELKLRREERDRSWVHGMILKEELVACARSKRSLAQHLEAMEQSMLAIIGQYKEELNQLVAHE

SEQ ID NO: 138386 - protein, 29 aa, Glycine max
  Coding DNA Sequence Number=SeqID_46701
MAPPEEIATIIYHNGHIVDDLVQGSMYTS

SEQ ID NO: 138387 - protein, 129 aa, Glycine max
  Coding DNA Sequence Number=SeqID_46702
TYQAYSQYVRPQGDAPVSLLFPLVYEVFFELQWLSWFLSAVPSCSATDGVVRSQFGTQAYRAGHQRGKCSGVPNDAAANHPPAGLMLPLSAPIRHSAAQLFGKGRSVRASSLLMNRPTRRKGDVLQVCD

SEQ ID NO: 138388 - protein, 154 aa, Glycine max
  Coding DNA Sequence Number=SeqID_46703
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=55%, HitCoverage=72%, E-value=3e-24, Identity=66%"; Hit description=LacZ protein
  Subcellular localization annotation: CTP_CleavageSite=38; ConfidenceScore=5.46e-01
HSKPVYTPASAQYANRLSPRVGRFINAAGTTGFPTGKRAVSATQLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVR

SEQ ID NO: 138389 - protein, 82 aa, Glycine max
  Coding DNA Sequence Number=SeqID_46704
MSSLSICDVLESDLRVKNLSSFTGSGVYPDSSSLTGSGVYPDLSSFTGSGVYHDLSSFTGSGVIQTFVTCIKRSTPYGSHQL

SEQ ID NO: 138390 - protein, 189 aa, Glycine max
  Coding DNA Sequence Number=SeqID_46705
  Subcellular localization annotation: CTP_CleavageSite=37; ConfidenceScore=5.52e-01
MVKVGTSYVPINVSFSPKVGSCQGPITTPRILSDLRMCSSGVSWFLSAVPPVQLLTGWCRSQFGTQAYTPDISAGKARFPFGNHVRLRNCIKTANARAIECGPFAYYARALSGCVQLAITMLALITPGCPSRMRSWQKKRTGASVRICRYRTHIGPRIPVTELATARSSCGDAEQWLPQRGRNFRKDAR

SEQ ID NO: 138391 - protein, 102 aa, Glycine max
  Coding DNA Sequence Number=SeqID_46706
  Subcellular localization annotation: CTP_CleavageSite=66; ConfidenceScore=5.06e-01
MHCRPQTHRHHLIRLIQLGHLAWSGIYSTWFASRRPTTGGRCRYMNVFTSSASFRAEVACPGDWPEAQAGEAPVEAPGDTEEARMDEEMTNLLDFLGGSGAT

SEQ ID NO: 138392 - protein, 107 aa, Glycine max
  Coding DNA Sequence Number=SeqID_46707
MENCTRQSLRMAPNSLVEESIGKITKTTFFSQEDPHLTAITTHGSKLVSGGCMKDKSIHGAPKKVVGRTKWSTGFFPPKKANMLFGKKNKSFASAPYLIETTYSCQG

SEQ ID NO: 138393 - protein, 121 aa, Glycine max
  Coding DNA Sequence Number=SeqID_46708
  Homolog annotation: Hit_ID=Q949K7; Match level="QueryCoverage=32%, HitCoverage=44%, E-value=3e-08, Identity=64%"; Hit description =Putative gag polyprotein
MGETHEIPHHNLADFEPWLGYATEGQAVGGIPFENTLESPQYHPQLHLLHSTAVKNHHAMAEMGKRKGSGPLKELFLVPNITTPPKFKVLDFDKYKGTTCPKNHPKMYCRKIRAYTKMRNC

SEQ ID NO: 138394 - protein, 278 aa, Glycine max
  Coding DNA Sequence Number=SeqID_46709
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGELELHRGGGRSRTSGSPGLQEFDPQSGKYWLKKADSQREKSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138395 - protein, 58 aa, Glycine max
  Coding DNA Sequence Number=SeqID_46710
EGEALTDSSQCRPWGSFDLSAPLSLCRSYMVGAFSQNIVTPTGLPMISLSESDLTYPL

SEQ ID NO: 138396 - protein, 83 aa, Glycine max
  Coding DNA Sequence Number=SeqID_46711
  Homolog annotation: Hit_ID=UPI0000ECBAF8; Match level="QueryCoverage =51%, HitCoverage=50%, E-value=1e-17, Identity=100%"; Hit description= UPI0000ECBAF8 related cluster
FYKDSGNLKRFAWGLNSGRHRGGAPIRPIVSRITIHWPSFYNVVTGKTLALPNLIALQHIPLSPAGVIAKRPAPIALPNSCAA

SEQ ID NO: 138397 - protein, 265 aa, Glycine max
  Coding DNA Sequence Number=SeqID_46712
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLDYLKFSTATVAADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138398 - protein, 144 aa, Glycine max
  Coding DNA Sequence Number=SeqID_46713
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=4e-25, Identity=55%"; Hit description =Putative uncharacterized protein
  Subcellular localization annotation: CTP_CleavageSite=38; ConfidenceScore=5.31e-01
MTMITPSSKLTLTKGNKSCLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138399 - protein, 150 aa, Glycine max
  Coding DNA Sequence Number=SeqID_46714
MASNSHQFSARNDAIVLRGVHDVQFEVNEQPEAYATNIYNRPPQQQNQQQQNNYDLSSNIYNPGWRNHPNLRWENPPQPQQQQQQPIPLFQNAAGPSRPYVPPPMQQQQQRQQETEAPSQPSLEELVRQMTIQNMQFQQETRAFIQSLTN

SEQ ID NO: 138400 - protein, 259 aa, Glycine max
  Coding DNA Sequence Number=SeqID_46715
MAPKKLSTKRSRRDATAEGSSAAPKFDSHRFQSAEHQQRFEAIKGWSFPRERRIHLREDEYTYFQEEIARRRWTPLVTPMAKFDPEIVLEFYANAWPTEEGVRDMRSWVRGQWIPFDANALNQFLGDPLVLEEGQQCEFSQRRKRADGFDEEAIAQLLCTTGQDFARTAVGRRRSQLREVIRPLITRAFIEKYCTPRQAQGDAHQATNALPPPRQADPTGSLGMERYLQHLVHQQAANHRGQVQIHECLYRFSLSQQGQ

SEQ ID NO: 138401 - protein, 88 aa, Glycine max
  Coding DNA Sequence Number=SeqID_46716
MQSSKCDVYIGAYLNGPNNYFKGIINSALKGLDDAPQPKSKAPTRWIVVKAAVSPTKPPQKPDPEVDDPLYLMTSTITKLFLRLYQVT

SEQ ID NO: 138402 - protein, 193 aa, Glycine max
  Coding DNA Sequence Number=SeqID_46717
MQSPIMSSPLGGDFLFSEGEVVVGRDVIDDSPKAFYGDVLGYMSFIQDFYQQSSMRPRAHEQFQKEDSSWGFVDLFNDLELALLDNVEELVGLLERYLFLATTFTSLGKILRRNILVRCEDHFDVLSFRHPCFPFSVRGLYWQARGANMRPLRVMPLSPVILVTLADSELILVASSFLMPRGAYLHGIARLFS

SEQ ID NO: 138403 - protein, 100 aa, Glycine max
  Coding DNA Sequence Number=SeqID_46718
MTSEATKEIADKIDSLEEQSSQGSFVAHGRYVVLTTAIGRLEYPRHVCVAGAGVTIKQYSLSMAPRKRRVVLISQGTIKTWVTQRNAGYTSKKILPAWLP

SEQ ID NO: 138404 - protein, 186 aa, Glycine max [sequence omitted]

SEQ ID NO: 138405 - protein, 54 aa, Glycine max
  Coding DNA Sequence Number=SeqID_46720
MPMFEPSYKRNGVEGQILDLDTVVKDGVLGGGVDFGVVRNKIIVNALSSSPPTP

SEQ ID NO: 138406 - protein, 125 aa, Glycine max
  Coding DNA Sequence Number=SeqID_46721
  Homolog annotation: Hit_ID=Q2AA09; Match level="QueryCoverage=48%, HitCoverage=21%, E-value=3e-07, Identity=45%"; Hit description =Retrotransposon gag protein
  Pfam annotation: Domain name=Retrotrans_gag; Domain location=1-90; Score=13.3; E_value=0.0028; Accession=PF03732.8; Description =Retrotransposon gag protein
EAKRWLHSFKGNSLKTWEEVVEKFLKKYIPKSKTAEGKAAISSFHQFPDESLSEALERFKGCTIYGEAHEIGQCIPIEENTQEIHYMGNQQRQGYTQGGFSGFQQGSYNQQGQWRSHPGNQFNKD

SEQ ID NO: 138407 - protein, 102 aa, Glycine max
  Coding DNA Sequence Number=SeqID_46722
MGRFHWDHITQHPIIISLNGETHLNLLSHFYLFIFHFFFIDFRLTSDFSISLHEHGPPVLDEEVEVLCLLPPTLDTADFPCGDVATGLDKLPPSFLDLLAQF

SEQ ID NO: 138408 - protein, 137 aa, Glycine max
  Coding DNA Sequence Number=SeqID_46723
STTKGAPKKPINRNQRSTKRDLSYWEYVDAFHSIQNRNSSVKRSASSSDPLKPTRIIPMLDQFEPFIQGFIDNIVDVKANGNCGYRSIAALLELGKWSHDYINLFGGTERFDELRLSLLVDGFSKVSVDKWMDIMKM

SEQ ID NO: 138409 - protein, 104 aa, Glycine max
  Coding DNA Sequence Number=SeqID_46724
MGNCDERPKVALSPIPTERKCAECPEGYKYVLSMKNTIFTLLFPQKRLPNPKTLFSTTQDHWLPPLLAVGSPHQEEHFNRSRILKILLEDSMEKTPQSSISKFL

SEQ ID NO: 138410 - protein, 55 aa, Glycine max
  Coding DNA Sequence Number=SeqID_46725
  Homolog annotation: Hit_ID=A7R0J7; Match level="QueryCoverage=80%, HitCoverage=9%, E-value=1e-07, Identity=63%"; Hit description =Chromosome undetermined scaffold_310, whole genome shotgun sequence
MDVASNGRNFKTIVKKTENVVIVEEQRVEKLREMSPLYEFVKEGINIKDIQWAQH

SEQ ID NO: 138411 - protein, 202 aa, Glycine max
  Coding DNA Sequence Number=SeqID_46726
MAKINQGKTMTGHDWPCIFVSYLQVHRDGSSGARVMTDRLLPLPGAKRAENVAARQPKMAPRKLASKRSRKDKAAEGTSSAPEYDSHHFRSAEHQQRFEAIKGWSFLRERRVQLRDDEYTDFQEEIGRRRWASLVTPMAKFDPEIVLKFYANAWPTEEGVRDMRSWVRGQWIPFDADAIGQLLGYPLVLEEGQECEYGQRRN

SEQ ID NO: 138412 - protein, 56 aa, Glycine max
  Coding DNA Sequence Number=SeqID_46727
MLEAATATTLASIIFFMLIMASIIAAICSCTSSTSPITLAQLRNGFIIPTWLAHGT

SEQ ID NO: 138413 - protein, 179 aa, Glycine max
  Coding DNA Sequence Number=SeqID_46728
VHGISMIIDQSLLFSLTKLPSQGAPFEGTIVDDWKFDYSSHDARRMVCNDQSEMTGGLDFDVGFLTGRQIDWAYLVRYRMHKALRANAPLPYPQLVTLFLHHFQIPLDDEPFVQVKRSFAIGAGAVTSFGYRKDRNGQWLKKDALPPQDERTPSPPPQRDDSALMTEVLSELRGLRTYV

SEQ ID NO: 138414 - protein, 56 aa, Glycine max
  Coding DNA Sequence Number=SeqID_46729
MSVKNHPGALRRRPVRVTMFCENAPTIWDQHRLKGALKPDDPQGLHSEESVRASPS

SEQ ID NO: 138415 - protein, 188 aa, Glycine max
  Coding DNA Sequence Number=SeqID_46730
  Homolog annotation: Hit_ID=Q2HW90; Match level="QueryCoverage=65%, HitCoverage=29%, E-value=4e-13, Identity=35%"; Hit description =Putative uncharacterized protein
MEPIASLSQYYDQPLRCFTFEDFQLVPTVKEFEEILGCPLGGRKPYLFSGFYPSTTRVAKVVKISAQELDRANGLSFIDILALLIFGVVLFPNMEGLVDLAAIDAFLAFHHGKESPVVAILAMYDTFDWGCEKSGARIEGRIRILSSCEGCPMRGVPSDESITPFIARGFSDHNARVLQGVRKAWDAA

SEQ ID NO: 138416 - protein, 43 aa, Glycine max
  Coding DNA Sequence Number=SeqID_46731
SVDQHEKVQDLLKAIDDQFITSDRDLVMQSYPPRALDRRLQED

SEQ ID NO: 138417 - protein, 48 aa, Glycine max
  Coding DNA Sequence Number=SeqID_46732
  Gene Ontology: Mol. function=binding; Cellular component=chloroplast; Biological process=photosynthesis
  Homolog annotation: Hit_ID=P61843; Match level="QueryCoverage=93%, HitCoverage=26%, E-value=9e-09, Identity=64%"; Hit description =Photosystem I assembly protein ycf3
NSNEGVNADALFPFSEGEQAIRQGDSEVAESWFNQAAEYWKQAIALTP

SEQ ID NO: 138418 - protein, 84 aa, Glycine max
  Coding DNA Sequence Number=SeqID_46733
  Homolog annotation: Hit_ID=A5BIL3; Match level="QueryCoverage=78%, HitCoverage=4%, E-value=3e-10, Identity=45%"; Hit description =Putative uncharacterized protein
MEDMIRDLGQEGFLEAHAPYYEDLETDSKLPLYLGCTTFTRLSAVLALVNLKARFGKEFVELRNCPTCGVSRYNQNDAGNTLMM

SEQ ID NO: 138419 - protein, 107 aa, Glycine max
  Coding DNA Sequence Number=SeqID_46734
MEALAEIAYYRLSFALLTPLRKVEMGAQLLVVFVVVAAIAALEEEHMACLDQQHSGREGQAIVVVEDLPISDLDDSSNLDCICCLKAEASGCSLTPDCCKEGQRSVW

SEQ ID NO: 138420 - protein, 218 aa, Glycine max
  Coding DNA Sequence Number=SeqID_46735
  Homolog annotation: Hit_ID=Q84VH5; Match level="QueryCoverage=78%, HitCoverage=29%, E-value=4e-75, Identity=75%"; Hit description =Envelope-like protein
GVVDIAVSEHQIAKEITAKQVQHWPKKGKLSAGKLSVKYAILHRIGAANWVPTNHTSTVATESFAVKLPIAFPTVLCGIMLSQHPNILNYTDSVMKRESPLSLHYKLFEGTHVPDIVSTSGKAAASGAVSKNALIAELKDTCKVLEATIKATTEKKMELERMVKRLSESGIDDGEAAEQEDEAAEEEVEAAEEEEEAAEEEEDAAEDTESDDDSEATP

SEQ ID NO: 138421 - protein, 127 aa, Glycine max
  Coding DNA Sequence Number=SeqID_46736
MTRGNPSDLQPFDPEIDRTLHRLVRHHFIPFDHSEHSITGESVHSVIGDFEHPDLKHYNFEHSDSNHSDFAHSENMAQPPPRERTLREMAAPDFTYESLCIQYPDEDVPYVLKTGLIHLLPKFHGLA

SEQ ID NO: 138422 - protein, 66 aa, Glycine max
  Coding DNA Sequence Number=SeqID_46737
MTGDASKFTTISPRKSGHETYSDNNRGLKHSLLSVSQLCDRSCMMIINVFLAKTMILGYGIKGSLT

SEQ ID NO: 138423 - protein, 70 aa, Glycine max
  Coding DNA Sequence Number=SeqID_46738
MACSVSASCPYSRDLYGRQLTRLLVIIPKVVISLLMVSRGIIPFKEHIAAVGTTSNNMLSKRKTLDEGSL

SEQ ID NO: 138424 - protein, 72 aa, Glycine max
  Coding DNA Sequence Number=SeqID_46739
MKSDKASQDIHSISQACSELQNKERETRLKRAIKGINSRTHQQESSQGYCASNQWGKTHQMIIMMDGSNSHK

SEQ ID NO: 138425 - protein, 94 aa, Glycine max
  Coding DNA Sequence Number=SeqID_46740
AQVVPPMTEREMITIMVDTLPTFYYEKLIGYMPANFADLVFARERIESGLRKGKFEYASNVVPNNSRRAPVVGTRKKEGDTHAVTTTPTWMKTP

SEQ ID NO: 138426 - protein, 153 aa, Glycine max
  Coding DNA Sequence Number=SeqID_46741
  Subcellular localization annotation: CTP_CleavageSite=12; ConfidenceScore=5.16e-01
MLVRMIRTCLFAAAQVKSCPGMHSSCVIASLPGCARTVGPPPISGGGPGIVWMSSTLKMRTRSPLKARACSPLKFRTCRLSKARECSPMMARTCNPLKVRTCSPLTVRVTSTQGEGRVALSRRGRVVLSTVRVTSTRGRVVLSSEDVSPLNGE

SEQ ID NO: 138427 - protein, 81 aa, Glycine max
  Coding DNA Sequence Number=SeqID_46742
NDEQDQRKGKEVAGKGSAGKRKGAFDDNMQDRWRPKEKQARCPLVISDDELNAAPRRMDMPDKGQSSRPRVVPQEEMLARN

SEQ ID NO: 138428 - protein, 192 aa, Glycine max
  Coding DNA Sequence Number=SeqID_46743
ESHLAVQFMEEISSVPIQRQDKDTLLWMAEPNGQYTTKDDNKPPPLDLAVSDTIHKEDDMSGGGLPPGISQTFGPVLSITSLLILKKVMDDALFHTWSWLNQNQVGKDKWREDDLTLQEKYPILYQVSNGSVGAIGKNEQWQMEAAGYLNCGGTFKSNIQIGSNSEAISMGRRCGIEKDCLGSLENSLQSKE

SEQ ID NO: 138429 - protein, 78 aa, Glycine max
  Coding DNA Sequence Number=SeqID_46744
  Subcellular localization annotation: CTP_CleavageSite=40; ConfidenceScore=5.58e-01
MKGKTHATFAQKINRPNSLKIVPNGVANCRNLPFGGRATRGLTGVSSKGGRRPESPPSIFEENVGKTGKVWSTNFKCE

SEQ ID NO: 138430 - protein, 137 aa, Glycine max
  Coding DNA Sequence Number=SeqID_46745
GKPVVPAALMNRPTRGERRFAYCALAECILAYYVGTDEGVSEVLHVAFPPGGSLVRSPVPAFRFTGVIPLLWPRLSHSTPDTQFRVGSSLQAGLYARTPRSVRPLRLIRHAPVKAKLKGQVLVTALLQASYLGSKSW

SEQ ID NO: 138431 - protein, 116 aa, Glycine max
  Coding DNA Sequence Number=SeqID_46746
MAPRKLSTKRSRKDAATEGTTAAPEFDSHRFRSAEHQQRFEAIKGWSFHRERCVQLRDDEYTDFQEEIAHWRWTSLVTPMPKFDPDIVLEFYANAWPTEEGVRDMRVMGKGPVDSF

SEQ ID NO: 138432 - protein, 105 aa, Glycine max
  Coding DNA Sequence Number=SeqID_46747
MLVRMIQTRLFAAARVLTPVCIVRQCNSLPLWVEDSVALLSTPSWAEDALNPLKARSVVLSTVKGPLMVRTCSPLKARTCSPLNGEGNCSPLKVRACSPLEGEDM

SEQ ID NO: 138433 - protein, 326 aa, Glycine max
  Coding DNA Sequence Number=SeqID_46748
  Gene Ontology: Mol. function=hydrolase activity, acting on ester bonds; Biological process=lipid metabolic process
  Homolog annotation: Hit_ID=A6EJK6; Match level="QueryCoverage=73%, HitCoverage=54%, E-value=7e-57, Identity=49%"; Hit description =Putative uncharacterized protein
  Subcellular localization annotation: CTP_CleavageSite=98; ConfidenceScore=5.07e-01
MAFAAGNNDALGWATNGGVEDGPTSTLTSTALFTTLLGNYVTTLTAGGQKGVLATIPDVTATPYFTTVTRAALLAAVNATNPPTPVTNIYIATKSGPRAATDQDYFVLPFSSMGLLGKPNEAQIPYGLHPLNPVEDKYVLDVSETATVVQRINEYNAAIKAAADSKGLALADVHGFLNNVKGGVRINGLAVSAKYITGNAFSLDGIHLTPIGNALMANIFISAINSKYGSKIPQVDVAKYRGVKLPDTISIRSVVTNDGLFAKLASSELSPVKVNIDGSEAIGGEGKGVRPMELVLMALGSCSVFDLHSILVKQRQQIDDIQVEVE

SEQ ID NO: 138434 - protein, 295 aa, Glycine max
  Coding DNA Sequence Number=SeqID_46749
  Gene Ontology: Mol. function=nucleotide binding; Cellular component =intrinsic to membrane; Biological process=defense response
  Homolog annotation: Hit_ID=Q6R271; Match level="QueryCoverage=97%, HitCoverage=81%, E-value=1e-79, Identity=67%"; Hit description =Disease resistance protein
MKEWEEWECKGVTGAFPRLQRLSIKDCPKLKGHLPEQLCHLNDLKISGCEQLVPSALSAPDIHELVGGSLLSAFLQVAFEKLASLQVRGFFRGRKLDEKLLNNLEIKLNSIQALADDAELKQFRDPLVRNWLLKVKDAVFDAEDILDEIQHEISKCQVEVEAEAESQTCTCNVPNFFKSSPASSFNREIKSRIEQVLENLENLARQSGYLGLKNASGVGSGFGGAVSQQSQSTSLLVESVIYGRDDDKEMIVNWLTSDIDNCSELSILSIVGMGGLDEFDVFNVTRTFLWKSLNH

SEQ ID NO: 138435 - protein, 20 aa, Glycine max
  Coding DNA Sequence Number=SeqID_46750
MAEGHRVWMMRLPEREDKSG

SEQ ID NO: 138436 - protein, 88 aa, Glycine max
  Coding DNA Sequence Number=SeqID_46751
  Gene Ontology: Mol. function=structural constituent of ribosome; Cellular component=large ribosomal subunit; Biological process =translation
  Homolog annotation: Hit_ID=Q5ZDK4; Match level="QueryCoverage=56%, HitCoverage=17%, E-value=7e-09, Identity=66%"; Hit description=50S ribosomal protein L22-like
MWEDEFVRCSQFPSLILKDKAVAPRKGHSPKKVNLVAALVRGMLVKDASMQLESTIKRAAKTVYQVKEFHRRVGFEVASADKMAKSCM

SEQ ID NO: 138437 - protein, 58 aa, Glycine max
  Coding DNA Sequence Number=SeqID_46752
  Gene Ontology: Mol. function=long-chain-fatty-acid-CoA ligase activity; Cellular component=membrane; Biological process=fatty acid metabolic process
  Homolog annotation: Hit_ID=A7MKE0; Match level="QueryCoverage=100%, HitCoverage=10%, E-value=2e-22, Identity=82%"; Hit description =Putative uncharacterized protein
MTTNNYFRGEAVKKVWLNRYPADVPAEINPDRYQSLVELFEHATTRYADQPAFINMGE

SEQ ID NO: 138438 - protein, 65 aa, Glycine max
  Coding DNA Sequence Number=SeqID_46753
MQQRGIGVSEWTIAYMAGMARAIRASQTGDLGQESDCRRCKSATHFLGTSANFGTCAWQRHVLSS

SEQ ID NO: 138439 - protein, 61 aa, Glycine max
  Coding DNA Sequence Number=SeqID_46754
MPLVEGDLEAVATPKEEPRSSEASSSFPIIGHSHIELVEDPIMAEEPRRVTLEDYSSSSVP

SEQ ID NO: 138440 - protein, 216 aa, Glycine max
  Coding DNA Sequence Number=SeqID_46755
MHLLRQRAQRISAPLRVIVTMARPPAKARITQAQHRIVRAQLRQRGVGARQRQHLATRINKAPAGFDFAALARRQRTEAQVAPRVILLPERRKQRFMLIVLRAKAKHQLQLMPPGFHLTGRKMEVLFGEHIGLSGRCQQQQSSRSPSVLCQSMGPPRCVGQVGSGRKGLHFRRFPLAWRLAKKDVIFHVYRTAYHSGAADGGLFAAVASACAVAAR

SEQ ID NO: 138441 - protein, 292 aa, Glycine max
  Coding DNA Sequence Number=SeqID_46756
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIIKRLWTNWSIRFVFKIEIKVESKAYHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138442 - protein, 77 aa, Glycine max
  Coding DNA Sequence Number=SeqID_46757
MACCNRLHVYYCSYTCPEAVVKFMLERIDGDPVLREHEEMGYVGVRELVGGGQQGMVGLSAHCGCGKLVHPSPDHIV

SEQ ID NO: 138443 - protein, 356 aa, Glycine max
  Coding DNA Sequence Number=SeqID_46758
  Subcellular localization annotation: CTP_CleavageSite=27; ConfidenceScore=5.19e-01
MKPAPTGAVAPPAYNADCWRIASSRVRMHLARQRQPGLRRGRQVTATPPHQSHLPIRMGIAQRHQRHARVPFFLRLDARQEGHAQPGADQRHDEVDLAAPRGDGRRKAGAPASLLDDAVQGEAGLEQDEGGVAQLVEADGGGPGVRVIGRQQRHQRLARHRLPVEIVGVRPQRRRQLDPAGHHHFFEPVAAVFQQADLDVRIAAAKAREHRREQRAAAQRRQAQPQHAALEAAQLVQFGVQIVALGQHLHGAPLAHGLADRGLGGENRFRGLGESALADHFHQRAQGAQIHGGTGQRRRPAHTGRCHRHGAGAGPAGRRPVAGAQCAPGRQLAAGRDAAVLRARGDVAAGPSRIPR

SEQ ID NO: 138444 - protein, 147 aa, Glycine max
  Coding DNA Sequence Number=SeqID_46759
  Subcellular localization annotation: CTP_CleavageSite=52; ConfidenceScore=5.51e-01
MVKVGTSYVPINVSFSPKVGPGLPGSTGTPGFIYSANAVVFRLPQSALFAIPCASGMPELMTLVYDGVFRGAPVAFCFYQLFPPVQLLTGWCRSQFHTSIPTGHQRGKCSRGADAAANSPLIARRAHCAAFTGKRGVSEVLPMCTTL

SEQ ID NO: 138445 - protein, 115 aa, Glycine max
  Coding DNA Sequence Number=SeqID_46760
MTTLTQIWMTLLHSNVLPSDHNSDLPLPKCQLAQGNAHQDAGAPPPPRQADSVGPLRVEWYIYHLVRQQAAKHHGQVQIHECLYRFSLSQQGQGSAPFVCRTPKQFGAEVTWPGD

SEQ ID NO: 138446 - protein, 120 aa, Glycine max
  Coding DNA Sequence Number=SeqID_46761
VEGPGSTSGPSHGRKGNDYHDARHIAKREVLIKVSSTSTNQLEGSEQLGQKGRKEIPMVSSTPAWIKPQQTPHGTHQYAQHHPSFSAHAGNASSSTPVQPKAPTQREAPQVPTPNTPRLA

SEQ ID NO: 138447 - protein, 59 aa, Glycine max
  Coding DNA Sequence Number=SeqID_46762
MENSKHLATPMSTGCYLDKDESGQPVDEKQYRVIRNKARIVAKGYNQEEGIDYEEPLHL

SEQ ID NO: 138448 - protein, 64 aa, Glycine max
  Coding DNA Sequence Number=SeqID_46763
GSERGVKKRKIGLYGMCFGEDLSKIRRFEDLGMDEARGEALAVQQHWFRGIYRRGRVVIDYKAW

SEQ ID NO: 138449 - protein, 101 aa, Glycine max
  Coding DNA Sequence Number=SeqID_46764
SENGGVYHQLDESQRLFLDAMTTQMQHLLNCNKEELYRRIAKSPLFTLKPLSPREVCDDQIRMREKREQEKENSEAPQRNMKKKSDTPDEKSDTHKRESDT

SEQ ID NO: 138450 - protein, 163 aa, Glycine max
  Coding DNA Sequence Number=SeqID_46765
MGDQEKTQEQMKADMSALKEQMASMMEAMLGMRQLMEKNVATAAAVSSAAKADPTLLATARHPPSNIVGWGRNTLGHDGNPHLGYNRAAYPYGLPPNYSPPVLQDDAGHIASPVLEREPPQQPDEVHEDPQDYARRDVEFYPPILKRPAPSTFASAQRHDTTN

SEQ ID NO: 138451 - protein, 197 aa, Glycine max
  Coding DNA Sequence Number=SeqID_46766
MAPKKLSTKKSGRDITGEGSSATSEFDSHRFRRAKHLQRFEAIRGWSFHRERRVQLREDEYSDFQEEIARRHWKPLVTPMAKGQWIPFDADALSQFLGDPLILEEDQQCEFNQRRSQADSFDEEAIAQLLCIPGQDFARTAAGRRVQIMRTSMTTLTQIWMTLLLSNVLPSNHNSDLPLPKCQLVYAILTRMSVHVA

SEQ ID NO: 138452 - protein, 179 aa, Glycine max
  Coding DNA Sequence Number=SeqID_46767
  Homolog annotation: Hit_ID=A0PAV3; Match level="QueryCoverage=20%, HitCoverage=16%, E-value=7e-08, Identity=81%"; Hit description =Restriction endonuclease
MVKVGTSYVPINVSFSPKVGPGLPGINRDTRIYLFGSDLPVHRYLFGAKLRRVMLQAYLIYVYDGGARYQLLFPFEVVQWLHVSISCPSCSATDGVVPLTIRTQHTSRTSALASVAGVSSEVRSSKKATVRQSEYVNTDSLFRANSSLTELATLGRSLRRAEQWLTNGAEFGDAGMILK

SEQ ID NO: 138453 - protein, 243 aa, Glycine max
  Coding DNA Sequence Number=SeqID_46768
  Homolog annotation: Hit_ID=A5B5V0; Match level="QueryCoverage=95%, HitCoverage=51%, E-value=7e-07, Identity=22%"; Hit description =Putative uncharacterized protein
MFSSEEQRIQYTNLFSSHSIIDPKFIDMDVFSNENFECIQTFQNSNVIPFMSLKLPVYSELVKAFYSNLEIQESTLIFEVFGIKMVIDQSLFYDLTQLSSEGVPFEGTLNDDWKFDFSVHDDRRLVCTNQTDMTGRLLVGSLAFEIRILHYLIVRILLPRSSNLAQVSEEDLIVMWAFHTGRQIDWAHLVRYRMHKALRLNGHFPYPHLVTLFLQHFNIPLDSEPYVPIKRSFLIGAAVIASF

SEQ ID NO: 138454 - protein, 66 aa, Glycine max
  Coding DNA Sequence Number=SeqID_46769
MPIGGADIEEEELTYLRSNPLQGEGDDAILPRKGPVTRTMSKRLQEDWARAIEEGPRILTNLKVDF

SEQ ID NO: 138455 - protein, 181 aa, Glycine max
  Coding DNA Sequence Number=SeqID_46770
  Gene Ontology: Mol. function=oxidoreductase activity; Cellular component=flagellum; Biological process=negative regulation of transcription
  Homolog annotation: Hit_ID=A4W916; Match level="QueryCoverage=100%, HitCoverage=91%, E-value=7e-77, Identity=80%"; Hit description =Flavoprotein WrbA
  Pfam annotation: Domain name=FMN_red; Domain location=2-148; Score= -38.7; E_value=0.032; Accession=PF03358.6; Description=NADPH -dependent FMN reductase
  Pfam annotation: Domain name=Flavodoxin_1; Domain location=1-118; Score=46.4; E_value=1e-10; Accession=PF00258.16; Description =Flavodoxin
  Pfam module annotation: Pfam domain module=FMN_red::Flavodoxin_1; Domain location=2-148::1-118
MAHAVAEGANRVDGVEVVVKRVPETMQAEAFAKAGGKTQNAPVATPQELADYDAIIFGTPTRFGNMSGQMRTFLDQTGGLWASGALYGKLASVFSSTGTGGGQEQTITSTWTTLAHHGMVIVPIGYGAQELFDVSQVRGGTPYGATTIAGGDGSRQPSDEELAIARYQGEHVAGLAKKLNG

SEQ ID NO: 138456 - protein, 100 aa, Glycine max
  Coding DNA Sequence Number=SeqID_46771
  Subcellular localization annotation: CTP_CleavageSite=59; ConfidenceScore=5.46e-01
MHTPSFTIPQFPKIGLTHKNSPQWSRQLSQPTLLWASEARLTGASSKGGKCAESPPTFICGKRWKNRRKPVMKNIPDSGVVFTFEEGISTSHVCPKGQQP

SEQ ID NO: 138457 - protein, 149 aa, Glycine max
  Coding DNA Sequence Number=SeqID_46772
MHKALRLNAPLPYPHLVTLFLQNFNIPLDSEPYIPIKRSFLIDATVVASFGYRKERDGSWVKKGAQPNDDEGHLPVEGDSSLLQSILDRYDGLQTYVGERIVIIKKGEIVEAMTSKIILMMPKNQELSKFQRFKNQVSRIKRRLNQDKY

SEQ ID NO: 138458 - protein, 75 aa, Glycine max
  Coding DNA Sequence Number=SeqID_46773
MAPKKLLAKRARKDAAGEGSSAAPQVDMEFDGHRFRSEEHQHHFEAIKGWSFIKERRVQLREGEYAEFQEEIARR

SEQ ID NO: 138459 - protein, 176 aa, Glycine max
  Coding DNA Sequence Number=SeqID_46774
  Subcellular localization annotation: CTP_CleavageSite=64; ConfidenceScore=5.09e-01
MVKVGTSYVPINVSFSPKVGPGLPGCPSCSATDGELVRNRQKHTPDISAGKCSGCTRLTRNSTPAALNACRYRRVPFAIGAQLSGKGPDRCGLFAIRRQLAKGGCAASLRLSWGSVKCFHRGGRLEKRLPGLQQNIDDTDIFRFLATDSLRSVFDCGERKWLRTGRRFPGRCQEDT

SEQ ID NO: 138460 - protein, 107 aa, Glycine max
  Coding DNA Sequence Number=SeqID_46775
ALGFPALVTGLCSPTGCSFPPARSRHHDIGIAPARHPVDPKKSDRFYGVPVAPNKVIRPPTNRAFIKKYCAPRQAQGETPQQPGDGRQWATDALPPPLEFTSAHPQK

SEQ ID NO: 138461 - protein, 67 aa, Glycine max
  Coding DNA Sequence Number=SeqID_46776
MDRAHKTPSGPGGAQQGPEVPSSGYGPLLVLQGARSPQQGIAPTRYPMDPEEPNRALRFPALVTGLC

SEQ ID NO: 138462 - protein, 287 aa, Glycine max
  Coding DNA Sequence Number=SeqID_46777
KLRSRLLLSLAAIVVAGGYVYKNVPENGQASQQTAQASITTEEYLSRFDPERYMRIGTDYFNPRYSPSRLNKPIDQIDITYDYPFAYLAKVEKKLADVDRLTALREIFKKLTAGAKTNQERHLAVLDFLYKAAYHNPYVQPMYEDKQAVFDPIVLLKLGEMRCGGVARVAADLFEAAGYKTRLVQAHAHITTEIYYDGGWHLFEADLVGGPPVMINGRIPSVAELANNPFLIDKSPSHFLVYVAPGPSGGGDKSPVYPSYYYFSSQALAGLDAAYYYRPPRRRAADS

SEQ ID NO: 138463 - protein, 266 aa, Glycine max
  Coding DNA Sequence Number=SeqID_46778
  Gene Ontology: Mol. function=homoserine dehydrogenase activity; Cellular component=chloroplast; Biological process=aspartate family amino acid biosynthetic process
  Homolog annotation: Hit_ID=A4TS74; Match level="QueryCoverage=100%, HitCoverage=32%, E-value=1e-130, Identity=88%"; Hit description =Homoserine dehydrogenase / aspartate kinase
  Pfam annotation: Domain name=AA_kinase; Domain location=1-253; Score =119.9; E_value=7.6e-33; Accession=PF00696.19; Description=Amino acid kinase family
MAEYSQPGDMMVVSAAGSTTNQLINWLKLSQSDRLSAHQVQQTLRRYHSDLISGLLPPESAEPLIAEFIQDLERLAVLLDGKVDEVCYAEVVGHGEIWSARLMAAVLNHLDMQAAWLDARDFLRAERAAQPQVDEGRSYPLLQQLLAQHPGKRLVVTGFISRNDAGETVLLGRNGSDYSATQVGALAGAARVTIWSDVAGVYSADPRKVKDACLLPLLRLDEASELARLAAPVLHTRTLQPVSGSDIDLQLRCSYQPEQGSTRIER

SEQ ID NO: 138464 - protein, 170 aa, Glycine max
  Coding DNA Sequence Number=SeqID_46779
MVKEMIHGNKRNGEGNDPRLYFPSSSFPSAFFPLFSFSEPLNLSPYMTIYRESHLVQGKLAQASCLLRLEVISSPWRVACLGLNLFLGPSELDASLGEFRGLAPTLFDTGTFNPRAVLQNIYAPFSPNLKNPNRATEGGALESTKNTIIANGECLSDYIEVRNELLTLGD

SEQ ID NO: 138465 - protein, 360 aa, Glycine max
  Coding DNA Sequence Number=SeqID_46780
  Gene Ontology: Mol. function=4-alpha-D-{(1->4)-alpha-D-glucano}trehalo se trehalohydrolase activity; Biological process=trehalose biosynthetic process
  Homolog annotation: Hit_ID=A6EDC6; Match level="QueryCoverage=93%, HitCoverage=54%, E-value=1e-121, Identity=58%"; Hit description =Malto-oligosyltrehalose trehalohydrolase
  Pfam annotation: Domain name=Alpha-amylase; Domain location=1-311; Score=-42.4; E_value=4.5e-07; Accession=PF00128.15; Description =Alpha amylase, catalytic domain
MPVAQFPGERNWGYDGVFPFAVQQSYGGATEFQRFINACHEVNIAVILDVVYNHIGPEGNYLPNFGPYFTDKYHTPWGEALNYDDRFCHGQRDFVLNNVRMWLEDFHIDALRMDAVHAIKDFSAVHILQEIRKETDEIIVRSGKQRFLSIECDLNDRRFLDPLAKNGFGMDAQWLDEFHHALRVTVGEAKRGYYEEFNGLDDLAKAYEKAYVFDGNYSFHREKFFGTDTNGISGNRFIVFCQNHDQVGNRMLGDRAASLYSKERTRLMAFAVFMSPYLPLVFMGEEWGTERAFPYFVSHGDPELVELVRAGRKQEFEDFHTDSQIPDPQDEAIFRKAIFGFGTNLIFESYQQHFVCIINH

SEQ ID NO: 138466 - protein, 110 aa, Glycine max
  Coding DNA Sequence Number=SeqID_46781
MNVHVAQVIADAIYLFASMQPTRYPLDPDKSNRALWFLALITGLSQLFGVLVTLSKVIRPPITRAFIEKYCMPRQAQGDAHQAVDAPPPPHQTDPAGSLGMERYLQHLVH

SEQ ID NO: 138467 - protein, 151 aa, Glycine max
  Coding DNA Sequence Number=SeqID_46782
  Subcellular localization annotation: CTP_CleavageSite=74; ConfidenceScore=5.03e-01
MGIAPTKTPSGPEEVQQGPGVSSSGYGPLSALQGARSPQQGLCPQDTQWTRRSPTGSWSCQALIMGLCQFYGVPVSSSKGISPPTNRAFIKKYCVSRQAQGETPQQPGDGRQRATDAPPSPLEFTSAHPQKGLSIVYTTWPTNRRPSPKPK

SEQ ID NO: 138468 - protein, 114 aa, Glycine max
  Coding DNA Sequence Number=SeqID_46783
HLTKTSLRVGNSDVYGFLEPQSIQRSKQSQFESEIYIKSWMQSSKQDVYLGAYFNGGHWQMVIILPKENLVVWFCSLHNRPDNYLKGIINSSLKGLDDTPQSKSKAAARWIVVK

SEQ ID NO: 138469 - protein, 108 aa, Glycine max
  Coding DNA Sequence Number=SeqID_46784
MSGFTRDSPQISVSPHQLDLAPYASEPYHAQWNAPGLLRDKHTLRSSHILGEMEVDEPWLGLWLPLNYQTDFVVDLGMAFVDNWVVGKEKVCYWLSNDIVGLVGNLAV

SEQ ID NO: 138470 - protein, 212 aa, Glycine max
  Coding DNA Sequence Number=SeqID_46785
MTTLTQIWMTLLLSNILPSDHNSDLPLPKCQLVYAILTRMSIHVAQLITDTIYIFAGMAPTRHPLDPDKSNRALGFPALITGLCQSFGVLVAPSKVIWPPITRAFIEKYCMQRQVQGDAPQAADAPPPHQAGPAGSFDTEQYLRHLVRQQAANHRAHVAWPGDWPEARAGEAPAEAPAEAPDEADEAREDEEMTRFTGFLRREWGPHDWEIS

SEQ ID NO: 138471 - protein, 218 aa, Glycine max
  Coding DNA Sequence Number=SeqID_46786
  Gene Ontology: Mol. function=oxidoreductase activity, acting on the CH-OH group of donors, NAD or NADP as acceptor; Cellular component =cytoplasm; Biological process=metabolic process
  Homolog annotation: Hit_ID=A9ITF9; Match level="QueryCoverage=98%, HitCoverage=60%, E-value=1e-111, Identity=90%"; Hit description =Tartrate dehydrogenase
  Pfam annotation: Domain name=Iso_dh; Domain location=1-211; Score =29.0; E_value=2.9e-16; Accession=PF00180.11; Description =Isocitrateisopropylmalate dehydrogen
EYSNSGGVLFGGTEREVVIQESVFTRVGAERVLKFAFELARKRGKHLTAATKSNGISISMPWWDQRVADMAGNFPDVRWDKYHIDILCAHFVQHPDWFDVVVASNLFGDILSDLGPACTGTIGIAPSANLNPERKFPSLFEPVHGSAPDIYGKGIANPIGQIWSGALMLDFLGYPDASAAVVRAIETVLADGPRTRDMKGSASTAEVGDAIASLIPTA

SEQ ID NO: 138472 - protein, 304 aa, Glycine max
  Coding DNA Sequence Number=SeqID_46787
MRGAPTEESLSPFLMRDLGAQSLKVIQRVHKAWRSPLRKDKELRGIRNGVIGGYHGWLRIHTQGLDWLSKLKVIDEENFEAPEEDEEVRALKLVLGKARLAKEKFKSAATHIRKECTELQEENMATVRALEQETKRARKEEHGREKFQGALWGSNNELKLRREERDRSRVHGMILKEELAACAKSKRSLAQHLETTEQTMLAIIGQYKEELNQSVTHEQKLVEDFAQVYAEKEARGRVIDALHQEATMWMDRFALTLNGSQDLPRLLAKAKAMAEVCMAPEEIHGLINYYQHTIDLMAHIIRNR

SEQ ID NO: 138473 - protein, 113 aa, Glycine max
  Coding DNA Sequence Number=SeqID_46788
MPLCGGRRGVIRNRFPVFRGGKHFLRGFLLWESLPVRCSSNDGPSYVGERLRTSGMGLGYSHNPRTYLIRDQRKVWRTSMACKPTLRIKRYSGKRAFRDTKLAVTKEGVEEAQ

SEQ ID NO: 138474 - protein, 168 aa, Glycine max
  Coding DNA Sequence Number=SeqID_46789
  Homolog annotation: Hit_ID=A5AWV0; Match level="QueryCoverage=72%, HitCoverage=8%, E-value=2e-12, Identity=32%"; Hit description =Putative uncharacterized protein
MRAGNSDIYGFLEPQSIQRFGQSQFESESYIKTLMQSSKRDVYLGSYLNGRHWQMVVILPKEHLVVWFCSLHNRPDNYLKGIINSALKGLDDAPQPKSKAPARWIVVKCNRQKGSTECGYYVMHWMSTIILGTFRNNWEADPRPLEPERLKALRIQWAQYYLRVRDQT

SEQ ID NO: 138475 - protein, 172 aa, Glycine max
  Coding DNA Sequence Number=SeqID_46790
MVLKEELAACSRSKKSLAQHLEATEKNMLAIIGQYKEELNQSLTYEQKLVEDFAQAYAEKEARGRVIDALHQEATMWMDRELTITKKAQRHPYNTRSKSKMDNEEGVQEQMKADMSTLKDQMASITKAMLKIQKSIEDNAVAAASNTTTEAEPVLQPAMNLGRDKSAMGFNR

SEQ ID NO: 138476 - protein, 46 aa, Glycine max
  Coding DNA Sequence Number=SeqID_46791
MAEQGWSLAMWVVMCLKSNKDDDVCLVNLIREQQAMCAKSSLVQGI

SEQ ID NO: 138477 - protein, 379 aa, Glycine max
  Coding DNA Sequence Number=SeqID_46792
  Gene Ontology: Mol. function=N-acetyltransferase activity; Cellular component=plasma membrane; Biological process=metabolic process
  Homolog annotation: Hit_ID=A4WDF3; Match level="QueryCoverage=60%, HitCoverage=25%, E-value=1e-106, Identity=85%"; Hit description=GCN5- related N-acetyltransferase
  Pfam annotation: Domain name=Acetyltransf_1; Domain location=142-221; Score=52.2; E_value=1.9e-12; Accession=PF00583.15; Description =Acetyltransferase (GNAT) family
  Pfam annotation: Domain name=PLDc; Domain location=338-364; Score =29.0; E_value=1.7e-05; Accession=PF00614.13; Description =Phospholipase D. Active site motif
  Pfam module annotation: Pfam domain module=Acetyltransf_1::PLDc; Domain location=142-221::338-364
ALRPLDIAGLSQFLVQVSNLIVDCAEIQRLDIHPLLASGNEFTALDVTLDIAPFEGDRESRLAIRPYPLHLEEWVEMKNGERVLFRPILPEDEPQLRAFISQVTKEDLYYRYFSEINEFTHDDLANMTQIDYDREMAFVAVRRAGHDDEILGVTRAISDPDNVDAEFAVLVRSDLKGLGLGRRLLEKLISYTRDHGLLRLNGITMPNNRGMVTLARKLGFDVDIQLEEVDDVEFFYAPAHFRETLLEKIASATRRICIVALYLEQDEGGRAILNALYEAKRQRPELDVRVLVDWHRAQRGRIGAAASNTNADWYCRTAQENPGVDVPVYGVPVNTREALGVLHFKGFIIDDSVLYSGASLNDVYLHQLDKYRYDRYHLI

SEQ ID NO: 138478 - protein, 101 aa, Glycine max
  Coding DNA Sequence Number=SeqID_46793
MAKFDPDIVMEFYANAWPTKEGVCDMRSWVRGQWIPFDAEAFSKFLGHPLILAEGQQCEYSQRRRQVSGFDEEAIAQLLCILGKILPRLPQGDGCGSCAPA

SEQ ID NO: 138479 - protein, 130 aa, Glycine max
  Coding DNA Sequence Number=SeqID_46794
MTTLTWIWMTLLFSNILPSDHNANLPLQMDCAHMTPSGPEEVQQGPGVSSSGYGPLSVLQGACSPSKFYGVPVAPSKVIRPPTNRAFIKKYCVPRQVQGETPQYPGDGRQWATDALPSPLEFTSAHPQKG

SEQ ID NO: 138480 - protein, 123 aa, Glycine max
  Coding DNA Sequence Number=SeqID_46795
  Subcellular localization annotation: CTP_CleavageSite=58; ConfidenceScore=5.07e-01
MVKVGTSYVPINVSFSPKVGPGLPGSMAYHGFYQLFLLFATERVVLSAPIRQQALRPEASAGKCKPGAMTLQLCAKGDRCGLFAITPAALKRMCCILAITMLADNARVFQSECVVAEKKADGQ

SEQ ID NO: 138481 - protein, 263 aa, Glycine max
  Coding DNA Sequence Number=SeqID_46796
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPEFDDASAIKAYDSVTGADVTDKFDIKVENGVMTATLKAGSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138482 - protein, 123 aa, Glycine max
  Coding DNA Sequence Number=SeqID_46797
MVARENVAKQQHYPDQREGGHAGAHDPHLSPCYIPGKVLPRNAQQLADSLLVKARGLTPPLAKLVELALLQDQWMPQKLVNGILIKKDPLAPHPGVLVSDSLFYRPGIGIELHDYLRIKLNHG

SEQ ID NO: 138483 - protein, 208 aa, Glycine max
  Coding DNA Sequence Number=SeqID_46798
  Subcellular localization annotation: CTP_CleavageSite=42; ConfidenceScore=5.35e-01
MTIQNMQFQQETRASTQSLTNQMGQMATQLNQAQPQNSKKLPSQMVQNPKNVSAITLRSGKQIEVPPPIEAPAPEPVKLYSTPEKEDELVAQKRKLPDHAGGSSSSSSDLPQPHIPLPFPPREIPNKKMEEVDKEILETFRKVEVEVEEPSSSSPTLVPPTVQPPPTLVLKPLPANLKYAYLEDKEKFPVIISASLATKQEEKLLLVL

SEQ ID NO: 138484 - protein, 49 aa, Glycine max
  Coding DNA Sequence Number=SeqID_46799
MSPVESPIVATYLSVRGRRKAHGCIFQGRKARGVATNGVSLAPTYPQLQ

SEQ ID NO: 138485 - protein, 143 aa, Glycine max
  Coding DNA Sequence Number=SeqID_46800
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MHGSKHEDGGHINENAILGAPKNGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138486 - protein, 150 aa, Glycine max
  Coding DNA Sequence Number=SeqID_46801
MAPLGTLWTQISPTGPGIPRTDHRTLPVVRSPRCTYQGAPPPPHQAGQAGAFGIEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 138487 - protein, 134 aa, Glycine max
  Coding DNA Sequence Number=SeqID_46802
  Gene Ontology: Mol. function=phosphoprotein phosphatase activity
  Homolog annotation: Hit_ID=A5BXI2; Match level="QueryCoverage=78%, HitCoverage=7%, E-value=1e-15, Identity=36%"; Hit description =Putative uncharacterized protein
MLPPICLVGSVAWCAVVPLICFHVVEWHQPDRVLRQFGMQQPILGCPSQPLNIHDITLKDKQDENWGQLFAPMISQWNNRADFRVNGYPRQEDLLSFNSDYMVWLKLRRHYSTLCLLKGGIHGQLMISCLMWRR

SEQ ID NO: 138488 - protein, 177 aa, Glycine max
  Coding DNA Sequence Number=SeqID_46803
  Homolog annotation: Hit_ID=A5AK77; Match level="QueryCoverage=53%, HitCoverage=11%, E-value=6e-11, Identity=39%"; Hit description =Putative uncharacterized protein
MTRGNPSDLQPFDPEIDRTFHILVRHHFIPFDHPEHSITGESVHSVIGDFEHPDFEHYNFEHSDSEHSDFEHSKNMAQPPPRERTLREMAAPDFTYESLCIQYPNEDVPYVLKTGLIHLLPKFHGLACEDPHKHLKEFHIDCSTMKPPDFQEDHIFLKAFPHSLEGVAKDWLYYLAP

SEQ ID NO: 138489 - protein, 190 aa, Glycine max
  Coding DNA Sequence Number=SeqID_46804
  Gene Ontology: Mol. function=RNA-directed DNA polymerase activity; Biological process=RNA-dependent DNA replication
  Homolog annotation: Hit_ID=Q0ZCD0; Match level="QueryCoverage=95%, HitCoverage=16%, E-value=3e-10, Identity=25%"; Hit description =Integrase
MERSMIDAVSGGALGDMTPIEARNLIEKMASNSQQFSARNDAIVLRGVHEVATDSSSSAEYKKLEGKLDALVNLITQLAMNKKSAPFTRVCGLCSSANHHTDHCPSLQQSGVNEQPKAYAANIYNRPIQQQNQQQHNNYDLSSNRYNPGWRNHPNLRWTSPPQQQQPVPPYHNASSPSKPYVPPPMQQQQ

SEQ ID NO: 138490 - protein, 124 aa, Glycine max
  Coding DNA Sequence Number=SeqID_46805
METCLEVEELLQRMIDQGQLEVGDDGRKKQHICMQSADERSFGRPKPLVIYFTKGSASQKRRHPLAAKLVPFPYQNNHAVPWRYTPPYKKEEEATDISSLSAKCICLYVLGRNRSSGGKICGLG

SEQ ID NO: 138491 - protein, 92 aa, Glycine max
  Coding DNA Sequence Number=SeqID_46806
MKGRRHKYGFNNNKREKGEKKRVVDDETGDKHQLDEVLRMPYHVFSTCLHSSSSSSSSSFSSFSSSSSFGRIGFAVYYEAYTQSFTFTIVVH

SEQ ID NO: 138492 - protein, 97 aa, Glycine max
  Coding DNA Sequence Number=SeqID_46807
MASSKHQRQSLCFYMLGLGMGSTPLEAVYVKLHYLVGVQNGSNQVDLRKARFYWENSSMAVKRSTLADYLAQQPINDYQPMHPEFPDEDIMALFEEE

SEQ ID NO: 138493 - protein, 73 aa, Glycine max
  Coding DNA Sequence Number=SeqID_46808
MSDSGASHIETLEIEQRKLSKNSNGHNFSHGGPIQVHSISRCSKLNNGSSREFQMVITFKADVRFRRITYRDA

SEQ ID NO: 138494 - protein, 48 aa, Glycine max
  Coding DNA Sequence Number=SeqID_46809
MGRARSRIVSGHGQKSRQVNGRNQPRYLGMEANGGWDRDRPSVTPSRC

SEQ ID NO: 138495 - protein, 41 aa, Glycine max
  Coding DNA Sequence Number=SeqID_46810
MHLHDQGTYREDPTEDLAFHTRKPSLEQREEQDERLQKYKW

SEQ ID NO: 138496 - protein, 53 aa, Glycine max
  Coding DNA Sequence Number=SeqID_46811
MKQNIDHHSKIGEKLATQLAQASKVASSRSNSLLEEGSGRPKWARLLFAPPFY

SEQ ID NO: 138497 - protein, 103 aa, Glycine max
  Coding DNA Sequence Number=SeqID_46812
GTSFVVQVKGTSTWVVVTENKRGYISCGSVQVEGTSTWLFKENKGGYIPCGSLLVKVFTRLKEISRTAGRLGTGCKHELSPNQYKTLVFVFFFPTLFNFCCAL

SEQ ID NO: 138498 - protein, 117 aa, Glycine max
  Coding DNA Sequence Number=SeqID_46813
  Homolog annotation: Hit_ID=UPI00016621D1; Match level="QueryCoverage =91%, HitCoverage=40%, E-value=9e-09, Identity=35%"; Hit description =UPI00016621D1 related cluster
VLVPIAFRGLHVLAFKGLHVLAFRGLYILAFRGLHVLTFGGLHVLIFRGLHALTFKGMQVLAFRGLRAFTVRGLNALAFRGLHVLTFKGLHVLSFRGLHVLAFRGLHVLAFRGLHPP

SEQ ID NO: 138499 - protein, 42 aa, Glycine max
  Coding DNA Sequence Number=SeqID_46814
VEGSSPEYEEPRDLRSNPFQGGGDDAILPTKGIRYKPSRGLG

SEQ ID NO: 138500 - protein, 103 aa, Glycine max
  Coding DNA Sequence Number=SeqID_46815
  Subcellular localization annotation: CTP_CleavageSite=39; ConfidenceScore=5.28e-01
MACPLRAYQKSPHGTPPACSHASLAFTQRTYCHGFSCIVCFHSRKASFIFGPLVIVGSLRGYSFAFTPNRLLYRNTKAYYPALLPPDNNVRVCDDPRHLNSMT

SEQ ID NO: 138501 - protein, 303 aa, Glycine max
  Coding DNA Sequence Number=SeqID_46816
  Homolog annotation: Hit_ID=Q6WAY4; Match level="QueryCoverage=49%, HitCoverage=27%, E-value=4e-13, Identity=31%"; Hit description =Putative uncharacterized protein
PSLKKRFYQVKIKSLEVTSLRKLGQLMGQLQRQAFRKAYGKIWDLARVEVSMEPIASLSQYYDQPLRCFTFEDFQLVPTVKEFEEILGCPLGGRKPYLFSGFYPSTTRVAKVVKISAQELDRVKQNRNGVVGVPRKCLEERAKALANQGLVDLAAIDAFLAFHHGKESPVVAILAMILSSCEGCPMKGVPSDESITPFIARGFSDHNARDRELRGSSNGIIGGYHKWLRVRTQGLDWLPNLKTVRDDEVKASEESDEVQALKAELERAWVVEEKFKAAIVSSSSEEVKGIITGQRHDLEGRAK

SEQ ID NO: 138502 - protein, 84 aa, Glycine max
  Coding DNA Sequence Number=SeqID_46817
PMNLLPSAVHASSTMESGALGSYCVALPAKLLHSVATYPSAGGRRETRGMRVPRKEYARSRHQRLFEENVGKTGKDAIYELFSE

SEQ ID NO: 138503 - protein, 131 aa, Glycine max
  Coding DNA Sequence Number=SeqID_46818
MRCPFCRDAEEEVSHLFFHYNKIQPIWWESISWLNIKSAFPLKPVQHFLQHISIQIKGVRGKRWRYWWLAKISKIPSKPQDLYNIKVYDGWLMHKQFQKVVRDCWLDYQPMGWGGYALKCKLQLLKQRLKI

SEQ ID NO: 138504 - protein, 186 aa, Glycine max
  Coding DNA Sequence Number=SeqID_46819
  Gene Ontology: Mol. function=RNA-directed DNA polymerase activity; Cellular component=exocyst; Biological process=exocytosis
  Homolog annotation: Hit_ID=A7QUU0; Match level="QueryCoverage=57%, HitCoverage=16%, E-value=4e-39, Identity=74%"; Hit description =Chromosome chr1 scaffold_180, whole genome shotgun sequence
MERGRFNKQASIRRYQARRSTADRKKRVTFRGAVNEGDGASGHKSRRKSEAVQRSTTELHIHDEQRKRSTELRTYHKNYQVETWSKILSSLSPKGLNENGKVHKPVLKERFKSFNAAFEEIHKTQSAWVVYDEQLQSELRVSISALVIPAYRSFLGRFSQYLYPGRQVLKYVCMCVCVRACVLYAA

SEQ ID NO: 138505 - protein, 113 aa, Glycine max
  Coding DNA Sequence Number=SeqID_46820
  Subcellular localization annotation: CTP_CleavageSite=68; ConfidenceScore=5.64e-01
MASRIISRDSVSLSAALFFSMLTASSSSSASYLLPSAASPSSMQHCLPLKNLFDQLLPQNHNHSSSVVALMVASSIACVLEFTIKASLDTAPEAAAFPDVETMSGTCVPSNSL

SEQ ID NO: 138506 - protein, 116 aa, Glycine max
  Coding DNA Sequence Number=SeqID_46821
MTLIDLPMILPSESDLTCQHLTRFFTDMVLDNLVFVEAKLHDESRLIQRCFDDIKDDDNDSRGKLKNTSRFKRKVDFKDQESRFKDQASKNQDSRIKLPRIKIKIQDSRFKNQEKT

SEQ ID NO: 138507 - protein, 173 aa, Glycine max
  Coding DNA Sequence Number=SeqID_46822
MPGRIGQIELKDRWDISEDEEEERRRPGRILQRDHQQRLEELLFHQELMPYQLIQVVASPRGGYRLLVVRGGISGSAADPNYPSGDSRRSVNYWDIGEFLSSYWNFPRYMSYCINTGILGPALELATPSLVLLPASLVGLKAELSFSLRESSLASSPYSDILFIRPPPMLPIS

SEQ ID NO: 138508 - protein, 19 aa, Glycine max
  Coding DNA Sequence Number=SeqID_46823
MKYLGSDPRSSPNERWSTD

SEQ ID NO: 138509 - protein, 174 aa, Glycine max
  Coding DNA Sequence Number=SeqID_46824
MAHEQKLVEDFAQVYAEKEARGRVIDALHQEATMWMDRFALTLNGSQDLPRLLAKAKAMAEEQMKADLSALKDQMASISEVMLKLQKTIEDKATTTASTYPYGLPSDFTPRATPEDLSQAPTFEGQLPPYDDYPGQDDEEGDTHLGPLLHLKDPSPHELPQPNIVRHIPASPTP

SEQ ID NO: 138510 - protein, 122 aa, Glycine max
  Coding DNA Sequence Number=SeqID_46825
DGPSGTSTLVFRGLHVLALRGLHVLTIRGLHALTSRGLHVLALRGLHVLALRGLHALTFRGPHVLALRGLHALTLEGYTPSPWVLVTLTVERTTRPRQQRVARPHLQRTTCPRLERATCPHL

SEQ ID NO: 138511 - protein, 134 aa, Glycine max
  Coding DNA Sequence Number=SeqID_46826
MSLATLFGKLQEHEMELMRLHQHEENDIKRKGTTLRASSSFIQEESDKEDLTETEEDDDDFRLFVKRFNKFLRNKRNKRESNINTKKKEEDSSLAPTCYESNQPGHMRFDYLVFERRIEKSNKRNLKEKKEKKA

SEQ ID NO: 138512 - protein, 73 aa, Glycine max
  Coding DNA Sequence Number=SeqID_46827
MYRLIRQALKSVVFHLLAKPICWLNEHPLSTTLMGQTRGRLWKKMSCTGLLSTPLHLTKRTASVHPLNEKGTR

SEQ ID NO: 138513 - protein, 93 aa, Glycine max
  Coding DNA Sequence Number=SeqID_46828
MGAFSKKGGTNSNHVHLGLPDSSSRRRFLLEEATLLAWACWVASSSPYFAINRGRSEEGKGFSLLGTSYSLEIAEENCFREENPCRGASVTFP

SEQ ID NO: 138514 - protein, 105 aa, Glycine max
  Coding DNA Sequence Number=SeqID_46829
YILCGTSRGYIYLGLTENKRGYISCGSVLAEGTSTRFKENKGGLKEISRTAGCLGTGGRHGNGLLKDHDEDQVNLCLMTKSDENNKEDSIRKKWYIDSGCSKHMT

SEQ ID NO: 138515 - protein, 298 aa, Glycine max
  Coding DNA Sequence Number=SeqID_46830
  Gene Ontology: Mol. function=nucleotide binding; Cellular component =protein complex; Biological process=barrier septum formation
  Homolog annotation: Hit_ID=Q6UUU1; Match level="QueryCoverage=20%, HitCoverage=40%, E-value=4e-18, Identity=78%"; Hit description =Putative uncharacterized protein
  Pfam annotation: Domain name=Tubulin; Domain location=79-209; Score= -77.4; E_value=0.077; Accession=PF00091.16; Description=TubulinFtsZ family, GTPase domain
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPVTTLNSMQALRKSQVQQTVQIGGATTKGLGAGANPNVGRKAAEDDQEEIRKMLEDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138516 - protein, 113 aa, Glycine max
  Coding DNA Sequence Number=SeqID_46831
MNGGETGIAFVAPDFLLAERVEAGRRTLYIHLFVPGTRHNSFEKGSGKTGRLALAYCVIFEQERAVFGTICTVAGKAGVKLFTSSGYEPYLASKANPFTSEILPNSNYKERKG

SEQ ID NO: 138517 - protein, 191 aa, Glycine max
  Coding DNA Sequence Number=SeqID_46832
MQSQGLALPPEPLFGPFGPRETILRRVTQIGAACTSKQILPAWLPWGEFMRDPLLFHNNPLLPGQVKVGVEEVTDADAPIPVPTDEVSLVGQALHTFLAWPTHLVKSLSQQVVVSPAKPPSKPDPEVDDPLYLMTLTIPELFLRPYQVTSDATVFRVFNPNFPLYIKHEDLSEIAHGGQCFSISVLQLWIL

SEQ ID NO: 138518 - protein, 66 aa, Glycine max
  Coding DNA Sequence Number=SeqID_46833
MPIGGAYIEEKELTYLRSNPLQGEGDDAILPRKGPVTRAMNKRPQEDWARAAEEGPRVLTNLKVDF

SEQ ID NO: 138519 - protein, 45 aa, Glycine max
  Coding DNA Sequence Number=SeqID_46834
MELSIDAILPRKGPVTRTMSKRLQEDWARAAEEGPRVPMNLRVDF

SEQ ID NO: 138520 - protein, 109 aa, Glycine max
  Coding DNA Sequence Number=SeqID_46835
MDFEICLIVQQKAGKFVQQNFSTCAKNACALLVMGKIPTVKMYTYVLGTSIKIFKSIQRLTNRNEENVTRVFEFFCLYSVFLVEGSFMIVGIDLLGYYGSLEGLMGTRC

SEQ ID NO: 138521 - protein, 118 aa, Glycine max
  Coding DNA Sequence Number=SeqID_46836
GRWLPPSSPRRAQLAQASQVASSRSNSLLEEYSGGPKWAWVLFAPPFLLKCYGTSLNYATMLPFDFRCVTETYGLCINIFLVFRHVLEFHKLPNDGCQAPHKDQRKVACHQAKVPRRN

SEQ ID NO: 138522 - protein, 74 aa, Glycine max
  Coding DNA Sequence Number=SeqID_46837
MNVLSGATLFGKITRAPNIFMIFVHRDSLGVPMNSKRIKAIPERPTPPSVKEKSPEFQEPRYLRSILFKGEGMM

SEQ ID NO: 138523 - protein, 179 aa, Glycine max
  Coding DNA Sequence Number=SeqID_46838
MYLTGPPLDITTEGVCRGFSYTGMLPMKKPAANLLNVLLSLSAISGGVCPSIHPIDSILRLSWYKMRAFQGNSSLPRTLVSPDLPLSADGSHLNAESTVHLVVSTWSLPHSLLLAHEKPRAMLLFGHDCGSNHRGKVHLIAGFNLNGTLQTPWPRMFDAPSNHMVHLSRSLSNFSSNKP

SEQ ID NO: 138524 - protein, 130 aa, Glycine max
  Coding DNA Sequence Number=SeqID_46839
  Pfam annotation: Domain name=zf-CCHC; Domain location=58-75; Score =29.7; E_value=1e-05; Accession=PF00098.14; Description=Zinc knuckle
MQEEEEEEEEEEEEEESDDEEDFSLFMKKFHKFVKNRRIEGSHNFNNGKISQEVSPTLKCYKCNQPGHIKANCLSNESWPKKNEKKSYKERRSKKAYIAWDDNDSSDGLEKEINLLSKDYESDENISQEV

SEQ ID NO: 138525 - protein, 45 aa, Glycine max
  Coding DNA Sequence Number=SeqID_46840
MTFVITACLGYFRPQRDSKGPPPLDDKRVQNDHNLSLRAIGHECV

SEQ ID NO: 138526 - protein, 60 aa, Glycine max
  Coding DNA Sequence Number=SeqID_46841
MEDVRKKAQAFQKQNTIPHVLSRGGYDYSEQKLLAEKTKKKLEEAAQSGSVDGIIEPPSP

SEQ ID NO: 138527 - protein, 89 aa, Glycine max
  Coding DNA Sequence Number=SeqID_46842
MGLRIKVENGGLANNVTQNLLGAPDSKVEDPRTALGIDIDGSPNKKWRMENRQIALRNNFRYAITSRGSTLEGGGHMNSARQLHSWVSE

SEQ ID NO: 138528 - protein, 271 aa, Glycine max
  Coding DNA Sequence Number=SeqID_46843
  Gene Ontology: Mol. function=motor activity; Cellular component=cell projection
  Homolog annotation: Hit_ID=UPI00016621D1; Match level="QueryCoverage =98%, HitCoverage=40%, E-value=8e-20, Identity=32%"; Hit description =UPI00016621D1 related cluster
DYTLAIRGLHALAFKGLQILTIRRLHVLAFRRLHVLAFRGLHVLANRGPHALTFIGLHVLAFIGLHVLTFRRLHALAFRGLHVLTFRGLQVLSFRGLYLFTFKGLHALAIRGLHALAFRGLHILTIIGLHVLYFRGLHALTFRGQHVLTIEGLHLLAIRGLHALAFIGLHILTIRRLHVLAFRGLHVLAKRGLHALTFRGLHVLTFRGLHVLTFRGLHALTNRGLHGPAFRGLHVLTFIGLDVLAYIGLHFLAIKGLHVLAIRRLHTLAFG

SEQ ID NO: 138529 - protein, 96 aa, Glycine max
  Coding DNA Sequence Number=SeqID_46844
MQNSRVTLRAESQHFASVNDANPCVASIPYFGFIDEIWELNYVKFTGKTIGVNVEDDDSYMDTYVSPLTAQITPNVSEKKKLTTFMLIEMIIMKEN

SEQ ID NO: 138530 - protein, 121 aa, Glycine max
  Coding DNA Sequence Number=SeqID_46845
MELSNGKGPSRVNLGFVEPWTKDVFALGFVLPWSCVEAYQGRALDFVNPYGSASAKVGFDESCVQCKYWRHGGVYQWDSPKEDLGFRKPFGGLTREFSDLGFEHRTLAYIAYISLAMGGMH

SEQ ID NO: 138531 - protein, 138 aa, Glycine max
  Coding DNA Sequence Number=SeqID_46846
FVGGASLIGFLCRSWTSGCTDCCHWATRTPWSCACFWSRCDDQTILWTSSKDLLHVFVHGSQRPRAADAKNQGLARGVDHEKSDSTTNVILQPDAIPVLVPRCNHRDLHCLLSLRHMTETSMRAGNVDVYEFLEPQSI

SEQ ID NO: 138532 - protein, 74 aa, Glycine max
  Coding DNA Sequence Number=SeqID_46847
  Homolog annotation: Hit_ID=A0ST23; Match level="QueryCoverage=35%, HitCoverage=53%, E-value=1e-07, Identity=100%"; Hit description =Putative reverse transcriptase
IRCCEKPCDLKVHTEEYEGRVGKPVVPAALMNRPTRGERRFAYWALAECILAYYVGTDEGVSEVLHVAGEKRLH

SEQ ID NO: 138533 - protein, 21 aa, Glycine max
  Coding DNA Sequence Number=SeqID_46848
MRIPFFTGQGVALGPNLRIIP

SEQ ID NO: 138534 - protein, 89 aa, Glycine max
  Coding DNA Sequence Number=SeqID_46849
MGFQTLPYSNIPDTTNIYVFILFTCVEGRSLEFQEPMDLRSNPFQGVGNDAILPPPKALDRRLQEDWARDAKEDPRVLMSLRVDFEPMS

SEQ ID NO: 138535 - protein, 148 aa, Glycine max
  Coding DNA Sequence Number=SeqID_46850
  Homolog annotation: Hit_ID=Q84VI1; Match level="QueryCoverage=100%, HitCoverage=27%, E-value=1e-50, Identity=60%"; Hit description =Envelope-like protein
AKKSGRKVPGNVPDAPLDNISFHSIGIGIDVEKRAAEEESWMQAEDRTEEAAEEEEDAAEWRLVFVRGKCVRFSPAVINKYLGRPTDGVIDIDVSEHQIAKEITAKRVQHWPKKGKLSAGKLSVKYAILHRIGAANWVPTNHTSTIAT

SEQ ID NO: 138536 - protein, 295 aa, Glycine max
  Coding DNA Sequence Number=SeqID_46851
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIWQREKGMKKINSTRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138537 - protein, 90 aa, Glycine max
  Coding DNA Sequence Number=SeqID_46852
MSLHVLYLYAFSRFPPRIFRSVVSLVTIFQRNKHGFEAFSPHVLKDERKRGWGHDRPIVTLLCAKQAGNVAARQPRILCILQLSFTICLF

SEQ ID NO: 138538 - protein, 130 aa, Glycine max
  Coding DNA Sequence Number=SeqID_46853
MTTITHTSFDNYTGQLRHRRFSLPNPSQKNDDLRIIHRWIVVNFYQHVHNPITSILTVGNSKNMSELRDIPLAPNAIAHTFTVGMYEIIFVEGETESHEDSTSGEEKLEESQGTARDAVIAFGRHVSPLR

SEQ ID NO: 138539 - protein, 139 aa, Glycine max
  Coding DNA Sequence Number=SeqID_46854
  Gene Ontology: Mol. function=protein dimerization activity; Biological process=DNA integration
  Homolog annotation: Hit_ID=A3B418; Match level="QueryCoverage=100%, HitCoverage=25%, E-value=1e-36, Identity=46%"; Hit description =Putative uncharacterized protein
  Subcellular localization annotation: CTP_CleavageSite=39; ConfidenceScore=5.42e-01
MFVKNFVMNHSMRLSIFNSFNSLKLLSIAPTRFASTIVMLKRFKQLKKGLQEMVDYILSFTSAIYNVLRRTDTEASSLHLVYEMWDSMIEKVKNVIYQYERKEESEGSTFYEVVHSILIDRWTKSSTPLHCLAHSLNPR

SEQ ID NO: 138540 - protein, 250 aa, Glycine max
  Coding DNA Sequence Number=SeqID_46855
  Homolog annotation: Hit_ID=Q6WAY6; Match level="QueryCoverage=56%, HitCoverage=28%, E-value=4e-21, Identity=38%"; Hit description =Putative uncharacterized protein
EWAPFIEILTLLIFGGVLFPNVDGLVDLAAIDAFLAYHDRKENPVVAILADLYDTFDRRCEKSSTRIVCWANWDQLLASKEGASINWFPRWKEGRTGVLISCGGFPNVPLMGTRGCINYNPVLAIRQLGYLMRGAPLEEELAPIIARGEEVEAPEEDEEVQSLRAELEQAQTVKERFKSATLKIRKENAELRDVATTKALEQETKRAHREEHGWNKLRGAMWGSNSELKLRREERDQSRVDTLIVKDELK

SEQ ID NO: 138541 - protein, 80 aa, Glycine max
  Coding DNA Sequence Number=SeqID_46856
MRNVENKANAVIVRMWVNSVHENVIGSRALESRCVTVPQLMLMCFGISRPCNETNYKCALESRGTTVILSVFVLAKPNIV

SEQ ID NO: 138542 - protein, 39 aa, Glycine max
  Coding DNA Sequence Number=SeqID_46857
MVHLLWISSSGVYIHLIVQREQGRVIGNLKNRWLLGEWT

SEQ ID NO: 138543 - protein, 65 aa, Glycine max
  Coding DNA Sequence Number=SeqID_46858
MEVDEPWLGLWLPLNYQVDMGERIAFVDNWAVGKEKGIFYLGTTVAAWVSPSFSPSSFAPVFSFV

SEQ ID NO: 138544 - protein, 70 aa, Glycine max
  Coding DNA Sequence Number=SeqID_46859
VSRICPLDLMMKYAQFQLSLAHQWAKCASTAKCSFNTLSVIEESGRASISRPCAKHEISALSTTVVFSQA

SEQ ID NO: 138545 - protein, 160 aa, Glycine max
  Coding DNA Sequence Number=SeqID_46860
  Homolog annotation: Hit_ID=A5B589; Match level="QueryCoverage=96%, HitCoverage=34%, E-value=4e-09, Identity=31%"; Hit description =Putative uncharacterized protein
MLATVASCMRGNSSARNLAPLDLEIEATCRRNNAERRRKALQERIVQPSSKGTRSSESSLAFPADLRESEVGASEAHIMVEDQPQRVTLEDYSSSIVPQFFTSIARPEVQAHNITYSHSLIQLIQGNLFHGFPNEDPYAHLATYIEICNTMKIVGVPEDA

SEQ ID NO: 138546 - protein, 143 aa, Glycine max
  Coding DNA Sequence Number=SeqID_46861
METCLEVEELLQRMIDQGRLEVGSEGREEQHICMQSAEESSLAKPKPLEEETTNISSLSAKVTNITGLSGVTHSGRVFVPPDLPIQPTNVKGKAKDIPAKGLPEKRDGYGKKEVSLEEASEFLRTIQQSEFKVIEQLNKTPAK

SEQ ID NO: 138547 - protein, 34 aa, Glycine max
  Coding DNA Sequence Number=SeqID_46862
MGSEQKVLPGTVGKGGIVKDPAVHQEVRDFWLFD

SEQ ID NO: 138548 - protein, 93 aa, Glycine max
  Coding DNA Sequence Number=SeqID_46863
MSKEVDMDYQNEEECGMNEPHVDCSDAFNTSQVFDRRDDVLQRARSVAHENRLWRSDEYRCRKKEFVRGDTGTRKCGCPFKLRGKQWLVDKAG

SEQ ID NO: 138549 - protein, 105 aa, Glycine max
  Coding DNA Sequence Number=SeqID_46864
YILCGTSRGYIYLGCYTENKRGYISCGSVQVEGTSAWVVILRTRKGASLVDEFKWRVHPLGCSKRTREGTSLVDLWLVKHFIRLKEISRTIGCLGTRCRHGLWLN

SEQ ID NO: 138550 - protein, 83 aa, Glycine max
  Coding DNA Sequence Number=SeqID_46865
MSASSPSQAKEQDDDTRPLWTYCDFTFNGSYTRMRAHLLKMTRNGVRVCQKVTVAKLIDLKKIDNEATLRVERSKTKSVSLPP

SEQ ID NO: 138551 - protein, 184 aa, Glycine max
  Coding DNA Sequence Number=SeqID_46866
  Gene Ontology: Mol. function=beta-lactamase activity; Biological process=beta-lactam antibiotic catabolic process
  Homolog annotation: Hit_ID=A6B9Y3; Match level="QueryCoverage=28%, HitCoverage=53%, E-value=2e-22, Identity=100%"; Hit description=Beta- lactamase TEM
ECEFSQRRNRADGFDEESIAQLLCIPGQDFARTAAGRCGTDVAAQAMSYPTIITPHILPFCRSVSWCMPPDTDERPWLTLIALTICSGAALVKGQPRHPALKMHPLTRPDGCLLPASAYRQAVTVSGSCMKSMSIQHFRVALIPFFAAFCLPVFAHPETLVKVKDAEDQLGARVGYIELDLNSG

SEQ ID NO: 138552 - protein, 159 aa, Glycine max
  Coding DNA Sequence Number=SeqID_46867
  Gene Ontology: Mol. function=phosphoprotein phosphatase activity
  Homolog annotation: Hit_ID=A5AWR0; Match level="QueryCoverage=91%, HitCoverage=17%, E-value=2e-16, Identity=34%"; Hit description =Putative uncharacterized protein
CAITLEDVALHLGIRVDGRVVAGPSFLHWDELCHELLGEVAPENARKGAALKLTWLLSMLHALLPKEPTMHQLQCRCRAYIMYMIGANLYKELCRASSEVGKSMGGCVILLQSWTWYRMPFIAPRVPRPETTFPLAKRVIPHGDLVGYRSRIDHIESHE

SEQ ID NO: 138553 - protein, 270 aa, Glycine max
  Coding DNA Sequence Number=SeqID_46868
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFYLRQDLSHLKVLLPKSPDRTTEARSSSLSRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138554 - protein, 86 aa, Glycine max
  Coding DNA Sequence Number=SeqID_46869
MVIIVNAEACGYVSMNYYQYIDVVYTNEHIFKAYSAQWWPLGNEAAIPPSNDAWTLIPDPTTIRAKGQPKSTRIRNEMDWVESFEH

SEQ ID NO: 138555 - protein, 158 aa, Glycine max
  Coding DNA Sequence Number=SeqID_46870
MWAFLTGRQIDWAHLVRYRMHKALRAYAPLPYPQLVTLFLCHFQIPIDDEPFVQVKGSFAIGVGAVTSFGYRKDRDGQWLKKDMLPPQDERTPSPPPQRDDSLALMNEFLSELRGLRTYVGECFDSLEGHFEGMDTRITQLEEDVSYLRRCFDLPPPS

SEQ ID NO: 138556 - protein, 139 aa, Glycine max
  Coding DNA Sequence Number=SeqID_46871
MGKAEEVQEQMKADMEAMKEKMAKMMEAIISMKKIKEVDTVAVSATSVVAKVNPMPPSGLNQMNHPTSNMVGKDLGSTDGPMMCKFKMSTPSHHMACLPTIHHPMWHTFPMRMSITPLPYSLKCLSTHGGRHMKFPTTI

SEQ ID NO: 138557 - protein, 333 aa, Glycine max
  Coding DNA Sequence Number=SeqID_46872
  Gene Ontology: Cellular component=cell outer membrane; Biological process=membrane organization and biogenesis
  Homolog annotation: Hit_ID=A4W6G0; Match level="QueryCoverage=100%, HitCoverage=42%, E-value=1e-179, Identity=88%"; Hit description =Organic solvent tolerance protein precursor
  Pfam annotation: Domain name=OstA_C; Domain location=38-333; Score =296.0; E_value=7.3e-86; Accession=PF04453.5; Description=Organic solvent tolerance protein
MWENEFRYLTQAGTGLMELDYLPSDKVFQDEHPSEGDKHRWLYYWRHAGVMDQVWRFNVDYTKVSDPYYFNDFDSKYGSSTDGYATQKFSVGYAIQNFNATVSTKQFQVFSTQTRSTYGAEPQLDVNWYQNDVGPFDTRVYAQAVHFVNTNSDMPEATRIHLEPTINLPWSNDWASLNTEAKLMATHYQQKNVDDYNASNNTDLQESVNRTLPQFKMDGKLIFERDMGLLADGYTQTLEPRMQYLYVPYRDQSKIQNYDSSFLQSDYSGLFRDRTYGGLDRIASANQLTTGVTTRVYDDAAVERFNVSVGQIYYFTESRTGDDNINWEKDNKT

SEQ ID NO: 138558 - protein, 126 aa, Glycine max
  Coding DNA Sequence Number=SeqID_46873
  Homolog annotation: Hit_ID=A7QRL1; Match level="QueryCoverage=96%, HitCoverage=64%, E-value=9e-33, Identity=51%"; Hit description =Chromosome undetermined scaffold_151, whole genome shotgun sequence
  Pfam annotation: Domain name=DUF1475; Domain location=2-126; Score= -42.6; E_value=0.00039; Accession=PF07343.2; Description=Protein of unknown function (DUF1475)
MAAKISLAIGLRTLFTVLGLLMLAIVLYTVFTDGLPFRKELLTPITTSAYIVVQFLKLSSQESSQDPMYYVLLRNPNKNGTAPQRKHSSIVTLRIIFSILGVVMLGTLVYTLITDGSPFRIELITP

SEQ ID NO: 138559 - protein, 150 aa, Glycine max
  Coding DNA Sequence Number=SeqID_46874
MAAKISLAIGLRTLFTVLGLLMLAVFLYTAFTDGLGVRFLKELVRPFCCLDCLQGIKLDQLNSVDCFDCLVRELSMLFKCAWHSTSGYHRGRGRHREEVRKRVDPRQSYVETRLGQHHRYHHANWRERDDITTFYLTRFPEDTTEKDPWA

SEQ ID NO: 138560 - protein, 921 aa, Glycine max
  Coding DNA Sequence Number=SeqID_46875
  Gene Ontology: Mol. function=DNA binding; Cellular component=nucleus; Biological process=regulation of transcription
  Homolog annotation: Hit_ID=A7QRN5; Match level="QueryCoverage=53%, HitCoverage=90%, E-value=1e-137, Identity=51%"; Hit description =Chromosome undetermined scaffold_151, whole genome shotgun sequence
  Pfam annotation: Domain name=NAM; Domain location=19-147; Score =266.4; E_value=6e-77; Accession=PF02365.6; Description=No apical meristem (NAM) protein
  Pfam annotation: Domain name=RRM_1; Domain location=562-633; Score =99.5; E_value=1.1e-26; Accession=PF00076.13; Description=RNA recognition motif. (a.k.a. RRM, RB
  Pfam module annotation: Pfam domain module=NAM::RRM_1; Domain location=19-147::562-633
MGEASGAGSADCFSQMMSSMPGFRFHPTDEELVMYYLKRKICGKRLKLDVIHETDVYKWDPEDLPGQSILKTGDRQWFFFCHRDRKYPNGGRSNRATRRGYWKATGKDRNVICNSRSVGVKKTLVFYAGRAPSGERTDWVMHEYTLDEEELKRCQGVKDYYALYKVYKKSGPGPKNGEQYGAPFNEEEWADDDIVDFNINSADQEAPNDVADNVNVPLPFLDDEINNIIREILDDELVLDQQHVNGYPDFPQVVSEETQSTVVDQFSEDVMLPEPVRISHPSCQFFDAQPSFDFNRPVTSHLHVSETSEVTSASNIKTKELDFNEDGFLEINDLIDTEPTLSNVENSVEYQHFEDGLSELDLFQDAQMFLRDLGPIIHETDSHAYTNALVSSNIECQSYQLLPNPEDANQTVGEFWMHGESNQLSSPGVVYESVGFPTEGNNNQSSTVEDVATSSLSSALWAFVESIPTTPASAAESALVNRALNRMSSFSRLKIKHTNIAASDRIETRISFFLSRWTNNGSEEEEDGAALHLLLLLISWPPPSPSIAAFSVFHTLSLSSHFSVGNIPYDATEEQLIEICQEVGPVVSFRLVIDRETGKPKGYGFCEYKDEETALSARRNLQGYEINGRQLRVDFAENDKGNDRNREQGRGGPGMTTNVDHQKQVGVPAVHGEAVQHQPIGLHIAITAAAVMTAALGGAQFGIQSNQNSLQSQSALAHDPLTLHLAKMSRSQLTEIISELKGMATQNKELARQLLLSRPQLPKALFQLQMPNLRLVSDQTSQSSMNEGQLGQASLVQTLSGLPHGQDKLQPGLTPYAQEGQVNTIPHNPLVPSQLTAHPKPPVQPRIPLQQNPNNLVLPGTLSGQSNLMLPSARSPGLGSLSVRPPIQLATSTALNQQMHASLLQHSVHVGNSTVGHNVQK

SEQ ID NO: 138561 - protein, 142 aa, Glycine max
  Coding DNA Sequence Number=SeqID_46876
  Gene Ontology: Mol. function=transcription factor activity; Cellular component=nucleus; Biological process=regulation of transcription, DNA-dependent
  Homolog annotation: Hit_ID=A2YRQ3; Match level="QueryCoverage=86%, HitCoverage=76%, E-value=7e-25, Identity=49%"; Hit description =Putative uncharacterized protein
  Pfam annotation: Domain name=AP2; Domain location=22-73; Score=57.6; E_value=4.2e-14; Accession=PF00847.11; Description=AP2 domain
MENLPPLMCKNLIRKRTSRRSTMYLGVRKRPWGRYAAEIRNPYTKERRWLGTFDTAEEAAIAYDLSSIKICGINARTNFHYPFVSLPPPPMSLPPPPPPPTPELDPSVEVCPEMNAAYDGDDESLVIASILQSFSNTGNCSF

SEQ ID NO: 138562 - protein, 1597 aa, Glycine max
  Coding DNA Sequence Number=SeqID_46877
  Gene Ontology: Mol. function=phosphatidylinositol phosphate kinase activity; Cellular component=mitochondrion; Biological process =phosphatidylinositol metabolic process
  Homolog annotation: Hit_ID=A5B6P1; Match level="QueryCoverage=92%, HitCoverage=98%, E-value=0.0, Identity=56%"; Hit description =Putative uncharacterized protein
  Pfam annotation: Domain name=Cpn60_TCP1; Domain location=183-604; Score=-264.1; E_value=0.016; Accession=PF00118.15; Description=TCP -1cpn60 chaperonin family
  Pfam annotation: Domain name=PIP5K; Domain location=1332-1566; Score =143.7; E_value=5.1e-40; Accession=PF01504.9; Description =Phosphatidylinositol-4-phosphate 5-Kinase
  Pfam module annotation: Pfam domain module=Cpn60_TCP1::PIP5K; Domain location=183-604::1332-1566
MCSMCHYCGVGLTESNFDNKKQGNESSLKLNGKVSIRPCKSCGEKLERANAKWHSTSPYATPLISPTMSLLSTDSCISTCSEFSVDVNSSDRNSQEESSVEGIVEELDYKLNGSQKVMENNNNNEGYTVRDVEIAQNFQEVKADFSEEPIASSAVEEAEYSLPDDLDVQTWEPPEPENPQDDMENSVTCNDDDEDQGLGIANWGEPTSMSSSEDELSGSYRFKEEKQKAMEEVMNGKFKALVGQLLKSVGVSSSDEGDKSWVDIVTSLSWEAASFLKPGAIGGNAMNPDGYVKVKCIAAGSRSQSQLIRGLVFKKHAAHKHMPTKYKNPRLLLISGVLGHSINGLSSFDSMDQEKDDLKSKMDRIEMCHPNVILVEKTVSRDIQESILAKGMTLVLDMKLHRLERVARCTSSPILSCDNLNGQKLRHCDFIYFEKFVEEHDAVGEGGKKPIKTLMFIEGCPTRLGCTILLKGTHSDELKRIKCVIRCAVVMAYHLILETSFLVDQKAMFSTIPAVSVADILPTDKKSCDSASINSSIPSLEYSAENGIVSTDIPICSGLHEKNTNGLNLGSEEFSQFSCEPYNPAVFSGFSAISSSLKKVMGDSFPFASSAPYQSLSAYFGFNGRKPDGMVNESISVLNSLEADETTTMEAKSHSNEVKLLNGGQSLSSPVHLDSNGNISKDDGNNRKELQSKDDINAVLDSQSILVLMSSRNALRGTVCQQSHFSHIMFYKNFDIPLGKFLEENLLNQTRLCDACQELPDAHFYYYAHHYKQLTIQVKRLPQEKSLLGEAEGKIWMWSRCRKCKSGSTKRVLISTTARSLSFGKFLELSLSHYSSSRKLSCGHSLDRDFLYFFGLGHMVAMFRYSSVATYTVSMPPQKLEFSGAIRQEWLSKETQNVYMKGITLFTEVANCLKTIQFDGLGGSIRDFSEVEKMLKQEQEEFEANIKTVVAKKGDPDQAAFKLLSLNRLMWDLLIKSYVWVRRLYPLHSSDVSEKVMQEHDYSKVEGTASRETGSMGNFIEDGNANVKIMFDTSKQVNELPIKEIPISGPLLECNEQAHPSNTQNERIPIVDDLRSRRLSDQKLNLSLDVIPTHLEVGANSSGSTDIQTNHLVSDFKILNKSASLHSPISNMLDSNDWFWKPFADIRQIGIRELQKRLLPKFESVSCSIAEYIPTANQLITEEGTRLHIPLKTDNHVVSDFEGEPSSIIACALALLKDAYEVSEVDDEDDRNESGITSNSTESLHGLTHGATLTSSHSFSRSSSDSDSVHSAGSTSSEESRASRATENHSIEIAMGYAKSLGREKYSVICHYFKQFRELRNWCCPSELDFIASLSRCRNWDAKGGKSKSYFAKTLDDRFIIKEIKKTELDSFLGFSSLYFKHMRESFEFGSQTCLAKVLGIYQVTKRHVKSGKEVKYDPLMVMENLTYNRNITRQYDLKGALYARYNSAADGAGDVLLDQNFVNDMNSSPLYVSHKAKRVLQRAVWNDTSFLNSINVMDYSLLVGVDSQKHELVCGIIDYLRQYTWDKHLETWMKSSLVVPKNVLPTVISPKEYKKRFRKFMSTYFLSVPDHWCSQKSSNPCKLCCSGEDDPSQQKP

SEQ ID NO: 138563 - protein, 174 aa, Glycine max
  Coding DNA Sequence Number=SeqID_46878
MGRSLQPTHYNGEDVVDDWMNPYSLLKHCLDLECVETWGLMVGGPKRWLNIRCTGYGVVTGNRWASDDLAECKAEDAIDAVRAICIAEDEARDDLAEGKAEDAIDAVRAICIAEDEASDDLAEDKTEDAIDAGVDESKGVDSEGGGSVKPVLASRLQTGQKVLHEVSHESTQAA

SEQ ID NO: 138564 - protein, 297 aa, Glycine max
  Coding DNA Sequence Number=SeqID_46879
  Gene Ontology: Mol. function=metal ion binding; Cellular component =extrinsic to vacuolar membrane; Biological process=intracellular protein transport
  Homolog annotation: Hit_ID=A7QXE5; Match level="QueryCoverage=80%, HitCoverage=53%, E-value=1e-106, Identity=78%"; Hit description =Chromosome undetermined scaffold_221, whole genome shotgun sequence
  Pfam annotation: Domain name=PA; Domain location=44-145; Score=82.3; E_value=1.6e-21; Accession=PF02225.13; Description=PA domain
MGTSNLLLFFSLMSLCAMAASKVVLIGNNITLSFDDIEANFAPAVKGSGKYGVLYLAEPLDACAELTNKVEQLPNASSPFALVVRGGCSFEEKVRIAQKAGFKAVIVYDNEEGGILVAMAGNSAGIRIHAVFVSKASGEILKKYAGLTNVEIWLIPTFENSAWSIMAISFISLLAMSAVLATCFFVRKHRIRRERPRASLVREFHGMSSRLVKAMPSLVFTSVLEDNCTSRTCAICLEDYCVGEKLRILPCCHMYACVLGALFSLNSLRPQAGYLFAWKLTLMFQLLPPFCSSTNYG

SEQ ID NO: 138565 - protein, 197 aa, Glycine max
  Coding DNA Sequence Number=SeqID_46880
  Gene Ontology: Mol. function=DNA binding; Cellular component=nucleus; Biological process=regulation of transcription
  Homolog annotation: Hit_ID=A5BE89; Match level="QueryCoverage=93%, HitCoverage=59%, E-value=3e-26, Identity=40%"; Hit description =Putative uncharacterized protein
VAEVGSKLFLLQEEGWVVCRAFRKPSPSHRQGFDPWCSTSSQQQHFFRDQIQSYARPLSIADILNETNNVPHPVEGTSFSHSFNSDNQQHLNNIISNQTAIIMDKQLLELPQLDSPTASLAIKECNQQQHNGLTNEEYCSDERSNSSAQGIDWKSFDNLFGSQLSDNAAYFSHPNLPLVMPHNHDQASHILGCFPDS

SEQ ID NO: 138566 - protein, 372 aa, Glycine max
  Coding DNA Sequence Number=SeqID_46881
  Gene Ontology: Mol. function=oxidoreductase activity; Cellular component=extracellular region; Biological process=response to oxidative stress
  Homolog annotation: Hit_ID=Q9XFI8; Match level="QueryCoverage=37%, HitCoverage=57%, E-value=1e-28, Identity=41%"; Hit description =Peroxidase
  Pfam annotation: Domain name=peroxidase; Domain location=57-336; Score=-0.3; E_value=9.1e-07; Accession=PF00141.14; Description =Peroxidase
MEDTNELLHLLVDAMNRGLRDVNGRMKWFRNQYNMMSTLMRNNSGFGWDPIGKTFTAHEDVWKDYLKSHPSHSKLRGKSMVDYEYLKIVVGGGVSSGNNSISVDPDDTDATTFEPENRTVGIEEFSYDPNSDTFITPNNYEPAYQPPSPNQPSPPSHPPLDSEVPIEKQNCHKRRRSEYGGSSSAVGINNQGNVLENLSVGIETIAVNFEKISNMMEKREKDRDRDRELEVRGPRFPVPLGRKDGLTFSINLPGTSSRTGQLLDRFAARKFDATDVVALSGAHTFGRAHCATFFNRMNQTDPTIDPSLNNNLMKTWNQKLFFDKFANAVVKLSQLDVLTGKQGQIRAKCSVPDTKKVLTSMVEEGLDLSAQM

SEQ ID NO: 138567 - protein, 559 aa, Glycine max
  Coding DNA Sequence Number=SeqID_46882
  Homolog annotation: Hit_ID=A5BHD2; Match level="QueryCoverage=98%, HitCoverage=76%, E-value=2e-64, Identity=34%"; Hit description =Putative uncharacterized protein
  Pfam annotation: Domain name=DUF616; Domain location=323-559; Score= -58.6; E_value=2e-09; Accession=PF04765.4; Description=Protein of unknown function (DUF616)
MAQQRQSGMERFGVRDLHHANGAGDHVAVGIRGGAALKQPRLRRSARSDRATHLSVAAILVFLFLVLVVTVLVFSYISRDDCKSVVAEISNNGGDSDDLKSDSDFLTNVPRIQRKKVLDFGHGSGGHGRDSRYWDRDDRRRDGDYGEDMMEQTSKDHGDENAEDDASVKTDHDSKSSQDGLQRRGDGLYNEAGRHELKRYEAEYEASLKNLGHSTEDDGKVSHDTDLEKKNAADDIDDEYDDFFDFHDAQMEDSGDSKNMKVKHSNSSVLSLDNEVQKQKEPNDSFDEENNDDVTSEDVEGTSSFNKKKSHDGKTNAKHANPSNGQSTRKSHPETKKKAKRRKFSGHQSLEERESSFLARDQQINCGFVKGPEGSQSTGFDLTEDDANYISSHQNSNASTLSSISVCGVGEVFGVEKSSAGIQLQGMGFEFHVRSMGFWCECLPKTNQRASAQLACIGAKVAMRGGMLGSHFKVTRLSRKNVCFVMFTDEITIRTLSSEGHVPDRMGFIGFWKLVVVKNLPYDDMRRVGKIPKLLPHRLFPFASIDLDDALIMATAWWH

SEQ ID NO: 138568 - protein, 913 aa, Glycine max
  Coding DNA Sequence Number=SeqID_46883
  Homolog annotation: Hit_ID=A7Q7D4; Match level="QueryCoverage=28%, HitCoverage=72%, E-value=5e-44, Identity=42%"; Hit description =Chromosome chr18 scaffold_59, whole genome shotgun sequence
  Pfam annotation: Domain name=FHA; Domain location=49-117; Score=60.4; E_value=6.1e-15; Accession=PF00498.17; Description=FHA domain
MASIAAMAENKNPEQEDQARFPILTVLKNNAIVKSIFIVLDDHNEDQMVLIGRHPNCNIVLTHPSVSRFHLRIRSNHSSRTLSLFDLASVHGTWVRGRKLEPGVSAELKEGDTFTVGISTRIYRLSWAPLTQLDDENLELRAEEEIPMPEDIVSLCCDEERKSHAEDEALGVLNGTETSCAPTNSGGENIICDCQLSPPYIQSPPYAQPVDELHNTKKIEACVEGTKIQQFQAPHDTFTGQPPSLEMHWSSFPMNIDPTSFHGKDVAAVAVVPTESEFGCTHEDNDNIEGILNTGSRTFNSENTRLIVDEDIPDSEFHQMEVVEEVSVDSVPGGEKQDELHWSSSPTNLDHASLDEKFVAAVAIIPTESEFGCTHGANDKVEDILTTGSRIFNSENTCLIVDKDIPDSEFHQMEVEEISVDSVPDGEKQDECKEEDLNAKSCREEGYSLDEVVEDNGNKCIKTIDPASFDGKGLATVTVIPTESEFGWTLGDNERIEDILEMESRTINSENTSLLDEEAIPVDKFQLINIIEEVAMDSISDGEKEDKCGMELESKLPASLNEKSCHEQESPNSSMPWEQTPQSLTAVTGCSGGKCKPASAPQVRARKSRFVSTAKVGTEVKRSNVKNVVINKSMPKDLSSVFDEKEAFTPNNENLCPKYLSLAVYEKESIYSAKNISSVSNKVNQTPKVAQEWKSQRKPLQCRINLVHEQDLMQLKKNRVERVPPFQSLMNSRGNHKSVTVSAAKSIDDAHICGQISNKCTKPSQYTSREQKRSWDMVVDTASLLNKESRKALQLLQGLKGTRLTIPSLVIRELGSMKQQFRILRTTSEASLALEWIEECLEKTRWWIHIQSSMEEFRLTALTPPASPQTRFIEESWALPGFNTSKKCASPKVEDHILDCALPLFHHDFGSRN

SEQ ID NO: 138569 - protein, 461 aa, Glycine max
  Coding DNA Sequence Number=SeqID_46884
  Gene Ontology: Mol. function=hydrolase activity; Cellular component =integral to membrane; Biological process=medium-chain fatty acid metabolic process
  Homolog annotation: Hit_ID=A7QN19; Match level="QueryCoverage=98%, HitCoverage=80%, E-value=1e-166, Identity=61%"; Hit description =Chromosome undetermined scaffold_129, whole genome shotgun sequence
  Pfam annotation: Domain name=Abhydrolase_1; Domain location=178-408; Score=18.8; E_value=0.00015; Accession=PF00561.11; Description =alphabeta hydrolase fold
MDQYCLPADSSNAYWLLLQVLSLIPLWHYLLLAAFILFSILYNFLELYFLQDLFSGFSGSPVLLSYNTSSSILNAVVSKCKILHGRYFATPWLCSPHLQTLFLNYFGRPPPLKYTKQLFSTADGETIALDWLSTSHVSGDVASEDESVPIVVVIPGLTSDSSSQYIKHLAYHTAKRGWKVVICNHRGFGGVSITSGFSYNAGWTEDIRAVVNYLHKEKSMAPLFVVGTSIGANILVKYLGEDGENIPVAGAVAVCSPWDLLIGDRYIRRRRVQKIYDKAIAFGLQDYAKLHQSHFSRNANWEGIEKSFTVRDFDDHATRVVAKYESVDTFYRRCSSSTYVQSVSVPLLCISALDDPICTTEAIPWDECKANKNIVLATVKHGGHLAFFEGITASHLWWVRAVNEFLGVLHSSNYMHVQEKISKPNIPLDSSIDHGRYFNVAEDGMVAELNNDQLTMWKKHM

SEQ ID NO: 138570 - protein, 360 aa, Glycine max
  Coding DNA Sequence Number=SeqID_46885
  Gene Ontology: Mol. function=endonuclease activity
  Homolog annotation: Hit_ID=Q2HUP4; Match level="QueryCoverage=50%, HitCoverage=72%, E-value=6e-67, Identity=61%"; Hit description =Endonuclease/exonuclease/phosphatase
MGCVQAKPLDLEEGPEYRTLDRLKLDNGCVPSTDFVAHRRSTGQRHHEPNKEYERLHQRREQPRKQTNELIESGVANAEGLHHKGKVVGRQGRRVTRRDDKNLANQCCFEDDMVDGWPKWLVDNVPTQVLAGLVPRSAESYKMIDKAFDSQRKTLSNLYDMDQLRNNVNARSLPGSNALYGSSTVSKEQGPLQRRPDVVKSKQGFPHFRERVWVKKLIHDRRIRFGTWNIGTLTGKSMEIVDVMVRRKINFMCLQETKWTGEKTKELDNSGFKLWYTGKIISRNGVGIIVDKEWKKDVVDVGLAEHFKVKFWEDLEGVLQDIPQGEKVFLGGDLNGHVGSVARGFEGVHGGFGLGEMNGE

SEQ ID NO: 138571 - protein, 69 aa, Glycine max
  Coding DNA Sequence Number=SeqID_46886
  Homolog annotation: Hit_ID=A7Q773; Match level="QueryCoverage=60%, HitCoverage=24%, E-value=9e-14, Identity=83%"; Hit description =Chromosome chr18 scaffold_59, whole genome shotgun sequence
MQNQDSQKCVSEKKPLVVLWRQLDSAMVETAKWAMFGFAVGLLTEYATGSDFVDQVKILLSNFGIVDLE

SEQ ID NO: 138572 - protein, 71 aa, Glycine max
  Coding DNA Sequence Number=SeqID_46887
MAITRGIKELTYHTYCKESDDDGRRGTLTEVWHSGCQTLITNTMRGCTDVGGDQTAKKVAHRCGRGSNPNH

SEQ ID NO: 138573 - protein, 186 aa, Glycine max
  Coding DNA Sequence Number=SeqID_46888
  Gene Ontology: Mol. function=carboxypeptidase A activity; Cellular component=integral to membrane; Biological process=proteolysis
  Homolog annotation: Hit_ID=A7QX56; Match level="QueryCoverage=70%, HitCoverage=29%, E-value=4e-60, Identity=83%"; Hit description =Chromosome undetermined scaffold_213, whole genome shotgun sequence
  Pfam annotation: Domain name=Peptidase_M14; Domain location=36-179; Score=26.1; E_value=6.4e-09; Accession=PF00246.15; Description=Zinc carboxypeptidase
MDLLMDSYDVVIAMICSAFNFKYVDLAQGYMSNDDLEWAIQEIGQRCSNISRIYSIGKSVNGFPLWVIEISDKPGEEETEPAFKEIIGFIGNVHGDEPVGRELLIFLANWLCDNHLKDPLATLIVENVHLHLLPSMNPDGFSLKKRGNANNIDLNRDFPDQVVEDALFFCWTWLKNLEKGFDTPFH

SEQ ID NO: 138574 - protein, 164 aa, Glycine max
  Coding DNA Sequence Number=SeqID_46889
  Gene Ontology: Mol. function=boron transporter activity; Cellular component=integral to membrane; Biological process=response to boron
  Homolog annotation: Hit_ID=A9YTW6; Match level="QueryCoverage=98%, HitCoverage=53%, E-value=7e-66, Identity=78%"; Hit description=Major intrinsic protein NIP5;1
MPESETGTPTAASVPATPDTPGGPLFTSLRVDSLSHERDSFAMARCKCLPTKGHICFTDFSVGVPLPNVSLTQKVGAEFVGTFILIFAATAGPIVNNKYNGVETLMGNAACAGLTVMFIILSIGHISGAHLNPSLTIAFAAFRHFPWAHVPAYIAAQVSASICA

SEQ ID NO: 138575 - protein, 554 aa, Glycine max
  Coding DNA Sequence Number=SeqID_46890
  Gene Ontology: Mol. function=inositol or phosphatidylinositol phosphatase activity; Cellular component=intracellular; Biological process=abscisic acid mediated signaling
  Homolog annotation: Hit_ID=A5BUY8; Match level="QueryCoverage=98%, HitCoverage=83%, E-value=1e-107, Identity=52%"; Hit description =Putative uncharacterized protein
  Pfam annotation: Domain name=Exo_endo_phos; Domain location=117-515; Score=38.5; E_value=2.4e-08; Accession=PF03372.14; Description =EndonucleaseExonucleasephosphatase family
MKQGSANNQQLLWARVVMRKWLNMASNEPDYTADPDDDNEEDPESDSDNEDAATPFQFRYFCDLPQFEYAEWGKRTRFGDSREELAPIESNEFLPRLRRQKSLTSRSQYINKKELRVCVGTWNVGGKLPPDDLDIDDWLGINEPADIYVLGLQEIVPLNPGNIFGAEDTRPVLKWENIIRDTLNRARPKAPKMKSFSDPPSPSKFKPSDDAPDIEQEILLESDGDIGEEVHPLDEEYNVYEGGADKPITDEEALNTNLQASVAADIANTGEPVGNDLQRQFSDGKRLNRLNCFRDENSTEKTDTSSSQQASKLSRMISSSDRIGLSWPEPPLHLLSQRPLDRPTSFKSVRSFSASKSFRTCQTFKQTIDDIGLLAEIDLEALMKRKRRSSYVRIVSKQMVGIFITIWVRRCLRKHIQNLKVSTVGVGVMGYIGNKLTKELEKGVFDGWSEGKLNFPPTYKYEINSEKYYGEDPKVGRRTPSWCDRILSYGTGMRLLRYGRTELRFSDHRPVTATYMAEVEVFSPRKLQKALTFTDAEIENEEVMATLGSWNLAK

SEQ ID NO: 138576 - protein, 74 aa, Glycine max
  Coding DNA Sequence Number=SeqID_46891
MQTRQLFCTLVGISSSLSFLITMRPVFLGTTWTRLTHWLLEMGVATYPFVGERGEAHRCVFHKRKMRGVATNVY

SEQ ID NO: 138577 - protein, 165 aa, Glycine max
  Coding DNA Sequence Number=SeqID_46892
  Subcellular localization annotation: CTP_CleavageSite=48; ConfidenceScore=5.25e-01
MNSLPSAVHVSSTFESGAPRLDCLALFANSQFSTFIHSPMNSLPSGVHASSTNEYEGPRIDCLALFASSRFFTFILSPMNSLPSAVHVSSTFESGGRRIDCLALFANAPFSTFIQSPMNLLSSVVHVFSIFESGAPRIDCLALFANSPFSTFIPSPMNSLHSAVH

SEQ ID NO: 138578 - protein, 88 aa, Glycine max
  Coding DNA Sequence Number=SeqID_46893
MEDCLEGPHLGNHETQLPNLESGGHMNSLAKRNSWGSEKGREWRTCLEGSALRQSCETQLQTRKWGHMNSPRQNVHGAPKKGENGGLP

SEQ ID NO: 138579 - protein, 81 aa, Glycine max
  Coding DNA Sequence Number=SeqID_46894
  Homolog annotation: Hit_ID=A0PAV3; Match level="QueryCoverage=46%, HitCoverage=17%, E-value=4e-07, Identity=76%"; Hit description =Restriction endonuclease
MVKVGTSYVPINVSFSPKVGPGLPGINRDTRIYLFWEVIFRHSCPSCSATTGWCVTAKAPPDISAGKCSGHAARNHHTRRA

SEQ ID NO: 138580 - protein, 226 aa, Glycine max
  Coding DNA Sequence Number=SeqID_46895
  Homolog annotation: Hit_ID=Q6UUU1; Match level="QueryCoverage=26%, HitCoverage=40%, E-value=2e-18, Identity=78%"; Hit description =Putative uncharacterized protein
SALDGEEHLGEWRNPIGKITKITFPSQEGSALDGEEHIGEWRNPIGKITKITFPGEEGSALDGEEHIGEWRNPVGKITKITFPSHDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138581 - protein, 187 aa, Glycine max
  Coding DNA Sequence Number=SeqID_46896
MIRGDTLWLSAPFCHPEAAGPMTSRDQVWSFCTLVSSRGGGPDDTRRYLTVIRTLLSSRGGGPDDKQRPKAAGPIIRGDTLRLSAPFCHPEAAGPMIRGDTLRLSAPFCHPEAAGPMTSRDQIWSFCTLVSSRGDGPDDTRRYLTVIRTLVSSRGGGPDDTRKYPSGYPYKHSFAICKTERLIACRG

SEQ ID NO: 138582 - protein, 163 aa, Glycine max
  Coding DNA Sequence Number=SeqID_46897
MDNEEGVQEQMKADLSALKDQMASISEVMLKLQKTIEDKATATASSIVREAEPVLQPALNPGLDRNTAVFGRRYSPQAYPYGLPPDFTPRATPEDLSQAPTFEGQLPPYEDYPGQDDGEGDTHLGPLLHLKDPSPHELPQPNIVRHIPASPTPVKESVPFRGR

SEQ ID NO: 138583 - protein, 397 aa, Glycine max
  Coding DNA Sequence Number=SeqID_46898
  Homolog annotation: Hit_ID=Q6WAY4; Match level="QueryCoverage=90%, HitCoverage=78%, E-value=2e-28, Identity=27%"; Hit description =Putative uncharacterized protein
SLDVTSLKELGRLMGPLQRQAFCKVYRKILDLTIAEVFTEAIVSLAQYYDQPLRCFTFGDFQIVSTVEEFEEILGCPLGGRKPYLLSGFLPSLSKIAAARQGIWRVKKSPPWFADILALLIFGVVLFPNVDGLVDLATIDAFLAYHHSKESPVVAILADLFDKFDRRVDWDQYLAGIGGSTINWFPRWKDGKEGVLFSCGDYPNVPLIGTRGCINYNPALAIRQLGYPMRGAPTEESLSPFLVRDFGTQSLKVLQRVHKALKSPLRKDKELRGIHNGIIGGYHEWLRVHTRGLDWLSKLKVINEENFKAPGEDEEVQALKLELGKARLTKEKFKSAATNIRKECAELQEENAATARALEQETKRACKEEHGRDKFRGALWGNNNELKLRREERDQSR

SEQ ID NO: 138584 - protein, 178 aa, Glycine max
  Coding DNA Sequence Number=SeqID_46899
  Gene Ontology: Biological process=transposition, DNA-mediated
  Homolog annotation: Hit_ID=Q1J7G7; Match level="QueryCoverage=18%, HitCoverage=47%, E-value=5e-11, Identity=93%"; Hit description =Transposase
MKTFQFAHGKRCNKGEHYPISPAHRLSLPYEIPDEHSSGGQEYQRVIFAKSWPRASRYQQGHQDLFILRSDLPSQVLQWVLFLSAVPPVQLLTGWCVTAKAPPDISAGKCSGHAARNHHTRRAYCAATGRVPFAIQAAQLLGRAIGAGLFAITPAGERGMCCKAIKLGNARVFPVTTL

SEQ ID NO: 138585 - protein, 243 aa, Glycine max
  Coding DNA Sequence Number=SeqID_46900
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLHLDIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138586 - protein, 227 aa, Glycine max
  Coding DNA Sequence Number=SeqID_46901
  Subcellular localization annotation: CTP_CleavageSite=22; ConfidenceScore=5.48e-01
PPPPPPTSDASASPSAVKRTRKASHLRSLSTRPPGAKRPVVHVDPATGKADGPHKKKLRTYLGIVARDKVDITYENWKEAEFDIPEASDSRTKGSYYRQWGRDGGSLNQTSRGNGPLQPIRTVSRTLFVTNTTSARKSGPSFARLIETLLGRMCASRHRPSRSRILPPTFSLVGTKKKMQEAAQSGNVDGVIDPPSPVRRHVKWKMARTKKTGEMTTKAAKEIAEKI

SEQ ID NO: 138587 - protein, 67 aa, Glycine max
  Coding DNA Sequence Number=SeqID_46902
MMTTKDDDKGDEQKAQRSKNNSSESKNISSESRTSQEFKNQGEFKTQEESLESRFKTQDSRMKKRLN

SEQ ID NO: 138588 - protein, 183 aa, Glycine max
  Coding DNA Sequence Number=SeqID_46903
  Gene Ontology: Mol. function=helicase activity; Biological process =viral genome replication
  Homolog annotation: Hit_ID=Q9LW42; Match level="QueryCoverage=100%, HitCoverage=12%, E-value=1e-46, Identity=44%"; Hit description =Helicase-like protein
MLSYLTKNHQRGKTVAYSKYPTSDEIDLIISVEIPSKEDDQELYALVQNHMVHGPCGIIRSESPCMKEGKSSRFYPKMFQPRTLLDANGYPVYRRRNDGRTISKNGVIIDNRHIVPYNPKLLKKYQAHVNIEWCNQSTSIKYLFKYINKGYNRVTAVMLYDGNDEIQNATNQKDEIKEYIDCR

SEQ ID NO: 138589 - protein, 77 aa, Glycine max
  Coding DNA Sequence Number=SeqID_46904
MFPHGKMPKKWVFKPYLTPTYQSPLIYMFFFFLQGEGTVQSYPLRALDRRLQEDWTKDAREGPRILMSLMVDFGPMG

SEQ ID NO: 138590 - protein, 254 aa, Glycine max
  Coding DNA Sequence Number=SeqID_46905
  Subcellular localization annotation: CTP_CleavageSite=53; ConfidenceScore=5.16e-01
MTIQNMQFQQETKAFIQSLTNQMGQMATHLNQAQSQNSDKLPSQTMQNPKNVSAITLRYGNQIQVPPLVATPAPEPVKLHSTPEKEDEIVAEKRKLPNRNFQVGGPSSSNSDLKQPPIPLSFPPRAIPNKKNGRSEKRDLGDLQESRGKSHYCFLDGFYGYLQIQIAPECRSEDFAFDVLMMPYDRDVLMPSENALLKFNSRQKSKNTRYKIKKISSVLGREFQIKTAKGLAKKFKQKCIFQEIYSLVINYQRM

SEQ ID NO: 138591 - protein, 102 aa, Glycine max
  Coding DNA Sequence Number=SeqID_46906
GVPVAPSKVIRQPITQAFIEKYCTQRQAQGGDPQAPDAPPPPPQADPAGSFDTEREEVAWPGDWPEAQAAEASAEAPGEPDEAREDEEMSDLLGFLGGSGAT

SEQ ID NO: 138592 - protein, 175 aa, Glycine max
  Coding DNA Sequence Number=SeqID_46907
GVPFEGTLVDDWKHVYSSLDARKMICTDHADMIGRLLAGSFTFECRIMHYVLYRILLPRSTNLAQASEEDLILLWALQIGHQIDWAHLHFNVPLDDEPFVKVCKQDLPPPIPNERTPSPPPQRGDSSSLLTEVLTELRDLRAFVGDRFDEMDSRITRLEDDMSFIRRCFDPPADS

SEQ ID NO: 138593 - protein, 95 aa, Glycine max
  Coding DNA Sequence Number=SeqID_46908
  Homolog annotation: Hit_ID=Q6WAY6; Match level="QueryCoverage=90%, HitCoverage=15%, E-value=9e-09, Identity=38%"; Hit description =Putative uncharacterized protein
MGTRGCISYNPVLAIRQLGYPMRGAPLKEELALVISRGFNKTNMETLQKVRKAWEVVQKKDKELKGSNNGPISGYRKWLKAHVQGLDWLPEIENH

SEQ ID NO: 138594 - protein, 39 aa, Glycine max; identical to SEQ ID NO: 132464
  Coding DNA Sequence Number=SeqID_46909

SEQ ID NO: 138595 - protein, 61 aa, Glycine max
  Coding DNA Sequence Number=SeqID_46910
VLQATPVYNHTEALPDEIIPLLKVSGNQQRLERFSRSWILRFIGVVTFVDKSRKRVPMRYL

SEQ ID NO: 138596 - protein, 92 aa, Glycine max
  Coding DNA Sequence Number=SeqID_46911
  Subcellular localization annotation: CTP_CleavageSite=54; ConfidenceScore=5.23e-01
MVKVGTSYVPINVSFSPKVVAQGFRTYSQYRATSRGDAAELTDLVSEALRPDISVASVAGVRRCANSPPRRLIAAATGRAFHSGNLSGCATA

SEQ ID NO: 138597 - protein, 86 aa, Glycine max
  Coding DNA Sequence Number=SeqID_46912
MSNSDSRTCHRAIRLVIAGFSKMYLTGSILDTNQDKRSPRHRRHKHKRIHKALFDSSECLLTVVIPTDGLVLVQEFEEWLASSGEL

SEQ ID NO: 138598 - protein, 198 aa, Glycine max
  Coding DNA Sequence Number=SeqID_46913
  Homolog annotation: Hit_ID=A0PAV3; Match level="QueryCoverage=32%, HitCoverage=31%, E-value=6e-07, Identity=52%"; Hit description =Restriction endonuclease
  Subcellular localization annotation: CTP_CleavageSite=96; ConfidenceScore=5.15e-01
MVKVGTSYVPINVSFSPKVGPGLPGINRDTRIYLFCEHRRTSALASVAVTLRVTTTPAALNAPLQGASHSPFRLRNCWEGRSGFPSHDVVKRRPVNCNTTHYRANWSSTAVAAALELVDPPGCRNSIPPQPSPGRPTRPRRLRRAGAHPRPPRRCQRPKRLARRGGGRRTVPRRPSSLSIPSTSRGGPVPAFVPFSEG

SEQ ID NO: 138599 - protein, 118 aa, Glycine max
  Coding DNA Sequence Number=SeqID_46914
MRTLGPSLVALAQASWSLLSNALGGLDCIKAHVQGLDWLPSLRTTKREEVEAPEEDEEVQALRAELEQAQTVKEGFKLAALKIRKENAELRDTNIATTKALEQEIKRARREEHSRNKF

SEQ ID NO: 138600 - protein, 113 aa, Glycine max
  Coding DNA Sequence Number=SeqID_46915
MARGNPGDLQPFDPEIDRTFHRLVRHSVHPGHCRSKLHDESRLIQRSFDDNKSDDKKLKESKNKFKMLKIESRTLQVSRGNLISRIKNQDSRFKLPRIKIKIQDSRFKNQEKN

SEQ ID NO: 138601 - protein, 193 aa, Glycine max
  Coding DNA Sequence Number=SeqID_46916
MPKCQLVYAVLTRMSIHVAQLIADAIYIFAGMAPTRHPLDPDKSNRALGFPALITGLCQSFGVPVAPTKRQAQGDAPQAAGAPPPPHQAGQAGAFDMEQYLRHLVRQQAANHRAHVRTHDCLYQMSLSMQSQGFAPFSCPTPDQFRAEVAWPGDWPEAQAGEAPPEAPGDGEEAHEDEEMADLLDFLGGSGDT

SEQ ID NO: 138602 - protein, 305 aa, Glycine max
  Coding DNA Sequence Number=SeqID_46917
MTDPGSSQEAWERYTDIVVPRKLLPDRNVVVYYTKFDEFKEELERRHWDEKLTDFANNNMDIAIVKEFYANLYDPKDKPPKQVRVRGHLVKFDEDTLNTFLKTVVILEEGEILCSFSRFALLRPDPQELAAKLYILGRGFELNADGQPLKILRKNMTTLAQTWNVLYFFNLIPTSHTSDVTLDRAKLIYGIIMKMDMNLGYLISHQISLTAQHDTSRLGFPALITTICKARGVQSDSRSLENLSLAINLAYIKKNCWNLDGPIVTFRGPRKARDAALHAPELTQGAVHYHAEPSGLGLVIHHEHG

SEQ ID NO: 138603 - protein, 312 aa, Glycine max
  Coding DNA Sequence Number=SeqID_46918
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFFAKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIHRELIASLHWVQMHPVLRMLMDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138604 - protein, 156 aa, Glycine max
  Coding DNA Sequence Number=SeqID_46919
  Subcellular localization annotation: CTP_CleavageSite=48; ConfidenceScore=5.05e-01
MVKVGTSYVADQRSSCQGPARSDVLSRPYFSNIRRQDFSGKASLRPIRHSVRNCWEGPDRCGPFAINDGQLAKGEAQVAIKLGNARSVQSLAYYVTLMWQGMKLPPRCVRSRIVIPRAQDIRFLGLTEHDSVVRLAASGNGLRTGRRFPGRCQEDT

SEQ ID NO: 138605 - protein, 156 aa, Glycine max
  Coding DNA Sequence Number=SeqID_46920
  Homolog annotation: Hit_ID=A5AK77; Match level="QueryCoverage=39%, HitCoverage=7%, E-value=2e-07, Identity=44%"; Hit description =Putative uncharacterized protein
MTRGNPSDLQPFDPEIDRTFHRLVRHHFIPFDHSEHSITGEAVHSVISDFEHPDLEHYNFEHSNSEHSDFAHSENMAQPPPHERTLREMTAPDFTYESLCIQYPDEDVPYVLKTGLIHLLPKFHGLAGEDPHKHLKEFHIVCSTMNPQMSKRITYL

SEQ ID NO: 138606 - protein, 209 aa, Glycine max
  Coding DNA Sequence Number=SeqID_46921
  Gene Ontology: Mol. function=dihydrofolate reductase activity; Cellular component=integral to membrane; Biological process=one -carbon compound metabolic process
  Homolog annotation: Hit_ID=P0ABQ5; Match level="QueryCoverage=72%, HitCoverage=95%, E-value=4e-81, Identity=92%"; Hit description =Dihydrofolate reductase
  Pfam annotation: Domain name=DHFR_1; Domain location=53-208; Score =184.3; E_value=3.1e-52; Accession=PF00186.10; Description =Dihydrofolate reductase
MAGSSATERAAVFKRTSAMLTEIINEDRNHLSLIQRHGWQGTEEGKHTGDPADEPETLAVDRVIGMENAMPWNLPADLAWFKRTTLNKPVVMGRLTWESIGRPLPGRKNIVISSQPGTDDRVEWVKSVDEAIAACGNAEEIMVIGGGRVYEQFLPKAQKLYLTHIDAEVEGDTHFPDYDPDEWESVFSEFHDADAQNSHSYCFEILERR

SEQ ID NO: 138607 - protein, 185 aa, Glycine max
  Coding DNA Sequence Number=SeqID_46922
MAPPKEIVIVIYHNGHIADDPVQGSVYTCANPIFIYVSRSITLTQLIQKINNRLPTRATAKVAQLLFCGPISFHQGQTRYISSQLLDNDDLGGAMEIILQNPQLNSAEFYVVTDLIPQPQPSSPQPSCPQLQLPPPQQLTYNNLNLNDPMSSYNNLKHKTRLTFILHTHNYYLKIILFLCPTKLL

SEQ ID NO: 138608 - protein, 237 aa, Glycine max
  Coding DNA Sequence Number=SeqID_46923
  Homolog annotation: Hit_ID=A4VHK2; Match level="QueryCoverage=34%, HitCoverage=38%, E-value=8e-07, Identity=36%"; Hit description =Putative uncharacterized protein
  Subcellular localization annotation: CTP_CleavageSite=34; ConfidenceScore=5.06e-01
MASGCFARFSRVCAIRPVTSRKARLPTFSDVTCRRRAIWEERRIRMSGHFTCCLCTNPGATFLAFFKQAQFTDKIALVQIRKDHLFPFLIFDQHCHRAFDDVIQRFRFFTLVNQRALRWVLMNVAMRQEPFESRVCLRFAKHHALLSSVISCHQSHQMHPDSGVAIEFLPIPWEVGCRNVSQPHPECFSIAFAACLLVSRFSMMQVAFRCEKCNARVICHRKCNVGVKEYASAREMG

SEQ ID NO: 138609 - protein, 266 aa, Glycine max
  Coding DNA Sequence Number=SeqID_46924
METGRSVKGKQKALVLPNRSQKQLKLQNVDRVQFFESLLQTGHHGRLRCAQPYAWIVVFLVRLVFAFRVAQLALQDTVPGCPLGVGIDVHFHNAVAYGVFDFLSRRTGTAVEDEVQAVVRQVEFLGHVVLRITQDGRGQLDVAWLVHAVHVTEGGSDGEARADGVQFFVRVSHVFRLGVQCGSVHMAVVHAIFFTAGAAQFDFQRHADFGHALQVGGADLDVFFQRLFRQIDHVRREQRFAGSGEVLLASVQQAVQPWQQFLRAVV

SEQ ID NO: 138610 - protein, 111 aa, Glycine max
  Coding DNA Sequence Number=SeqID_46925
MVGGLNSRMALTKGAFPTGGESIKFWTDTWLGDQYNLQQKYHQLFLISRQQKDHISHMGHFNHNTWTWDLRWRRNLFDHESLLAVQFMEDISSVPIQRQVKDNMLWLAESN

SEQ ID NO: 138611 - protein, 143 aa, Glycine max
  Coding DNA Sequence Number=SeqID_46926
MDNIFKKRWRNKKILTGVALLLIIITASISIALSLIIAQNQAISKEKKHLKEITTGVLMRMSATRAQFSEIVNHFSGVKEADACAPHHVQKMQEYNVAGFFLQAVAHIQNNRIICSSISELLDGMTLGTPYRVEPDGSSSGGV

SEQ ID NO: 138612 - protein, 277 aa, Glycine max
  Coding DNA Sequence Number=SeqID_46927
  Homolog annotation: Hit_ID=A5AWV0; Match level="QueryCoverage=85%, HitCoverage=18%, E-value=1e-14, Identity=22%"; Hit description =Putative uncharacterized protein
  Pfam annotation: Domain name=Peptidase_C48; Domain location=101-274; Score=-33.3; E_value=0.063; Accession=PF02902.10; Description=Ulp1 protease family, C-terminal catalytic domain
VSVEQVKDADAPVPVPTDEVSLVGQALHTFLAWPTHLVAVSPPKPPPKPDLEVRWDATVFEVVNPDFPLYIKHEDLSEIAHGGQCLSLSVLQLWILHLTETCMRAENSDIYGFLEPQSIQRSGQSQFESESYIKSWMQSSQRDVYLGAYLNGFHYSGHWQMVVIVPKEHLVVWFCSLHNRPDNYLKEIINSAIKGLDDAPQPKSKASARWIVVKCNRQKGTTECGYYVMHWMSTIILGSPRNNWEAYFNDPRPLEPERLKALRIQWHSLNLRVRDQP

SEQ ID NO: 138613 - protein, 82 aa, Glycine max
  Coding DNA Sequence Number=SeqID_46928
MAIKGLFICDLEHEFAQSFSEQKRTCKGLLQDSGTLKRVAWGLGVGTRGCLWSRPPNDDERFIFVGDGKKMQWKLLELLDYS

SEQ ID NO: 138614 - protein, 141 aa, Glycine max
  Coding DNA Sequence Number=SeqID_46929
MLNQRIELTLPDELSDLQEIYAYKILTAIAKEIPWKRCQKLVRRPTSAPDRASSIKRWSMCWSSYWATNATKDVLYLTKFLCSMLSAGLLNPDVSCMFSLILIKCRPQIPHVGLNLTRTALRHTYQQLGYRTTIPHANMLN

SEQ ID NO: 138615 - protein, 78 aa, Glycine max
  Coding DNA Sequence Number=SeqID_46930
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=35%, E-value=2e-12, Identity=88%"; Hit description=LacZ protein
MWQLHQMQAHPPFASWRNSEEARTDRPSQQLRSLNGEWDAPCSGALSAAGVVVTRSVTATLASADVRRCFCRYAPPRQ

SEQ ID NO: 138616 - protein, 41 aa, Glycine max
  Coding DNA Sequence Number=SeqID_46931
MEEIHGEEAEWRRRKGDWRRYFKEKMSQEQAHHHRKSWRRA

SEQ ID NO: 138617 - protein, 91 aa, Glycine max
  Coding DNA Sequence Number=SeqID_46932
FTRDSPQISASPHQLDLAPYTSEPYNAQWNAPGLLCDKHTLCSSRILEVMEVDEPWLGLWLPLNYQLDMGANFVVDLGMAFVDNWAVGKEK

SEQ ID NO: 138618 - protein, 133 aa, Glycine max
  Coding DNA Sequence Number=SeqID_46933
MEKSDKRNFKEKKAYITWEDNDMDSSSDLENEIINLGLMAKDYESKEEVMSSNYDSSISFDKLQDAFNDLHKESVKLAKLVSYSKKTISSLEKEISNLKFEDLKIVIAKFTLVTSSTLLTCFYCGKKDHSAST

SEQ ID NO: 138619 - protein, 36 aa, Glycine max
  Coding DNA Sequence Number=SeqID_46934
MWVSIRAPPEKALFTTEPLQPHSSSTDKGWSYDAGS

SEQ ID NO: 138620 - protein, 87 aa, Glycine max
  Coding DNA Sequence Number=SeqID_46935
  Subcellular localization annotation: CTP_CleavageSite=34; ConfidenceScore=5.03e-01
MWVQAIGLFAQATCAPEFGLPRPFNQRLLVLHVGGGAVKQRESFTTRDPRSVNPFSEIRRREEEISLKRDRLYNEDQSKFLIEYASG

SEQ ID NO: 138621 - protein, 194 aa, Glycine max
  Coding DNA Sequence Number=SeqID_46936
REEHTYTNVQGAPGPTPDSKCLLDPIWGAPTERVMQQFGYTQTIPAPPANSWVSFDDIHDRWMHYSDHMAATGDNCVVPGQCASDYMDWFFCILHSFMTPGQPSDPRADGHATQPRVATQDLDTDIRPVMEPATPSTSARSDVAEPRHAVEACHAIAERLESHLNLGVVTPGTSTHELIEECLRIARSVTQDEL

SEQ ID NO: 138622 - protein, 72 aa, Glycine max
  Coding DNA Sequence Number=SeqID_46937
  Subcellular localization annotation: CTP_CleavageSite=61; ConfidenceScore=5.09e-01
MTRCGYRKVSPHATGLSGRWIAKGVCGLPSGVSACHRTLGSQVTKGGVVNKSKAFAPTYPQFMMRNSDLRSS

SEQ ID NO: 138623 - protein, 92 aa, Glycine max
  Coding DNA Sequence Number=SeqID_46938
  Subcellular localization annotation: CTP_CleavageSite=37; ConfidenceScore=5.26e-01
MFAHSIKGCRPLGRACGVLIPSPSRLFRFFRRFPQINVGGDSARIPFVEHASRESRVALPPKGRLRQLLCKQSMGQNTPNDYNDGWLKFSQR

SEQ ID NO: 138624 - protein, 79 aa, Glycine max
  Coding DNA Sequence Number=SeqID_46939
MSGFTRNSPQISVSPHQLDLAPYASEPYNAQWNAPGLLRDKHTLRSSRILGEMEVDEPWLGLWLPLNYHAFSLQNSLLG

SEQ ID NO: 138625 - protein, 45 aa, Glycine max
  Coding DNA Sequence Number=SeqID_46940
MEKRTWECLKQSQMKILWKIHIFMKKSTKTKKKEIAKILNPKKIK

SEQ ID NO: 138626 - protein, 78 aa, Glycine max
  Coding DNA Sequence Number=SeqID_46941
MTACSFKAYDLRISIHSHHTIDQFKPITNIEFQNQGNKNLDPVNDPVHAHSGPVLVQMMDPEKEAGLTLVQMAQAEEI

SEQ ID NO: 138627 - protein, 234 aa, Glycine max
  Coding DNA Sequence Number=SeqID_46942
MAESSHTRFRLARQDEEVQALKSELGKAKLAKEKFKLAATHVRKECAGLREENAITARALERETKRARKEEYGRNKFRGALWGSNSELKLRREERNQSRAHSMVLKEELIACSRSKRSLSQRLCETETNMLAIIAKYEEELGLATAHEHRTADEYAQVYAEKEARGRVIDSLHQEATMWMDRFALTLNGSQELPRLLAKAKAMADTYSTPEEIHGLLGYCQHMIDLMAHIIRNR

SEQ ID NO: 138628 - protein, 69 aa, Glycine max
  Coding DNA Sequence Number=SeqID_46943
MVAITPAKVHQPPFLREYDSNATCACHGEAPGHSIEHCRALKCKVQGLTDAGRLKFEENRMIIKFLPLL

SEQ ID NO: 138629 - protein, 35 aa, Glycine max
  Coding DNA Sequence Number=SeqID_46944
MEEGYAASSEVGQVHLQMRKMLLVEVLDTAFPTSM

SEQ ID NO: 138630 - protein, 70 aa, Glycine max
  Coding DNA Sequence Number=SeqID_46945
VPTDPKRIKVILDLPTPPTPHIELVRNHVPSWEDVHERSVEGRSPEYEEPQDLRSNPFQGGGHDAILPPK

SEQ ID NO: 138631 - protein, 100 aa, Glycine max
  Coding DNA Sequence Number=SeqID_46946
  Subcellular localization annotation: CTP_CleavageSite=80; ConfidenceScore=5.59e-01
MPPKVSSSSGRGGRSSTKGKDVMLALPEPITKKATTSSSGSPTQTGSSTQKGKLERSLTQIKPESSTQESPKPTTTKQTVADYAWVNTNSPGLEDIGPHQ

SEQ ID NO: 138632 - protein, 168 aa, Glycine max
  Coding DNA Sequence Number=SeqID_46947
MEGLVDLAVIDASLAFHHGKESPVVAILAMYDTFDRGCEKSGTRIVCCALALYVWLVSHLFLQEGRPVYPLQGHRSCVEKGKANWDQLLASMEGGCINYNPVLAIRQLGYPMRGVPSDESITPFIARGFSDHNARVLQGVRKAWMRHEERTESLGEAVMGSSAAIISG

SEQ ID NO: 138633 - protein, 164 aa, Glycine max
  Coding DNA Sequence Number=SeqID_46948
MTGPLDESISCFLIRVDPWVLLPIAFRGLHALTSRGLHVLALRGLPALALERTTRPHLERTTRPHLQRTAVLTFVEDYTPSPSEGYTPSPSEDCTVLTFVGLHALTFRGLHALAIRGLHVLAIIGLHSLAFKRDTFWTSEGYTPSPLEELCVLSFSGLHIHTLR

SEQ ID NO: 138634 - protein, 80 aa, Glycine max
  Coding DNA Sequence Number=SeqID_46949
MLGFTSDSPQISASPHQLDLAPYASGPYNAQWNAPGLLHDKHMLCSSRILEEMEVEEPWLGLWLPLNYRVDMGASQHRTP

SEQ ID NO: 138635 - protein, 141 aa, Glycine max
  Coding DNA Sequence Number=SeqID_46950
MSIVSPKTCRESKGSRLTRSVKFRNVTEIERRCFCAIRPLGPSSFFLQKVVASGGSNLARLGELGGKLLPYFAINRGRSEEQKGSAFLALLILSKLLRKIVSVKKSKPRHFRNVSVSNYAKVFNRSSTFIVRSSFSSVFNW

SEQ ID NO: 138636 - protein, 121 aa, Glycine max
  Coding DNA Sequence Number=SeqID_46951
MSRGSGDLGDVRWGAIAQNQAWLIPTQPEHSQQALVIDYQLCVIDYIVLPATGNHVQNKVMVQLCFGIRVKEAGGPFGPANESYPEPHELIVIHASSTIESGAPQIDCLVLFVYPPPSNVI

SEQ ID NO: 138637 - protein, 76 aa, Glycine max
  Coding DNA Sequence Number=SeqID_46952
MKGTMHEPQANLGADQNFSPISLPSSFRGVHRPMASLYNLKSRKFHLSVTIYYHPSNDACDRSEPSSSIPRGATSA

SEQ ID NO: 138638 - protein, 41 aa, Glycine max
  Coding DNA Sequence Number=SeqID_46953
MTLRQHGLTEWRRRRVERRCHFKEKMSQEEVHHHRKPWIRA

SEQ ID NO: 138639 - protein, 119 aa, Glycine max
  Coding DNA Sequence Number=SeqID_46954
LKIRKENAELRDINIATTKALEQETKRARREEHGRNKFRVALSKRNMSQRLCETETNMLAIISKYQEEQNLATAHEHRVADEYAQVYTEKEARGRVIDSLQTPTLPLRRSTDFSAIVSI

SEQ ID NO: 138640 - protein, 128 aa, Glycine max
  Coding DNA Sequence Number=SeqID_46955
MGFIRLTGGSCRLLPCLGIGPVSRPCNLSPKLLRGRAYKTGGTLPLLTEAEPVETLIEPNAADNAPRPVTQLDRPAEVVAYFSMKARVIGGRITLLGVMGTPYDWQRPVISAGNPGPGWTYLGLEGAW

SEQ ID NO: 138641 - protein, 81 aa, Glycine max
  Coding DNA Sequence Number=SeqID_46956
  Homolog annotation: Hit_ID=A0PAV3; Match level="QueryCoverage=46%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSLLTGWCVTAKAPPDISAGKCSGHAARNHHTRRA

SEQ ID NO: 138642 - protein, 67 aa, Glycine max
  Coding DNA Sequence Number=SeqID_46957
  Subcellular localization annotation: CTP_CleavageSite=53; ConfidenceScore=5.13e-01
MTPPLTSSPLSFAASPWWKITIKDLIEAQRSSLHRSLTSKLPSSRLSFCLYISISPVVNTWITLISS

SEQ ID NO: 138643 - protein, 143 aa, Glycine max
  Coding DNA Sequence Number=SeqID_46958
MAYTHIPDSTSDSPQISASPYQLDLAPYASEPYNAQWNAPGLLRDKHTLRSSRILREMEVDEPWLGLWLPLNYQVDMGSSLAYDNGIWGEPYKLFAAKFLFVGMAFVDNWVVGKEEEWQSQHGFLPLFSPSSFAPVFSVVLVG

SEQ ID NO: 138644 - protein, 253 aa, Glycine max
  Coding DNA Sequence Number=SeqID_46959
  Homolog annotation: Hit_ID=Q6WAY6; Match level="QueryCoverage=71%, HitCoverage=30%, E-value=5e-17, Identity=33%"; Hit description =Putative uncharacterized protein
MTDAWGANTFPVHKYNSRTFHLKFVDHVFSVGGDFACIPFLEHAPTSHASPSHRRVGCDIAILADLYDTFGRRCEKSSTRIVCCTPALYLWLVSHLFHQEVRHACPLEGHHSCIEKGGANWDQLLANKEGASINWFPRWKEGRTGVLILCGGFPNVPLMGMRGCISYNPVLAIRQLGYPMRGAPLEEEIAPVISRGFNKTNVEMLQKVRKAWEVVRKKDKELRGSNNGPIGGYRKWLRAHVQGFDWLLSLRTA

SEQ ID NO: 138645 - protein, 270 aa, Glycine max
  Coding DNA Sequence Number=SeqID_46960
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVILWYDCSLYCLVPEKCILTSSPLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138646 - protein, 96 aa, Glycine max
  Coding DNA Sequence Number=SeqID_46961
MGGGSYHAKMSLLVTSFTGKNLKKFDIPTGCNMDELKDLIKQVAPTGISPYGIHETQMVLIESNYWKKIGPIEILAVFSKPCTGNGKRVVLVAKLA

SEQ ID NO: 138647 - protein, 346 aa, Glycine max
  Coding DNA Sequence Number=SeqID_46962
  Homolog annotation: Hit_ID=UPI00016621D1; Match level="QueryCoverage =82%, HitCoverage=40%, E-value=1e-16, Identity=31%"; Hit description =UPI00016621D1 related cluster
MTKGAHLKRATRHHLQRTTRPHLGYSYPYLQRTTRPRLHRATRPRLQRTTRPHIGGLHVLAFRGLHALAFMGLHYLAFVGIHALTFRGPHVLPFIGLHALTFRGLCVLTLRGLYPLTFRGLDPLSFVRLQALTFRGVHIFGFIWLNALCFLGLHALAFRRLHVLGFGGLHVLTFRGLDVFGFRELHVLTIRGLHDLIFRGLHVLVLRGLHALAFVGLHALTFRGLHVLEFIGLHALSFRGLRVLQFRGLHLLTFRGLQVVGFRGLHIPTFRGLHVLPFRGIHVLTFRGLEVLTFRGPHALAFRGLHVLAHKGPQALTFVGKHTLTFRGLHVLAFIRLHALAFRGLH

SEQ ID NO: 138648 - protein, 157 aa, Glycine max
  Coding DNA Sequence Number=SeqID_46963
MFHFWGLSVSTNHRGVRRDLRMPARGKEAIPFFLILSFYGKNSESGQDLGTRIPRKRLEEKAEALANQGEWATFIDLLALLVFRTVLFPNVDGLVDLAVIDAFLAYHHSKESPIIAVLADAYDTFYLRCEKEQCKNLSVVCLFVMYGWYPTFFYHEG

SEQ ID NO: 138649 - protein, 189 aa, Glycine max
  Coding DNA Sequence Number=SeqID_46964
  Gene Ontology: Mol. function=aspartic-type endopeptidase activity; Cellular component=intracellular; Biological process=RNA-dependent DNA replication
  Homolog annotation: Hit_ID=Q6WAY3; Match level="QueryCoverage=96%, HitCoverage=9%, E-value=5e-09, Identity=25%"; Hit description =Gag/pol polyprotein
  Pfam annotation: Domain name=G-patch; Domain location=43-82; Score =25.6; E_value=0.00015; Accession=PF01585.14; Description=G-patch domain
MPYVESAEESLETAFQSFEVVSISSMDSLSGQPCQSDAAVMMARVMLENGYEPGMGLGKDNGGITSLINAQGNRGKYGLGYKPSQADMKRSICGKEEQWSKLAVEARKSDDESPEGTNIWDPPIDFEQEVNQTEDEGNEDVGLPPELERMVAHEDQEMGPHQEETELVDLGIGTGKREVKIGTGITAPI

SEQ ID NO: 138650 - protein, 307 aa, Glycine max
  Coding DNA Sequence Number=SeqID_46965
LAKEKFKSAATHIRKECTELQEENAAIAKALEQETKRARKEEYGREKFQGALSRRSLAQHLEATEQSMLAIIGKYKEELNQSMAHEQKLVEDFAQVYAEKEARGRVIDALHQEATMWMDRFALTLNGSQDLPRLLAKAKAMAEEQMKADLSALKDQMASISEVMLKLQKTIEDKATATASSTVREAEPVLQPALNPGLGRNTAVFGRTYSPQAYPYGLPPDFNPCATPEDLSQALTFEGQLPPYEDYPGQDDGEGDTHLGPLLHLKDPSPHELPQPNIVRHIPASPTPVKESVPFAEDKGKIEVLEE

SEQ ID NO: 138651 - protein, 152 aa, Glycine max
  Coding DNA Sequence Number=SeqID_46966
YSKEFARHGMRREERIESLGEATVRDDEVKASEESDEVQALKAELERAWVVEEKFKAAIVSSSSEEVKGIITGQRHDLEGRAKGNTWAIIDKCKEKLNLAATHEQRLEDEYAKISAEREARKGQELPRLLAKAKAMADTYSAPEEIHGLLGY

SEQ ID NO: 138652 - protein, 113 aa, Glycine max
  Coding DNA Sequence Number=SeqID_46967
  Homolog annotation: Hit_ID=A0PAV3; Match level="QueryCoverage=33%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVAPPGCREFDGLLGPELGSSSEYPC

SEQ ID NO: 138653 - protein, 174 aa, Glycine max
  Coding DNA Sequence Number=SeqID_46968
  Subcellular localization annotation: CTP_CleavageSite=63; ConfidenceScore=5.26e-01
MVKVGTSYVPINVSFSPKVGPGLPAVLPVQLLTGWSASQFGTQAYRPEHQRGKARFPIRNHVRCATAYESANARAIECGPFAITPAGASGCVHTGDYYVGTDNARVFPVRTCCGKKKLHRCSVRICEYRLTIGPRIVTELLPLGRHAAALRTWPLQRARNSEILNRSWTELTGK

SEQ ID NO: 138654 - protein, 52 aa, Glycine max
  Coding DNA Sequence Number=SeqID_46969
MHIVVVKQGQDYLELPSGVGTKHEQQKPTKVLRNGCNWGWGHDRLIVAPSLR

SEQ ID NO: 138655 - protein, 59 aa, Glycine max
  Coding DNA Sequence Number=SeqID_46970
MGVEGRSPKFQEPLDLRSNAFQGGGNDAILPPQGHWIEDSKKIGPEMQEKALGFSRVLG

SEQ ID NO: 138656 - protein, 182 aa, Glycine max
  Coding DNA Sequence Number=SeqID_46971
MQLPQEPLNKKPRGLARNNMAEKNFVELCGGSNSELKLPREERDQSRAHSMVLEEELAACSRSKRNLSQHLCETRTNMLAIVSKYQEELNLATTHEHKVADEYAQVYAEKEGRGRVIDSLHQETTMWMDQFALTLNGSQELPRLLSKAKAMANTYSAPEEIHGLLSYCQHMIDLMTHIIRNR

SEQ ID NO: 138657 - protein, 60 aa, Glycine max
  Coding DNA Sequence Number=SeqID_46972
  Subcellular localization annotation: CTP_CleavageSite=23; ConfidenceScore=5.65e-01
MASPPASPPPPPPPPPSDTSPFSSAVKRTRKASCLQSLSTRPPGAERPMVHVDLGTDKAD

SEQ ID NO: 138658 - protein, 137 aa, Glycine max
  Coding DNA Sequence Number=SeqID_46973
  Gene Ontology: Biological process=transposition, DNA-mediated
  Homolog annotation: Hit_ID=Q1J7G7; Match level="QueryCoverage=21%, HitCoverage=42%, E-value=2e-10, Identity=100%"; Hit description =Transposase
ASRYQQGHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDGLTASIVED

SEQ ID NO: 138659 - protein, 89 aa, Glycine max
  Coding DNA Sequence Number=SeqID_46974
  Homolog annotation: Hit_ID=A0ST23; Match level="QueryCoverage=30%, HitCoverage=55%, E-value=2e-08, Identity=100%"; Hit description =Putative reverse transcriptase
MISDADNERHLLGWRQGVHMCVIKLIDTVDLEGGPVGKPVVPAALMNRPTRGERRFAYWALAECILAYYVGTDEGVSEVLHVAGEKGCT

SEQ ID NO: 138660 - protein, 75 aa, Glycine max
  Coding DNA Sequence Number=SeqID_46975
MSVKNHPGALRNHRETSQGHDGFARILQPYGISIDLKEHSNPVTPKAYTPKSPSGLLPPDSSTTPKIILAHRHCS

SEQ ID NO: 138661 - protein, 118 aa, Glycine max
  Coding DNA Sequence Number=SeqID_46976
MVTWSEYRSRIDHMEIHEFSSVPYRGFEEHLPRHAYKDREIWTACTAIICFPIVERHQTNWVKLWFGLQQDIPVDHLNLDRLHQIDMLEAIITVTGWLSCGVDYIWKDNAMMFLLDND

SEQ ID NO: 138662 - protein, 142 aa, Glycine max
  Coding DNA Sequence Number=SeqID_46977
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=UPI0000ECC20B; Match level="QueryCoverage =41%, HitCoverage=66%, E-value=4e-15, Identity=69%"; Hit description =UPI0000ECC20B related cluster
MTTPSSKLNLTKGNKSREGQEKPAMSVAANFLKNKLEGDPLVRERPPPRWSSHSPESESYYMSLAFVLQRRDWEDPGVTQLNRPAPHPPFWRWSKNEHAHTDSPSQHLRNGKGEGHAPCTVAVSGAGVVVTLTVTATLANAE

SEQ ID NO: 138663 - protein, 83 aa, Glycine max
  Coding DNA Sequence Number=SeqID_46978
MTKSKGKDPLEGLGGPMTRARARKAKEDLQQVLSILFEYKPKLQGEKSKVASTFGRPNGDWLDGFWGDFWLPQFLLHSAIKFF

SEQ ID NO: 138664 - protein, 65 aa, Glycine max
  Coding DNA Sequence Number=SeqID_46979
MIGTSKPYTGAMRGTMHEPQVPSYKVMMKDNNWYLKALHWGNEGIVHEPQVNIGEDQKFSPVNVF

SEQ ID NO: 138665 - protein, 50 aa, Glycine max
  Coding DNA Sequence Number=SeqID_46980
MTINSWGSGLDGGGCMNENLFMGLRIRFVGGGCTNNARQSIRGGSGLDGG

SEQ ID NO: 138666 - protein, 341 aa, Glycine max
  Coding DNA Sequence Number=SeqID_46981
  Homolog annotation: Hit_ID=Q6WAY6; Match level="QueryCoverage=60%, HitCoverage=41%, E-value=2e-12, Identity=27%"; Hit description =Putative uncharacterized protein
  Subcellular localization annotation: CTP_CleavageSite=50; ConfidenceScore=5.47e-01
MFAHSIKGCRPLGRTCGVLIPSPFVNTTPEPFNLKVRRSRLFRFFRRFPRINVGGDSARIPFVEHASRESRVALPPKGRLRHPALYVWLVSHLIRQEVRHACQLESHRSCTEKGGANWDQLLANKEEASVNWFPRWKEGRIGILISCRGFPNVPLMGTRGCISYNLVLAIRQLGYPMRGAPLEKELAPKVHKAWEVVQKKDKELKGSNNGPIGGYRKWLKAHLQGLDWLPSLRIAIREEVEALEEDEEVQTLRTKLEQTQIVKERFKSATLKIRKENAELRDINIATTKALEQETKWARREEHDRNKFRGALWGSNSELKLRGEERDQSRVDNLILKDELK

SEQ ID NO: 138667 - protein, 101 aa, Glycine max
  Coding DNA Sequence Number=SeqID_46982
MVSRYTLNEIAAEYERVPYGGKNPSRCGCVMRSTHSLPCALKHSASSSEEPIQRWNIPMLDQFHPCIQDSIENIIGVKANGNCGYRAIAALLVWVKNHGHW

SEQ ID NO: 138668 - protein, 124 aa, Glycine max
  Coding DNA Sequence Number=SeqID_46983
MEAISKRFEKLDVKTKGSQKKQMTKQQRPAKRDSSYRENVDALHSMQNSNYLVKHCASSSKQPKPKRKMPMLDQFHPCIHDFIENIVDVKVDAPCGAGRPWIFFINEVLCFLKINDSRMEKEER

SEQ ID NO: 138669 - protein, 234 aa, Glycine max
  Coding DNA Sequence Number=SeqID_46984
  Gene Ontology: Mol. function=identical protein binding; Cellular component=integral to membrane; Biological process=negative regulation of catalytic activity
  Homolog annotation: Hit_ID=A7QC07; Match level="QueryCoverage=36%, HitCoverage=10%, E-value=2e-38, Identity=86%"; Hit description =Chromosome chr10 scaffold_76, whole genome shotgun sequence
MKHFTDTLISANILVPGPPSRSTVSISLIEGVVIGFVDTGIDPTHPSFDDNKYEKPYPVPAHFSGICEVTRDFPSGSCNRKLVGARHFAASAITRGIFNSTQDYASPFDGDGHGTPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138670 - protein, 196 aa, Glycine max
  Coding DNA Sequence Number=SeqID_46985
MEPIASLSQYYDQPLRCFTFEDFQLVPTVKEFEEILGCPLGGRKLYLFSGFYTSTTRVAKGVLFPNVDGLVDLAAIDVFLAYHNHKESPVVAMLADLYDTFDRRCEESNARIVCCTPALYVWKEESGFYLHAKDVQMSLDGTRGCINYNPVLAIRQLGYPMRGVPSDESITPFIARGFSDHNARVLQGVRKAWDAA

SEQ ID NO: 138671 - protein, 159 aa, Glycine max
  Coding DNA Sequence Number=SeqID_46986
  Homolog annotation: Hit_ID=Q6WAY4; Match level="QueryCoverage=86%, HitCoverage=25%, E-value=1e-13, Identity=34%"; Hit description =Putative uncharacterized protein
MGTNQTGKTFHQFKIKGLDITSIKELGRLMGPLQIQAFRKAYGKILDLTIAEISTEAVVSLTQYYGQPLRCFTFGDFQLVPAIEEFEEILGCPLGGRKPYLFSGFLPSLSKIAVVVRDSAKELDRVKQTRNGVVGLPRKYLEGKARVMANQEEWVPFMD

SEQ ID NO: 138672 - protein, 193 aa, Glycine max
  Coding DNA Sequence Number=SeqID_46987
MGEAEEVQEKMKADMEAMKEQMATMMKAMMSMKKIMEANAVAVATTNAVAKAKIWKVRAAPIMCKFKTSTPSHHMACLPTIRHPMWRTLPMRMSITPLLYSLRANNLNLIMHMSLDPWGGTHEMPHHNLADFEPCLGYATEGQVVGGIPLQNTLEGPQFRPQPQPSHSTTVKNPHAMAEMGEVGSSRGKAQGH

SEQ ID NO: 138673 - protein, 115 aa, Glycine max
  Coding DNA Sequence Number=SeqID_46988
VVPGDMSRGSGDLGDVRRAPGSQQIKGTKTTKQGGLCGGWPAVNLEAKMVSGDVIDYQASKGNWKTVEASGNQLPVFVIDYTEEWVTGNRLPKMKSLKIPLLLACSGYETHCVAA

SEQ ID NO: 138674 - protein, 76 aa, Glycine max
  Coding DNA Sequence Number=SeqID_46989
MAAEWRRKRERRCHFKEKMSLEEAHYHRRPRIRAWRKKEMNEGRGREEHEILCSKRALKSEPTNPRSIPRFSTKCA

SEQ ID NO: 138675 - protein, 137 aa, Glycine max
  Coding DNA Sequence Number=SeqID_46990
MLRAALNTAIHVVLNVMYAFACNYLWILSYFMHPRVMLLRVYIMSSRTRCMLVSSFVMGSRKVHITFLTTHMGNCVPECAILAIKIAIPWVMGLNQARAFTKRFIKSSLSMEVTILQKIGARDGSSYVIASSTAKHV

SEQ ID NO: 138676 - protein, 161 aa, Glycine max
  Coding DNA Sequence Number=SeqID_46991
MSFAGFLLYIESESLVLYPLAVNLSVSALGALGGWRVRNGAMFLLEGGGNGLGMGSGRVCSQSRSEAGWTCAPKRRRFGKGSGFRAVRDADSVSGALTLEEGLEKLKEALQILNSPSPSPPTVLRPSLCFAPNPTPPRTFLSFMFPRTTPTLNHSMSIWMI

SEQ ID NO: 138677 - protein, 115 aa, Glycine max
  Coding DNA Sequence Number=SeqID_46992
  Subcellular localization annotation: CTP_CleavageSite=34; ConfidenceScore=5.51e-01
MQATPSNNLMDSSLATGAKVSSKFFYTFNLSVALSNKYWHLFLVITLFFTLVLFLLDVVGVPSKCDSVVDIACCVHGFSPRIYERTHECASDVQNSTQLFEYFKGVCFLSDKVDP

SEQ ID NO: 138678 - protein, 147 aa, Glycine max
  Coding DNA Sequence Number=SeqID_46993
MSKILIMGAIFVNMGIFVVQVELLNSNHCAIRKVSQHFGKKMGKKLKLGAKWKRVPDVPKVQKEEERRERKKKEEKTRQKCFRITSVIDSYTVCHSFFGRSSFFFRLVLAFKDLNLIYGPLGDPFIVCASSSPSLTIKASFDRSFIL

SEQ ID NO: 138679 - protein, 41 aa, Glycine max
  Coding DNA Sequence Number=SeqID_46994
MSRKKEITLYRFRVQSINNSFSSNWVQGIIHSSTCLTKTII

SEQ ID NO: 138680 - protein, 96 aa, Glycine max
  Coding DNA Sequence Number=SeqID_46995
MKFPHVNDFVVPGGTKGAEDCVSPCMLSSVLDAKEWVRITVRMTKLGLCLSSALDDKRVRITVRVSMTKTYGAADKSKALAPTYPPMRNSDLRSSG

SEQ ID NO: 138681 - protein, 108 aa, Glycine max
  Coding DNA Sequence Number=SeqID_46996
MAVMVARVMLGNGYEPKISLGKDNGVITSLISGKGNRGKFGLGYKPTQADIRKSVAGRKNGSQGSRLRQEDKGIPPCHISRSFISAGLGDEGQVVAICEDDAPSGSDL

SEQ ID NO: 138682 - protein, 209 aa, Glycine max
  Coding DNA Sequence Number=SeqID_46997
  Homolog annotation: Hit_ID=A4AQ76; Match level="QueryCoverage=92%, HitCoverage=88%, E-value=7e-27, Identity=30%"; Hit description =Putative uncharacterized protein
MKIYVISGLGADFKVLEKLQFPAHLEVVFIDWLIPGLNESFPQYVERMASKIDDSEPFYLLGYSFGGIMVQEINKIKPAEKVVILGSIKSDKEKSRLIRAGQITRIPKILPTRFFNEKNTAAYSVLRKFFDPKNPKVLQYFRVKDPYYLKWSIEKISDWRFDENPEVIQILGDRDIVFPVKNSKPNYIIRGGTHLFPATKSKEVSKIFK

SEQ ID NO: 138683 - protein, 193 aa, Glycine max
  Coding DNA Sequence Number=SeqID_46998
  Homolog annotation: Hit_ID=A5BSR3; Match level="QueryCoverage=27%, HitCoverage=16%, E-value=9e-07, Identity=50%"; Hit description =Putative uncharacterized protein
MTSEAAKEIADKIDAFEDQASQGSFVAHGRHDVLTAAIGRLEHPGHVRAVGAGVTIKQYFRSTSRISYTSSSMAPKDLQQLMQQIRDQLEDSITEKVTRQLMLSFSQMQSQFQSQMQSQGLALPPEPEVGPSAARVSTKESCVDPSGNDLDIGDSDKCGLYIEEYPPRLVALGRVYKESITVHNIPLLHDQVK

SEQ ID NO: 138684 - protein, 227 aa, Glycine max
  Coding DNA Sequence Number=SeqID_46999
  Homolog annotation: Hit_ID=Q6UUU1; Match level="QueryCoverage=26%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138685 - protein, 154 aa, Glycine max
  Coding DNA Sequence Number=SeqID_47000
MPISPCRCISWDHAHKTPSGSEEVQQGPGVSSSGYEPLSVLQGARSPSEESHPQRHPVDPKKSNRALGFPALGSRLQDTQWTRRSPTGSWSCQALITGLCQFYRVHATSSKGIRPPTNRAFIKKYCAPRQAQGETPQQPGDGRQRATDAPPSPL

SEQ ID NO: 138686 - protein, 271 aa, Glycine max
  Coding DNA Sequence Number=SeqID_47001
  Gene Ontology: Mol. function=sugar binding
  Homolog annotation: Hit_ID=Q2FLS2; Match level="QueryCoverage=94%, HitCoverage=63%, E-value=4e-26, Identity=30%"; Hit description=PKD
MKKLYFSVLSTCIISGLSAQEVVWQKDIKSSTQDFLSQVTTTIDQQYLITGSVIQAANQKKDAGSNTQQNNGYDFHLVKLNQQGDQVWEKYFSGNNHDYLSSTVATQEGGFLISGTSYSGKGIDKKDDSKGGSDIWLIRINEFGDELWQKTLGTSADEEARSVIQTTDLGFVVAGNVQNASKGYGSKDILIIRLDKNGKEISQLILGGRGLDEVEKMIPTRDGGALLGIYSRSSEFRVSDSGNQNSATGTSGSVSRYVKTTENFGEGDYWI

SEQ ID NO: 138687 - protein, 194 aa, Glycine max
  Coding DNA Sequence Number=SeqID_47002
  Subcellular localization annotation: CTP_CleavageSite=39; ConfidenceScore=5.19e-01
MVKVGTSYGADATSHSLPKVPGFPVSTGTPGLIFCEVIRHSGVSGFYQLFSCSATDGVVYPLTIRHTSIPAGTSALASVAWGADADANHSHAALNCLPLRARPLSIQGNLRQLLKTANARAIEADVLHTGDYYVGTDNARVSVECVHVEEKKAAPAFPPGGSLVRSPVPAFRFTGVIPLLWPRLSHSTPDTQFP

SEQ ID NO: 138688 - protein, 148 aa, Glycine max
  Coding DNA Sequence Number=SeqID_47003
MASSDIAILRDRAHIPTKTRLLELTSPDALLAHNKLLDVKFVVELMNLDVLSLMKNKNNFSAGGLFGFQHGQQYNQQSGQWRNHPGNQFNRDQGGSPIKPQPQKPSLYDRTTKLEETLAQFMQVSMSNQNSTESSKRNLEVQVGELAK

SEQ ID NO: 138689 - protein, 71 aa, Glycine max
  Coding DNA Sequence Number=SeqID_47004
MAAQETDKRKRSIALKVSSSMQEENEDEESEDKEDFSLFVKNFQIFVKKRRIERRQNFNHGKRFQEDSPTL

SEQ ID NO: 138690 - protein, 105 aa, Glycine max
  Coding DNA Sequence Number=SeqID_47005
IAPTKTPSGPEEVQQGPGVSSSGYGPLSVLQGARTPPGKGHVIIGIATARHLVDPKKSNRRAIDAPPPPLEFTSAHPQKGLSIAYDTWPTNRQPSPKPKGAPSCS

SEQ ID NO: 138691 - protein, 118 aa, Glycine max
  Coding DNA Sequence Number=SeqID_47006
MNRVTSLLHLLPNTFRTVDILVTSSFTLTKIKGHALRRPYRTRARARAIDEAEEVQEKMKADMEAIKEQMATMMEAMMSMKKIMEANAVIVAATSAVAKVNPMLPSGLKQMNHPTSNM

SEQ ID NO: 138692 - protein, 45 aa, Glycine max
  Coding DNA Sequence Number=SeqID_47007
MGSYLVYGPKIYPKAHKNPKAFCCISGPIFLESSIQYPWGIFSRR

SEQ ID NO: 138693 - protein, 101 aa, Glycine max
  Coding DNA Sequence Number=SeqID_47008
MESRVHSFTWSNQKEVYVEQPPGLKKGLLLWVIPYIAPRLDMTTKILWKIHNEERNLKRKRDEENKDDQNDTAQEDDILPKEWKTSRVFLLTTSSEISQKW

SEQ ID NO: 138694 - protein, 132 aa, Glycine max
  Coding DNA Sequence Number=SeqID_47009
MEYLEGAWETLEGNTRCRFRGTIRFTNTSLVHPDEPARTLQRTVEWILPTPTPYRLVEPAQVIEVTLSEEDPEEDPEELPPEPAVDALDFLEGDEDPLLEVDSPEDVMSASEVDSTEDSGPGEMAINGGSSS

SEQ ID NO: 138695 - protein, 240 aa, Glycine max
  Coding DNA Sequence Number=SeqID_47010
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARDLFIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138696 - protein, 515 aa, Glycine max
  Coding DNA Sequence Number=SeqID_47011
  Gene Ontology: Mol. function=signal transducer activity; Cellular component=membrane; Biological process=signal transduction
  Homolog annotation: Hit_ID=Q6D515; Match level="QueryCoverage=99%, HitCoverage=83%, E-value=0.0, Identity=75%"; Hit description=Methyl -accepting chemotaxis protein
  Pfam annotation: Domain name=Cache_1; Domain location=49-131; Score =20.8; E_value=0.00019; Accession=PF02743.9; Description=Cache domain
  Pfam annotation: Domain name=HAMP; Domain location=190-262; Score =18.5; E_value=0.024; Accession=PF00672.16; Description=HAMP domain
  Pfam annotation: Domain name=MCPsignal; Domain location=293-515; Score=314.4; E_value=2.2e-91; Accession=PF00015.12; Description =Methyl-accepting chemotaxis protein (MCP) signaling domain
  Pfam module annotation: Pfam domain module=Cache_1::HAMP::MCPsignal; Domain location=49-131::190-262::293-515
AGAAPKGRYAYFIDRDQGGNFALHPLTSIFKPGQGDYYLLPQKSQKDTLIEPYSYAYNGVPTLLTSVAAPIISQGKLWGVVTSDISLASLQEKVNSIKPWEGSGYAMLLSSAGNVVSYPDKSQTSKAWKGDTHNFSSTVTEQHDAILGEDALVAWRPVVIGNSDQKWYLGVVAPVSKVMEAAHRQLINAVILMVISILVVCALLGLVFSRKVLKPIGGEPLTAATIALAVADGKLDNAIPLKARDSSSLFFALHTMQNQLREIVGQIQDASASVRQGAGEIASGNLNLASRTEEQAAALEQTAASMEQITATVKHNAANAHQATTLTDNATHIASRGESLVGQVVQTMAQIDDSAKKIGDITAIINSIAFQTNILALNAAVEAARAGEQGRGFAVVASEVRNLAQRSANAVKDIAALIEESGQRVGSGVQLVQDAGKTMQEMTQAVNSVRTIIGEIVTASDEQARGISQVTIAVNEMDGTTQQNAALVQQMSAAASSLEDQAAQLAHTVGRFHLS

SEQ ID NO: 138697 - protein, 298 aa, Glycine max
  Coding DNA Sequence Number=SeqID_47012
  Gene Ontology: Mol. function=oxidoreductase activity; Cellular component=cytoplasm; Biological process=metabolic process
  Homolog annotation: Hit_ID=Q0LYB2; Match level="QueryCoverage=82%, HitCoverage=99%, E-value=2e-72, Identity=59%"; Hit description=NAD -dependent epimerase/dehydratase:Short-chain dehydrogenase/reductase SDR
  Pfam annotation: Domain name=Epimerase; Domain location=4-237; Score=- 53.2; E_value=0.0033; Accession=PF01370.12; Description=NAD dependent epimerasedehydratase family
  Pfam annotation: Domain name=KR; Domain location=3-176; Score=-70.0; E_value=0.0028; Accession=PF08659.1; Description=KR domain
  Pfam annotation: Domain name=adh_short; Domain location=2-159; Score =91.4; E_value=2.9e-24; Accession=PF00106.16; Description=short chain dehydrogenase
  Pfam module annotation: Pfam domain module=Epimerase::KR::adh_short; Domain location=4-237::3-176::2-159
MKTILITGCSSGFGHATALWFLERGWKVIATMRTPRAELFPESAHLRLLPLDVTDAESIRQTLAEAGEIDVLVNNAGIGLLTSLEGAPMSSVREVFETNTLGTIAMTQAVIPQFRAKNSGMVINVTSTVTLKSLPLLAVYTGSKAAVNAFTESLALELQPFNVQVRLVLPGLAPTTDFGKNARPRMENTLLEPYQPMFDGIIAGMQQPQPTTKAQDVAAAVWRAATDPAAPMRIPAGEDAEASMKQYVPPDRRAPASFAAGQTTVQAAPQARTSASLRTYPVPAAAARRWRPAPPSAA

SEQ ID NO: 138698 - protein, 338 aa, Glycine max
  Coding DNA Sequence Number=SeqID_47013
  Homolog annotation: Hit_ID=UPI00005F8ECF; Match level="QueryCoverage =31%, HitCoverage=85%, E-value=2e-27, Identity=58%"; Hit description =COG0251: Putative translation initiation inhibitor, yjgF family
  Pfam annotation: Domain name=Ribonuc_L-PSP; Domain location=222-338; Score=75.6; E_value=1.7e-19; Accession=PF01042.12; Description =Endoribonuclease L-PSP
MKKSPAKIILLNFATNDARHFHFRDIEKDYQEPHPICGRAEKWHVAPYVTKLDALAKAESVPLARQYQRILQMKDWQSLMSPDCIHPSEQLYRMKAEETFSVLVSHFNTELAAAGHGKNPDGEQCPQLLDTVATMLHQEWSGFSHWRDRSAIRQRLLMRNAQPAKTFTLVALNAENEVLATASTILHELDDIHERQFWMGEVLTVAAHRGILPSLWLAGNRAAHRVVRTAPYVHAVKHGDTLYVSGLTAFATTAQQADITAQAEVIFQQLHTLAAQENTSLKNLIKVTIFVTSFTDINALRDVLYRHYGEHLPASSLVQISQLFCPDLKIEIEAIIAL

SEQ ID NO: 138699 - protein, 1087 aa, Glycine max
  Coding DNA Sequence Number=SeqID_47014
  Gene Ontology: Mol. function=binding; Cellular component=outer membrane; Biological process=pathogenesis
  Homolog annotation: Hit_ID=Q8FFF8; Match level="QueryCoverage=95%, HitCoverage=49%, E-value=9e-83, Identity=25%"; Hit description=YapH homolog
MSTGNYDDEVAAALGDQVVLSADGAKASVKINRGKTLEVANSASAVMRASNGATAIIAGKLATSNAPSSEAGALELISGARGINNGVINSGFFNAANGRGVAEDSLGYAGTAVSAIYDSEFRNNGVLNVHIGDAPWGTAGLFLGSSSAVNHGNINIGIHDVANGSSAAAVSFSGEGSFVNARDGTIYLGRTPQNHKGDVTQDVAVSLGGGISAISGLLDSRAINDGRIVIGSKVENAVGMRIEAGPNAVSLNNGVIDVNGMAQALPRENIAMLAMDSGSGGQVGNRGTLNLNGYNSTGLKVIATAGNQAHAFSSGAINVAGDADRFGGTNNTAVWVTGEPGGHASADITGPIRLSGKAGIGIRAEGQATVNVSAGGIPTSSGSDSMLDSGQISFYRIGPDARINLPANGRYSASVWNGTIFRVEQGADFDGRGLTLSMNSPFATGVYGSGAGTDIDTHGATLNIASFASGLTITDGARATIDAATRIHLNGSDARVAIADGNRYTLQGNVVNPNTQFDPNTLLINQAAIDGRANNQQPFTVMNHARLVNRGAISLRGEGVTGIYAQYGATVDNRGDINILRNGRALFADGYPGAGDGKTLTEINNSGTLNLYSGQSTQQTTTFGAVSYHQLGRINQNGTINLYGDNVVGAKAFAGGRITLGVNSRVVFHDAQQIGYQAFDPGSRLIVNGSPVDVSSRNSTLYEIRNGAWLYNQGFGNVTLSGRDSTGIVVSGTDALVSSTDVYQVTGKGATVLRASDRAQGIITSLIALNGKNTLGAQATGDGTEVYAASLITGTGRNATAFDVSGDARLFNQQQGVVDLRGRNSTGARVHDGGNFINRGTVSVASGTGVDVSSGYGQYVPLDSTLRVNDGTAALRVGSGGAMKIYGDGQGASTLAAYGKADGLLLDSGAQRFEANDIIIGAYGSGTALNNRAGISDISLSNVRFEANGGTGIRSATSFDPAGSAQIHVGAGGTGYRYENADGSTTGNDLVIGRDYRIEVNGSGTGVRANTRGRVIAQGLIDIRDADGGSAIVTRSASQVINQGTIRSQSRVAPLIDLRGGETVFINQGTLDAPYADQVVSGGRRDP

SEQ ID NO: 138700 - protein, 514 aa, Glycine max
  Coding DNA Sequence Number=SeqID_47015
  Gene Ontology: Mol. function=transporter activity; Cellular component= integral to membrane; Biological process=transport
  Homolog annotation: Hit_ID=A0NM46; Match level="QueryCoverage=53%, HitCoverage=88%, E-value=6e-97, Identity=64%"; Hit description =Binding-protein-dependent transport systems inner membrane component
  Pfam annotation: Domain name=BPD_transp_1; Domain location=309-510; Score=68.3; E_value=2.6e-17; Accession=PF00528.13; Description =Binding-protein-dependent transport s
  Pfam annotation: Domain name=BPD_transp_1; Domain location=78-306; Score=76.0; E_value=1.2e-19; Accession=PF00528.13; Description =Binding-protein-dependent transport s
  Pfam module annotation: Pfam domain module=BPD_transp_1::BPD_transp _1; Domain location=309-510::78-306
MPEISLPASPARRRWRWTRLAEPWWYLSPGLLLIALFIFVPMAIGISYAFQSMNLLNPLESGWVGWANFAQMLDDRRFFRALGHTLNWTLSSLLLQFFFGLALALLLNREFRFRRWVQALVFLPWAVPAFLSGLTWSWLLNPVVGPLPQWLSDVGILSEPYNILSDPQLAMWGPVIANVWFGIPFFAITLLAALQSIPKDLYEAAAIDGASGWQQFRRVTLPFLAPMIAITVMLRTIWIANFADLIVVMTDGGPAGSTSILSSYIFTTAYRKLDFGYASAMAGVTLLPGGFTLSHFAKVLTDSDFPTFFINSLIVSCSTAALTTLIAAGAGYAFSRFQFRGKMVMAALLLFTQMFPLVMIIAPIYRVMAPLGLTNSLLGLILIYSAFNVPFATFLMQSFFDAIPKDLEESAMLEGCTRFQALYRVLMPLTLPGMAATLGFVFTAAWSELLFSLMLINKNEVMTFPVGLLSFVSKFAVSWGEMMAAAVLALIPACLFFAFIQRYLVQGLTAGAVK

SEQ ID NO: 138701 - protein, 116 aa, Glycine max
  Coding DNA Sequence Number=SeqID_47016
MGIAPTRHPVDPEKSNRAQGFPNMVTGLYQSYRVPVPPRQGYVIIGIAPARHPVDPKKVHATSSKGIRPPTNRSFIKKYRVPRQAQGETPQQPGDGRQRATDAPPSPLEFTSAHRQ

SEQ ID NO: 138702 - protein, 106 aa, Glycine max
  Coding DNA Sequence Number=SeqID_47017
MYMMRLSALNEYGSGVIDILAGSVRHIGWCIVGRQTIWQEDGGIGFILAIALVAATATTLASIIFFMLIMASIIVAICSFMVSMSAFICFCTSSTSPITLALARVQ

SEQ ID NO: 138703 - protein, 260 aa, Glycine max
  Coding DNA Sequence Number=SeqID_47018
  Subcellular localization annotation: CTP_CleavageSite=63; ConfidenceScore=5.22e-01
DYTSLPLRGLHILANRGAGRPHLQRTTCPRLERATRPSPWVLVTLTVERTTRPSLFRGTTHPRQQRAGRPHLQRTHVLALRGLHALTLGLHVLTIRGLHALTSRGLHVLALRGLHRPHLGGLHVLTIRGLHVLTSEDYMFLLEGHTALTLGTSYPHRLRGLHSLAFRGLHVLATSEGYTPSPSEDTRPHFQWAPYPHLKTNLRSSVLKCLTETCTPGPTVRAQPEREAITQLLCILGQDFTRAAAKRRVRIMRTNMTTLT

SEQ ID NO: 138704 - protein, 299 aa, Glycine max
  Coding DNA Sequence Number=SeqID_47019
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIFLSKLEVQDQGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138705 - protein, 304 aa, Glycine max
  Coding DNA Sequence Number=SeqID_47020
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDAQSTHSATTDFQQTLSVNRQPNNAPSVHRSELGRRSDARNQHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138706 - protein, 111 aa, Glycine max
  Coding DNA Sequence Number=SeqID_47021
MTPVNRKAGTGERTREPPGGNACRKVHSSIEFRARGDKPLVLSVAAIDASVGAQERGIARNSESCIHIFSWPVQFFLLPHEARSDWEHPGISVPNIVIASMQHIRPLAPLA

SEQ ID NO: 138707 - protein, 381 aa, Glycine max
  Coding DNA Sequence Number=SeqID_47022
  Homolog annotation: Hit_ID=Q6WAY4; Match level="QueryCoverage=89%, HitCoverage=62%, E-value=1e-32, Identity=29%"; Hit description =Putative uncharacterized protein
MIKGLDVTSLKELGRLMGPLQRQAFRKMYGKILNLTAAEPLRCFTFGDFQMVPTVEEFEEILGCPLGGRKPYLFSGFLPSLSKIAVVVGDSAKELDRMKQTRNGVVGLPRKYLEGKARDMASQEKWVPFSDILVLLIFGVVLFPNVDSLVDLAVIDAFLAYHHSKESPMVAILADLFDTFDRRCEKNSAQIVCCLPALCVWLVSHLFQQDIRHSCPLQSYRSCVEKRRVDWDQYLAGIGGSTINWFPRWKEGKEEVLFLCGDYPNVPLIGTRGCINYNPALAIGQLGYPMRGAPTEESLSPFLVRDFGAQSFKIVQRVHTAWESLLRKDKELRGIRNGIIGGYHEWLRVHTRGLDWLSKLKIIKEENFEAPEEDEEVQALK

SEQ ID NO: 138708 - protein, 103 aa, Glycine max
  Coding DNA Sequence Number=SeqID_47023
RQFQGDAPQAADAPPPHQAGPAGLFDMEQYLQHLMSLSLQSQGFTSFPCPTPDQFRAEVAWPEDWPEARAGEAPAEAPDEADEAREDEEMTDLLDFLGRSGAT

SEQ ID NO: 138709 - protein, 66 aa, Glycine max
  Coding DNA Sequence Number=SeqID_47024
  Homolog annotation: Hit_ID=Q6WAY3; Match level="QueryCoverage=98%, HitCoverage=2%, E-value=1e-07, Identity=44%"; Hit description =Gag/pol polyprotein
MPYANLLPYLLDNAMAAISPTKISQPPFPRGYNPNMTCAYHRGVPGHSIQHCMTLKHKVQSLIDAG

SEQ ID NO: 138710 - protein, 106 aa, Glycine max
  Coding DNA Sequence Number=SeqID_47025
MAPKKISKKRSRRDAAAKGSSVAPKFDSHRFRSTEHQQRFEAIKGWSFHRERRVQLKENDQTQEDVPSTCTTKDVPSNGLRQRSQAVKPLILCEWGYKRILRQLVL

SEQ ID NO: 138711 - protein, 89 aa, Glycine max
  Coding DNA Sequence Number=SeqID_47026
  Subcellular localization annotation: CTP_CleavageSite=33; ConfidenceScore=5.04e-01
MIFHSPFLQNVTQTLTPPFPPPTTTSGRHEPPLLATKPPHQEKHLNQSGILGILLKDSMERIPPILHFKASMSASCMLGTVATYPFAGE

SEQ ID NO: 138712 - protein, 180 aa, Glycine max
  Coding DNA Sequence Number=SeqID_47027
  Gene Ontology: Mol. function=structural molecule activity
  Homolog annotation: Hit_ID=P03740; Match level="QueryCoverage=61%, HitCoverage=57%, E-value=4e-61, Identity=100%"; Hit description=Tail fiber assembly protein
  Pfam annotation: Domain name=Caudo_TAP; Domain location=97-180; Score= 45.3; E_value=2.1e-10; Accession=PF02413.8; Description=Caudovirales tail fibre assembly protein
  Pfam annotation: Domain name=Phage_fiber; Domain location=14-27; Score=15.4; E_value=0.21; Accession=PF03335.4; Description=Phage tail fibre repeat
  Pfam annotation: Domain name=Phage_fiber; Domain location=28-41; Score=15.9; E_value=0.15; Accession=PF03335.4; Description=Phage tail fibre repeat
  Pfam annotation: Domain name=Phage_fiber; Domain location=46-59; Score=13.2; E_value=1; Accession=PF03335.4; Description=Phage tail fibre repeat
  Pfam module annotation: Pfam domain module=Caudo_TAP::Phage _fiber::Phage_fiber::Phage_fiber; Domain location=97-180::14-27::28 -41::46-59
GTSTQGIAYLSKTDSQGSHSHSLSGTAVSAGAHAHTVGIGAHQHPVVIGAHAHSFSIGSHGHTITVNAAGDAYIPPHTGLPANSTDIAPPDIPAGFVAVFNSDEASWHLVEDHRGKTVYDVASGDALFISELGPLPENFTWLSPGGEYQKWNGTAWVKDTEAEKLFRIREAEETKKSLMQ

SEQ ID NO: 138713 - protein, 96 aa, Glycine max
  Coding DNA Sequence Number=SeqID_47028
MSGFTHDSPQISASPHQFDLAPYASEPYNAQWNAPGLLRDKHTLRFESYSRRNGGMAFVNNWAVGKEKEWQSQHGFLPHPHPLYLPQFSHSSKQDD

SEQ ID NO: 138714 - protein, 243 aa, Glycine max
  Coding DNA Sequence Number=SeqID_47029
  Gene Ontology: Mol. function=oxidoreductase activity; Cellular component=membrane; Biological process=metabolic process
  Homolog annotation: Hit_ID=A6TG22; Match level="QueryCoverage=53%, HitCoverage=69%, E-value=2e-66, Identity=96%"; Hit description =Putative oxidoreductase, flavoprotein
  Pfam annotation: Domain name=FMN_red; Domain location=1-119; Score =74.6; E_value=3.3e-19; Accession=PF03358.6; Description=NADPH -dependent FMN reductase
EEGFPQSVQAIAKQIREADGVVIVTPEYNYSVPGGLKNAIDWLSRLPEQPLAGKPVLIQTSSMGAIGGARCQYHLRQILVFLDAMVMNKPEFMGGVIQNKVDPQAGEVVDQSTLDHLRGQLTAFGDYIQRHEQQRNDNHARAEFTQTAGTNLHHAVGNKAQGDTFGDREAERHHHRGDKRRYRFRQHANVNQRPSGGIGRNHPRQRRQEDDQQEQDTYDNGGQASTPANRNAGGGFDIGRNRR

SEQ ID NO: 138715 - protein, 233 aa, Glycine max
  Coding DNA Sequence Number=SeqID_47030
  Gene Ontology: Mol. function=ferrous iron transmembrane transporter activity; Cellular component=1-2nm peptidoglycan-based cell wall; Biological process=ferrous iron transport
  Homolog annotation: Hit_ID=A6TF32; Match level="QueryCoverage=100%, HitCoverage=30%, E-value=1e-110, Identity=88%"; Hit description =Ferrous iron transport protein B
  Pfam annotation: Domain name=FeoB_C; Domain location=75-128; Score =90.4; E_value=5.8e-24; Accession=PF07664.3; Description=Ferrous iron transport protein B C te
  Subcellular localization annotation: CTP_CleavageSite=63; ConfidenceScore=5.15e-01
MDRLMQALGLPGKSFVPLIVGFGCNVPSVMGARTLDAPRERLMTIMMAPFMSCGARLAIFAVFAAAFFGQNGALAVFSLYVLGIVMAILTGLMLKYTIMRGEASPFVMELPVYHVPHIKSLVIQTWQRLKGFVLRAGKVIVIVSIFLSALNSFSLSGKVVDNINDSALASVSRVITPVFKPIGVHEDNWQATVGLFTGAMAKEVVVGTLNTLYTAEDIQNEEFNPQEFSLGDE

SEQ ID NO: 138716 - protein, 100 aa, Glycine max
  Coding DNA Sequence Number=SeqID_47031
MTFMGLRKKVENRELANSATVATYPSAGGRRETRGMRVPRKEYARSRHQRLFEENVGKTGKDAIYELLSERFGSCIYARGRVFPFAPTYSSIWDEKIRPT

SEQ ID NO: 138717 - protein, 140 aa, Glycine max
  Coding DNA Sequence Number=SeqID_47032
AAGPMIHGDTLRLSAPFCHQEAAGPMTSRDKIWSFCTLVSSRGGGPDDTRRYLTVIRTLVSSIGGGPDDTRRYLTVIRTLLSSRGGGPDDKQRQNLVILLPCGGPDDSRDFGLLVLVRLIIRAICEIPEIRQVDVSSRGL

SEQ ID NO: 138718 - protein, 111 aa, Glycine max
  Coding DNA Sequence Number=SeqID_47033
MPLSMCRRLGELEIMPQRDDSSALMHEVFSGLRGLRTYVGERFDSLDGRIDAIDAHFEGMDTRITQLEEDKLNCHHQKGGDCRSKDFDVLMMSKDHVLLKFNSRGSCASQV

SEQ ID NO: 138719 - protein, 139 aa, Glycine max
  Coding DNA Sequence Number=SeqID_47034
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=72%, E-value=3e-24, Identity=69%"; Hit description=LacZ protein
MKHFTDTLISANIELSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138720 - protein, 123 aa, Glycine max
  Coding DNA Sequence Number=SeqID_47035
  Subcellular localization annotation: CTP_CleavageSite=21; ConfidenceScore=5.12e-01
MSSPHLGTAVTLTVERTTRPRLERTTRPHHQRVARPHRQRTTCPRLERATRPHLGTTRPRLERDYTSSPPRCTPSPPRTTVLALKGYMPSPWVLVTLTVERTTRPRLERTTRPHHQRAARPHL

SEQ ID NO: 138721 - protein, 212 aa, Glycine max
  Coding DNA Sequence Number=SeqID_47036
  Homolog annotation: Hit_ID=Q6WAY6; Match level="QueryCoverage=58%, HitCoverage=21%, E-value=3e-15, Identity=36%"; Hit description =Putative uncharacterized protein
AQYANRLSPRVGRFINAAGTTGFPTGKRAVSATQLIYDHDYEFELGTHSGPLRMATAHAQRKKEASWDRLLASKEGASVNWFPRWKEGRTGILISCGGFPNVPLMGTRGCINYNPVLAIRQLGYPMRGAPLKEELTPIIARGFNSTNAEALQKVRKAWEMVQKKDKELKGSSNKPIGGYHRWLKAYMQGLDWLPNLRTTKGVEVEAPEKDEE

SEQ ID NO: 138722 - protein, 257 aa, Glycine max
  Coding DNA Sequence Number=SeqID_47037
  Homolog annotation: Hit_ID=A2Q6B4; Match level="QueryCoverage=30%, HitCoverage=32%, E-value=2e-07, Identity=35%"; Hit description =Ribosomal protein L33; Nucleic acid-binding, OB-fold
MDLKEGCTYVMHNFRVTKNDEQYRVCDHPYKLTFIGVMVVRQCDLDGLPLKKYRFIDFSDIIVGQLQFDLLVDIIGVVDEVVFRHISPKIMNWCLALYGPIIVLLTNARIKEGQGSYPCSVSNSLKASKLTINEPLTPIEEFNQKLSELGIEIRSILTRRSQWSSQPSGSAQLSSRETFISKLEAKSISEINNLCEVIHLYMFTCLSLLWMPPAKFYSWYNHKDCYGQSFMVLSILHSVLKENRCLSRTICVPMWQT

SEQ ID NO: 138723 - protein, 138 aa, Glycine max
  Coding DNA Sequence Number=SeqID_47038
DKRYPLSKGRVSYTTVIRAAVGGPFESCGSLPLHEWGQSSGSGSRSVPGARLLFRRVFDNLAVVRSPLLEAGVLGRWGFLFLNQFGCVSPEIGWSNIYELAGQRWMEGKIDWSSSGTGPSIDHGAYSTLTEFILLKRN

SEQ ID NO: 138724 - protein, 202 aa, Glycine max
  Coding DNA Sequence Number=SeqID_47039
  Homolog annotation: Hit_ID=A5B5G6; Match level="QueryCoverage=45%, HitCoverage=22%, E-value=2e-07, Identity=36%"; Hit description =Putative uncharacterized protein
  Pfam annotation: Domain name=zf-CCHC; Domain location=107-124; Score =21.5; E_value=0.00084; Accession=PF00098.14; Description=Zinc knuckle
MKREKHVSYSSHNSCKSLSEELRDYCEGRHRSHLRPHSHRRENERKPQEVNIKLPYFHGKDNVEANLDWEIRVEQQLKRKSTSKSYGSHSYPKKDQGQGILGKTSSMKCFKCLGRGHITSQCPTKKTMIMRGQDIYSSQDEATTSPSSSKSEEAKGEESSEEIYPQEEGQPLMVKEEYKETLVSIATSLRLEFIPQVKELLD

SEQ ID NO: 138725 - protein, 130 aa, Glycine max
  Coding DNA Sequence Number=SeqID_47040
MYVPVQRRGLGVEESIPSSERQQREVGPELRRAIRCKKGFLRRGPGAHQHGWQGATFTSELRCCQAVLCLGSGAIEEVTACSFIFVCPSWFPPGIPVLCNFSSQSFKRKEHGIEAMVKCRAESKGRDQSR

SEQ ID NO: 138726 - protein, 154 aa, Glycine max
  Coding DNA Sequence Number=SeqID_47041
VPPVQLLTGWCVTAKAPPDISAGKCSGHAARRVPFAIQAAQLLGRAIGAGLFAITPAGERGMCCKAIKLGNARVFPVTTLNSIHQLLVIHASFIIESGAPRIDCLGLIEFGAPRMDFLALFVYPTPSNLIRSPMNCLSFMHPPPSSLEPHELIA

SEQ ID NO: 138727 - protein, 198 aa, Glycine max
  Coding DNA Sequence Number=SeqID_47042
  Homolog annotation: Hit_ID=UPI00005545B3; Match level="QueryCoverage =32%, HitCoverage=35%, E-value=1e-16, Identity=75%"; Hit description =conserved hypothetical protein
MADFRLWSTSRSHSQAGLYHYAHEQNLSLSLPSHTSASLDEKSGLSDWSFCVITSHLSYTFDQGCHCEAIVKVHGVLPSSRRYLCDKEFRYLRTVRVTAAVYRGFHSKLITLLLPTFQHRAGVRLYTSCYHLAESCVFNKQSLPPVHREDRPPNSKFFPGSFNLVDYDNSRDYKQTRDYGRAGDRARPSQKGFDDSSK

SEQ ID NO: 138728 - protein, 184 aa, Glycine max
  Coding DNA Sequence Number=SeqID_47043
  Homolog annotation: Hit_ID=A2Q142; Match level="QueryCoverage=58%, HitCoverage=39%, E-value=9e-09, Identity=37%"; Hit description =Ovarian tumour, otubain
  Subcellular localization annotation: CTP_CleavageSite=7; ConfidenceScore=5.06e-01
MCPPPSKVNTKGAPKKPIKRSQRSTKRDPSYWEYVDVFDCVQSSNSPVKRSASCSEPPQPTRIIPMLDQFAPFIQGFILDVVDVKADGNCGYRSIAALLEMGYVIASRYNIILVSLSRQQSMTFFPLRTQPPPDSFGHRMICVGHLFGNHFVQAKQSTTPYISRMQQYTSLMSFKRHYVDLNED

SEQ ID NO: 138729 - protein, 108 aa, Glycine max
  Coding DNA Sequence Number=SeqID_47044
MHLSLTLNWSLYFSVIFKFRLMMNGQWLKKDALPPQDERTPSPPPQRDDSALMTEVLSELRGLRTYVGEHFDSLDTRFAGMDIRLTQLEKDVGYIRQSFDLPPPPPPS

SEQ ID NO: 138730 - protein, 76 aa, Glycine max
  Coding DNA Sequence Number=SeqID_47045
MKENNKGSPVESPTVATYPSAGGRRVTRGMRVPRKEYARSRHQRLFEENVGKTGKDAIYELLSERFGSCIYARGRY

SEQ ID NO: 138731 - protein, 62 aa, Glycine max
  Coding DNA Sequence Number=SeqID_47046
MASNLATSAKARLTGALSKGGKMRGVATNEGISTSHVDKSGDLAPTYPPSKRKSDLRSSFLR

SEQ ID NO: 138732 - protein, 294 aa, Glycine max
  Coding DNA Sequence Number=SeqID_47047
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTLTCPINVSFRQKLAQGFPGINRDTRIYLFCEVIFRHRYLFGAKCRRVLQWLMFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSICGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138733 - protein, 147 aa, Glycine max
  Coding DNA Sequence Number=SeqID_47048
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=2e-24, Identity=54%"; Hit description =Putative uncharacterized protein
  Subcellular localization annotation: CTP_CleavageSite=41; ConfidenceScore=5.41e-01
MTMITPSSKLTLTKGNKSCPNHRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138734 - protein, 64 aa, Glycine max
  Coding DNA Sequence Number=SeqID_47049
MTSYGGELVLDSSSPLSGVSNYLSCFSIPLPLIFKKKMTPLLKKIQGLQAPHGATSCGIKSISS

SEQ ID NO: 138735 - protein, 212 aa, Glycine max
  Coding DNA Sequence Number=SeqID_47050
  Homolog annotation: Hit_ID=Q6WAY3; Match level="QueryCoverage=98%, HitCoverage=7%, E-value=3e-08, Identity=27%"; Hit description =Gag/pol polyprotein
  Pfam annotation: Domain name=G-patch; Domain location=43-82; Score =19.4; E_value=0.00085; Accession=PF01585.14; Description=G-patch domain
MPYVEAAEESLETAFQSFEVVSISSVDSLSRQACMSDAAVMMARVMLGSGYEPGIGLGKDNGGITSLRNAKGNRGKYGLGYKPTQADIKRSIAKRKSESQGSRLRQEGEGIPPCHISRSFISAGLGDEGQVVAIYKDDVPSALNLVRPCPPDFRLGNWQVEERPDIYATSIISNDESLEGTNTWDPPIDFKQETSQTEDEENKDVGLPPELE

SEQ ID NO: 138736 - protein, 76 aa, Glycine max
  Coding DNA Sequence Number=SeqID_47051
MEGVQLIPHFHIKPTKEPSYACSFLLPKSSSLKRGNVPLPKGTLKIIPILYWRIPMNPSFPNKGSPPIEGIPLKAK

SEQ ID NO: 138737 - protein, 180 aa, Glycine max
  Coding DNA Sequence Number=SeqID_47052
MAPRNLASKRSRKDKAAEGTSSAPEYDSHRFRSTEHQQRFEAIKGWSFLRERRVQLRDDEYTDFQEEIVRRRWASLVTPMAKFDPDIVLEFYANAWPTVEGVRDMRSWVRGQWIPFDADALSQFLGYPLVLEEGQECEYGQRRNRADGFDEEAIAQLLCIPGQDLPGLLLGDECGSCAPT

SEQ ID NO: 138738 - protein, 194 aa, Glycine max
  Coding DNA Sequence Number=SeqID_47053
  Subcellular localization annotation: CTP_CleavageSite=36; ConfidenceScore=5.27e-01
MAGPLNESHPLASKGLHVNPSGTTSPQPSRGLGRPRLSEDYTSLPSDDYMPHFQRLTRPRTSESYTARPSKDYTSSPSEGYTPSPLEGCTSSPSKDYTSSPSEGYTSSPSEDYTSSPSKEYTSSPSEGYTPSISEDYKSSPSEGCTPSPSEDYNSSPLEDYTSSPLEGCTPSPSEDCTSSPSEGYMPFAFRGLH

SEQ ID NO: 138739 - protein, 104 aa, Glycine max
  Coding DNA Sequence Number=SeqID_47054
MRSANRKRKVFQFLREECARRAKSRRSQREYLTRRLWMKYRQKIRQAPAFRGHPKWLIDTEDWLSKLIKVIDEENLEAPEEDEEAEPKLELGKARLAKEKLQIS

SEQ ID NO: 138740 - protein, 74 aa, Glycine max
  Coding DNA Sequence Number=SeqID_47055
MELCTHKRKLKGNERISMGRNVSALIGKSVPHIPEKCKDPGSPYTSDLLYEVQAEEPSSSPTLVPPTVQPPPTP

SEQ ID NO: 138741 - protein, 77 aa, Glycine max
  Coding DNA Sequence Number=SeqID_47056
MCAQVCSKSKRLEMAPKKLSANRSRRDAAAEGSSATPEFDSHRFQSAEHQQRFEAIKGWSFHRERRIQLREDEYTDF

SEQ ID NO: 138742 - protein, 57 aa, Glycine max
  Coding DNA Sequence Number=SeqID_47057
MNDGFVGQRRMKDDFVGQKRLLYEDIGLLRSMLLYGNCCGGSSCSCGHEGCGDDDCG

SEQ ID NO: 138743 - protein, 71 aa, Glycine max
  Coding DNA Sequence Number=SeqID_47058
MWVQAIGLFAQATCAPEFGLPRPFNQRLLVLRIGGAAVKQQIHDAHRDNPSLVFKNPLQQETHGLLIPFQK

SEQ ID NO: 138744 - protein, 130 aa, Glycine max
  Coding DNA Sequence Number=SeqID_47059
MYPPLELIHKICTLSCSQYYNPSRCTFYLYHKGCTLQGVKTKNSQAVSPLNLCKGKQKISQAKNKILKTKFRKLFGKEKQWAMVILMMPKNQELSKVSSKDSRIKFQDSRFKNNQDQDSGIKRRLNQNKY

SEQ ID NO: 138745 - protein, 85 aa, Glycine max
  Coding DNA Sequence Number=SeqID_47060
MSPDFTSQDDKGAEDDVSLRVSTGLTEIVCADNHLGISACHRTSRVTIAKGGAVDKSEALSPTYPQFVMRNSDLRSSCKNGVRLK

SEQ ID NO: 138746 - protein, 215 aa, Glycine max
  Coding DNA Sequence Number=SeqID_47061
MFGLVGTCQLSQLCRSYSCTTSTKQLHLSLSESVYFVKMASRKHISSDSRPQDQYDTRRFQSMDARNRYIDNILDRRILPERNVQIYHFEFDEFKTELERRNLHKCLTNLQEGSIDVAVVKEFYANFYSPEDQAPKCARVRGHLIKMDADNLNEFLQTPVLLEVGESLPTYYRFYRLRSDPKEMVASLCIPCKGFILKAEGHPWKLLKKDFTTLA

SEQ ID NO: 138747 - protein, 74 aa, Glycine max
  Coding DNA Sequence Number=SeqID_47062
MTRTQHVHIVGEPWGIPLSTDFQVQAIGQFAQATCVPEFGLPRPFNQRLLVLHVGGVAVKQRVKFKTNKFQNKK

SEQ ID NO: 138748 - protein, 412 aa, Glycine max
  Coding DNA Sequence Number=SeqID_47063
  Homolog annotation: Hit_ID=Q2HW90; Match level="QueryCoverage=48%, HitCoverage=40%, E-value=2e-14, Identity=31%"; Hit description =Putative uncharacterized protein
MASQEKWGPFADILALLIFGVVLFPNVDGLVDLAANDAFLAYHHSKESPVVAILADLFDTFDRRCEKNSVRIVCCLPALCVWLISHLFQQDTRHPCSLQSYRSCAEKGRVDWDQHLAGIGGNAINWFPCWKEGKEGVLFSCGDYPNIPLIGTRGVPHEGSANRRKLSPFLVRNLDAQSLKAIQRVHKAWRSPLRKDKELKGIRNGIIGGYHGWLRIHTRGLDWLSKLKVIDEEDFEAPKEDEEVRALKLELGKARLAKEKFKSAATHIRKECTELQEENAATAKALEQETKRARKEEHGREKFRGALWGSNNELKLRREERDRSRVHGMILKEELVACARSKRSLAQHLEATEQSMLAIIGQYKEELNQSMAHEEKLVEDFAQVYAEKEARGRVIDALHQEATMWMDRFALT

SEQ ID NO: 138749 - protein, 42 aa, Glycine max
  Coding DNA Sequence Number=SeqID_47064
MEVQSFNNRFSAMYWKPKDSPSRFTGTYVSVGKIDVGVKTIM

SEQ ID NO: 138750 - protein, 196 aa, Glycine max
  Coding DNA Sequence Number=SeqID_47065
  Gene Ontology: Mol. function=sequence-specific DNA binding; Cellular component=intracellular; Biological process=regulation of transcription, DNA-dependent
  Homolog annotation: Hit_ID=A5FAS3; Match level="QueryCoverage=59%, HitCoverage=38%, E-value=3e-36, Identity=64%"; Hit description =Transcriptional regulator, AraC family
  Pfam annotation: Domain name=HTH_AraC; Domain location=45-86; Score =8.4; E_value=0.34; Accession=PF00165.14; Description=Bacterial regulatory helix-turn-helix proteins, araC family
  Pfam annotation: Domain name=HTH_AraC; Domain location=92-135; Score =18.5; E_value=0.018; Accession=PF00165.14; Description=Bacterial regulatory helix-turn-helix proteins, araC family
  Pfam module annotation: Pfam domain module=HTH_AraC::HTH_AraC; Domain location=45-86::92-135
MIAQIELLLSYSNRFYKRQFITRKAVNHGILEKFEEVLDQSFNNSSLLEHGIPTVHSLAEKLSISPSYLSDLLRSLTRQNTQQYIHQKLSNLAKEKLSTTQLSISEIAYELGFEHPQSFSKFFKKMEKEMKVFVTGATGFIGSATVKELQSGGHQVIGLARSEESAEKLRKSGVEVYYGDLSQPETLIEAVEKADA

SEQ ID NO: 138751 - protein, 112 aa, Glycine max
  Coding DNA Sequence Number=SeqID_47066
MDDFTEDEDQQFFDHTNHQSDDQTDDEGVGKPRHLRHLRCNISNLGVQTIYSDQRRLNFVYKLHENGCTWSLGAYNSRRHNKWIVKSIRGHHTCLVPMLRQDHLQLDKHVIA

SEQ ID NO: 138752 - protein, 40 aa, Glycine max
  Coding DNA Sequence Number=SeqID_47067
MRLPGKESMLMKIEEIHSKRINLAQCGAKKSLAHKILVGN

SEQ ID NO: 138753 - protein, 193 aa, Glycine max
  Coding DNA Sequence Number=SeqID_47068
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=44%, HitCoverage=72%, E-value=6e-24, Identity=67%"; Hit description=LacZ protein
  Subcellular localization annotation: CTP_CleavageSite=62; ConfidenceScore=5.20e-01
MAARGTPAPAPARGGGHRHRPAALGAALWRLPCRARCHRPLAGRCATARTPPPQPQAAGAVRAGRGGLRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138754 - protein, 425 aa, Glycine max
  Coding DNA Sequence Number=SeqID_47069
  Homolog annotation: Hit_ID=Q6WAY4; Match level="QueryCoverage=95%, HitCoverage=81%, E-value=1e-33, Identity=27%"; Hit description =Putative uncharacterized protein
LKELGRLMGPLQRQAFRKVYRKILDLTAAEVFTEAVVSLAQYCDQALRCFTFGDFQMVPTIEEFEEILGCPLGGRKPYLFSGFLPSLSKIVAVVGDSAKEMDRMKQTRNGVVGLPRKYLEGKARDMASQEKWGPFADILALLIFGVVLFSNVDGLVDLAAIDAFLAYHHSKESPVVAILADLFDTFDRSYRSCAEKGRVDWDQHLAGIGGNAINWFPRWMEGKEGVLFSCGDYPNVPLITTRGCINYNPALAIRQLGYPMRGAPTEESLSPFLVRDLGAQSLKVIQRVHKAWRSSLRKDKELRGIRNGVIGGYHGWLRVYMRGLDWLSKLKVINEENFKALLAKEKFKSAATHIRKEYTELQEENAATARALEQETKRARKEEHGRNKFRGALWGSNNELTLRREERDRSWVHGMILKEELAACA

SEQ ID NO: 138755 - protein, 253 aa, Glycine max
  Coding DNA Sequence Number=SeqID_47070
  Homolog annotation: Hit_ID=Q094Z8; Match level="QueryCoverage=85%, HitCoverage=17%, E-value=2e-30, Identity=37%"; Hit description =Putative uncharacterized protein
VAVNQQLALHRVILLSEVGAEDRQHGQQHYRQRHHVGNRHIARATELVQQPQRQRALVAGGKGGHDDFIERQRERQHAPGQQRRAEVRQDHVTEGLPAVGAEIHRRFDQAVRGAAEPGDDVVEHDHHAERRMADDDGQDARLDVQRLERRQQRQTGDDPRQRDRQQQQQRNAVLAEEIAPIQRRRRQGAEHQRDGGRQAGDLRRQQHRIEDILPPGGNVEPVQREPLRREAESGILGVEGVNGDDRQREMQED

SEQ ID NO: 138756 - protein, 76 aa, Glycine max
  Coding DNA Sequence Number=SeqID_47071
MDKHICRSKLHDESRLIQRSFDDNKGDDKKLKESKNEFKIESRTLQGSRGNLISRIKFQESSFQELRSRFKNQEKT

SEQ ID NO: 138757 - protein, 41 aa, Glycine max
  Coding DNA Sequence Number=SeqID_47072
MGVQIAPRPTWALQNIPPEGGCFWRKQPGSPGRAELAWGRK

SEQ ID NO: 138758 - protein, 128 aa, Glycine max
  Coding DNA Sequence Number=SeqID_47073
MNLGHIISSQISLIAQHDSSRLGFPTLITTLCKARGVTSDSLTFESLSPAINVAYVKKNCWNLDDPTVTFRGPHKAKGKRSEAPSSSHIPPIPAPSTSTAPSVPAPPTGTSSITSKTLFSMLQSLHKG

SEQ ID NO: 138759 - protein, 183 aa, Glycine max
  Coding DNA Sequence Number=SeqID_47074
MASITEAMLKLQKTIEDNATVVASNTAREVEPVLQPAINLGRDRNATGFNRRYSPQAYPYGLPLDFTPGTALDDLSQAPTFEGQLPPHADYPLQEDDEGDAHSGPLLPLQEPGPHELPQPNIVCHIPSPSVPIKELVPIAKDKGKIDLLEERLRAVEGLGNYPFSDLADQCLVPDIIIPPKFK

SEQ ID NO: 138760 - protein, 185 aa, Glycine max
  Coding DNA Sequence Number=SeqID_47075
MAFKHKVQSLIEAGWLTFQEDRPNVKTNPLANHGGGAVNAVESGRPRRSKPPEGCIDPQKDSCLMHPGAPHSMEACLAVGDLLQQMIDQGRLEIGDEGGTQLPKRRDTPWYTPPSERKEGATDISSLSAKVTNITGLSSMTRSGHVFAPPDLPTQPANAKGMARMKEGQNVKVILALDEMAVTRE

SEQ ID NO: 138761 - protein, 277 aa, Glycine max
  Coding DNA Sequence Number=SeqID_47076
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRCCMPPESCAGYLSRAWPRPTLCSSAAACSRASFLALPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138762 - protein, 43 aa, Glycine max
  Coding DNA Sequence Number=SeqID_47077
MAEISQGVFQFTPTRINETLGLIRILVVDLKRANKAALILVNF

SEQ ID NO: 138763 - protein, 92 aa, Glycine max
  Coding DNA Sequence Number=SeqID_47078
MAMVEYAAKFEELVKQAMNYQGVRQFPLLVNMCRIWDEDSRDKAAYYRSTGQMKNKKNRPQHRGKPYSTLSKEYGNRSNNQRTVAIGLVGGS

SEQ ID NO: 138764 - protein, 168 aa, Glycine max
  Coding DNA Sequence Number=SeqID_47079
MSGFTRNSPQISASPHQLDLAPYASEPYNAQWNASGLLRDKHTLRSSRILGEMEVDEPWLGLWLPLNYQVDMGASQHRTLELGVKFYRLSRCKIHFLVVFLCGRQTFVVDLGMAFVDNWVVGKEKVCYWLSKDIVGLVGNLAVQEWQSQHGFLPHPHPLYLPQFSQSS

SEQ ID NO: 138765 - protein, 235 aa, Glycine max
  Coding DNA Sequence Number=SeqID_47080
  Gene Ontology: Biological process=transposition, DNA-mediated
  Homolog annotation: Hit_ID=Q1J7G7; Match level="QueryCoverage=17%, HitCoverage=71%, E-value=1e-11, Identity=72%"; Hit description =Transposase
DLPSQVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISWKHRKSSFNICGIKWNSGGSKSSGKEIEYQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 138766 - protein, 130 aa, Glycine max
  Coding DNA Sequence Number=SeqID_47081
  Homolog annotation: Hit_ID=Q2HW90; Match level="QueryCoverage=80%, HitCoverage=20%, E-value=8e-08, Identity=34%"; Hit description =Putative uncharacterized protein
MGTNQTGKRFYQVKIKGLDVTILKELGRLMGPLQMQAFRKAYRKILDLTIAIAEIFTEAVVSLTQYYDQPLRCFTFGDFQSVPTIEEFEEILGCPLGGRKPYLFSGFLPSLSKIAIVQRKPGGSYVGKLI

SEQ ID NO: 138767 - protein, 106 aa, Glycine max
  Coding DNA Sequence Number=SeqID_47082
MASRKHKSIGARPAAQYDTRRFHSLDARNRYTDNALGRSILPEKKVEIYHTEFDDFKTELERCNLHKCLTNLANGTIDVALMKEFYANLYSSEDPSPKQARVRGHL

SEQ ID NO: 138768 - protein, 107 aa, Glycine max
  Coding DNA Sequence Number=SeqID_47083
  Subcellular localization annotation: CTP_CleavageSite=40; ConfidenceScore=5.10e-01
MGYKNKIGEKLATQLAQASKVASSRSNSLLEEGSGRPNFRRSYGNSRIAKKHIFSFSAILRNFTDRASLLPFDFRHVSELHILCNKGCQVPRSGQTKVACHQTMVPG

SEQ ID NO: 138769 - protein, 107 aa, Glycine max
  Coding DNA Sequence Number=SeqID_47084
  Homolog annotation: Hit_ID=A2Q1Y4; Match level="QueryCoverage=71%, HitCoverage=26%, E-value=1e-30, Identity=84%"; Hit description =Nodulin-like protein, related
MDKVVGGRGMVIWSVVVAVDSGCGDMVANMRVHIARTGWFAAALVPTPIAFILLAISGSGAALHIGTALIGLSSGFVFSAAVSITSELFGPNSVGVNHNILITNIPL

SEQ ID NO: 138770 - protein, 91 aa, Glycine max
  Coding DNA Sequence Number=SeqID_47085
MNRWMTMKNLMLEDTGTQRSDRIIYVRGRGCHNAERPVVHVDPATEKADDPHKKKLRTYLGIVARDKVDITYENWKEVPTAQNDLVWEDIQ

SEQ ID NO: 138771 - protein, 88 aa, Glycine max
  Coding DNA Sequence Number=SeqID_47086
  Subcellular localization annotation: CTP_CleavageSite=78; ConfidenceScore=5.45e-01
MVKVGTSYVPIKRLLFSPKVGPGLPGAYNESTSTGTRVPFASVRNCSGRPDRCGPLRYYAPTRRKGMCCKLRLSWEKEAATAVAAALE

SEQ ID NO: 138772 - protein, 145 aa, Glycine max
  Coding DNA Sequence Number=SeqID_47087
MGKAEEVQEKMKADMEAMKEQMATMMAMMSMRKIMEANAVAVAATNTIAKVNPMPPSGLNQMNHPTSDMVGKDLGSTDGPMMCKFKTSTPSRYMACLPTIHHPMWRTLPMRMSITPLPCSLRADNLIIYMSLNPWGRHMKYPTTI

SEQ ID NO: 138773 - protein, 36 aa, Glycine max
  Coding DNA Sequence Number=SeqID_47088
MDALEPYTGAMRGTMHKPQANLRADLKFSPNRFLAT

SEQ ID NO: 138774 - protein, 221 aa, Glycine max
  Coding DNA Sequence Number=SeqID_47089
  Homolog annotation: Hit_ID=Q6WAY6; Match level="QueryCoverage=41%, HitCoverage=16%, E-value=1e-09, Identity=35%"; Hit description =Putative uncharacterized protein
MANQGDWVPFMDVLALLIFGAVLFPNVDGLIDLAAIDAFLAYHHSKESPVVAVLADLFDTFDRRYPNIPLVGTRGCINYNPALAIRQLGYPMRGAPTEESMSPFLVRDFGAQNSKTIQRIHKAWETPLKKDQELRGIRNGIIGGYHEWLKVHIRGLDWLAKLKVVSKESFEALEEDEEVQISQKRFRKGKICQGEVQFGRYTLSEGLCRVTGRECNYRKSP

SEQ ID NO: 138775 - protein, 101 aa, Glycine max
  Coding DNA Sequence Number=SeqID_47090
  Subcellular localization annotation: CTP_CleavageSite=37; ConfidenceScore=5.13e-01
MPLRGRIASGSHPQDNQWTRRSPTGSWSCQALIMGLCQFYGVSVAPSKVIRPPTNRAFIKKYCVPRQAQGETPQQPGDGRQRASDAPPSPLEFTLAHPQKG

SEQ ID NO: 138776 - protein, 123 aa, Glycine max
  Coding DNA Sequence Number=SeqID_47091
TPGFIICEVISVTGIYSAQSASAVPPVQLLTGWCVTAKAPPDISAGKCSGHAARRVPFAIQAAQLLGRAIGAGLFAITPAGERGMCCKAIKLGNARVFPEFDPGPSWLKVSVDLCDRWFGEFK

SEQ ID NO: 138777 - protein, 148 aa, Glycine max
  Coding DNA Sequence Number=SeqID_47092
QGAPFEGTIVDDWKFDYSSHDARRMVCNDQAEMTAHLVRYRMLKALRANAPLPYPQLITLFLRHFQIPLDDEPFVQVKCSFAIGAGAVTSFGYRKDRNGQWLKKDALPPQDERTPSPPPHMDIRLTQLEEDVGYIRQSFDLPSPPPPS

SEQ ID NO: 138778 - protein, 146 aa, Glycine max
  Coding DNA Sequence Number=SeqID_47093
  Homolog annotation: Hit_ID=Q6WAY3; Match level="QueryCoverage=84%, HitCoverage=5%, E-value=5e-07, Identity=30%"; Hit description =Gag/pol polyprotein
  Pfam annotation: Domain name=G-patch; Domain location=1-42; Score =21.2; E_value=0.00052; Accession=PF01585.14; Description=G-patch domain
MVARVMLGNGYEPGMGLGKNNGGRSSLVSTRGNRGKFGLGYKPTQANIRKSVAERKSGSQGLGHECQVVAICKDDSTSGSDLVRPCPPGFRLGNWRLEERPDIYGTSIISDDESLEGTNTWDPTSDFKQEMDQTESEEDEDVGLPP

SEQ ID NO: 138779 - protein, 187 aa, Glycine max
  Coding DNA Sequence Number=SeqID_47094
MHKALRSYAPLPYPHLITLFLQHFNVPFDSEPFVKVKRSFSIGANVVSSFGYRKERDGSWVKKDALVQVVEDRSPSPHSQRDDSSSLMHNILERFDGLQTYVDERIVIIKKGDIVEAMPSKIILMMPKNQESSKFQRIKSQVSFKNQDQDSRFKNNQDSSKESRLKIQESREDSIKISIKRVFQNIE

SEQ ID NO: 138780 - protein, 161 aa, Glycine max
  Coding DNA Sequence Number=SeqID_47095
MAPTMHPLDPDKSNRALGVPALITGLYQSFGVPVAPSKVIRPPITRAFIEKYCTQRQAQGDAPQAADAPSPHQASPTGSFDMEQYLRHLVRHLQSQGFTSFPCPTLDQFRAEVAWPGDWPEALAGEAPAEALAEAPDEADEVHEDEEMTDLLDFLGGSGAT

SEQ ID NO: 138781 - protein, 155 aa, Glycine max
  Coding DNA Sequence Number=SeqID_47096
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=1e-24, Identity=55%"; Hit description =Putative uncharacterized protein
  Subcellular localization annotation: CTP_CleavageSite=49; ConfidenceScore=5.52e-01
MTMITPSSKLTLTKGNKSWYRAPPRGRRVGRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 138782 - protein, 292 aa, Glycine max
  Coding DNA Sequence Number=SeqID_47097
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMKGLVGQELSRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138783 - protein, 219 aa, Glycine max
  Coding DNA Sequence Number=SeqID_47098
  Gene Ontology: Mol. function=sugar efflux transmembrane transporter activity; Cellular component=integral to membrane; Biological process=carbohydrate transport
  Homolog annotation: Hit_ID=A6T4K9; Match level="QueryCoverage=84%, HitCoverage=47%, E-value=2e-85, Identity=86%"; Hit description=Sugar efflux protein
AAACPELEGGWRDKNVRMLFIASTLMWTCNTMYIIDMPLWISSDLGLPDSLAGILMGTAAGLEIPAMILAGYYVKRWGKRKMMVAAVAAGVLFYVGLIMFHGRTALLALQLFNAIFIGIIAGIGMLWFQDLMPGRAGAATTLFTNSISTGVILAGVIQGALSQSYGHGSVYWTIAAISLLTLFLTSRYDSLDVADNKDVGNHPDQRGHANVNEGVKEVT

SEQ ID NO: 138784 - protein, 122 aa, Glycine max
  Coding DNA Sequence Number=SeqID_47099
RVHLLGNCYTENKRGYISCGSVQGEDTSTWLFKENKGGYIPCGSLACKGFYKDERNLKNRRLLGGLDVFRGHLIQQSNPIRPYKVRPSSIVPPPPPAQIELSTISNSTPPHDCWPPLTSPLH

SEQ ID NO: 138785 - protein, 271 aa, Glycine max
  Coding DNA Sequence Number=SeqID_47100
  Pfam annotation: Domain name=zf-C2HC_plant; Domain location=77-131; Score=48.3; E_value=2.6e-11; Accession=PF07567.3; Description =Protein of unknown function, DUF1544
MTSGVELAEACIAEATQGENEGNRKGKNQNGHDWCQGQYIKGTGSNSSYVNIAIATGATTFVGSRPRSKNAPGNKTDIGWKHGTNFLGNGKKVKCNYCSKTNNGEIFRFKHHLVEIRWDFEPCPWMLKEVKMLMMKVVAKVSNASKKKRKLNSIHEEGIHTEGVETNTTQNGIEGKMMFAFKGREKEKFVQASGEGVQATLNQLYKKGDKDKVDDQCAQFWYTSFIPFNVIKNPTFTKFCDMVARYEVGYKPPSYLDIKEKLLKRVVGKLI

SEQ ID NO: 138786 - protein, 198 aa, Glycine max
  Coding DNA Sequence Number=SeqID_47101
  Homolog annotation: Hit_ID=A5AWR0; Match level="QueryCoverage=31%, HitCoverage=6%, E-value=4e-07, Identity=35%"; Hit description =Putative uncharacterized protein
MNLDRLHQIDMRGNHYIDWMEYHAEWINIWKNKHNDVLARQWVEGIVTHTPAYMEWYRKNTTLFLSVAQQLHDPHTKITIMLQGQSMYCIPSLVHQTFGQTGESVTATSHEWMSDLFDVDFNTPNLTTSYLASLQQFNAPHSFGEQGQSSSATTTNIGYTNIEQQHHHDMGEPVIQERRNPRRNRRPPPCGTGHRLGH

SEQ ID NO: 138787 - protein, 43 aa, Glycine max
  Coding DNA Sequence Number=SeqID_47102
MAAHLEESQMTFEERLEKQIEEKMTYIFKNAYCFGWIIFPDNG

SEQ ID NO: 138788 - protein, 87 aa, Glycine max
  Coding DNA Sequence Number=SeqID_47103
  Subcellular localization annotation: CTP_CleavageSite=35; ConfidenceScore=5.51e-01
MFTDHLIRKAHSDFSTAISTIAGNTGPKKVRFTVLTSTVDTNLLNDSVALRGSFLAAPPEQWRQPPQRRRRRGTKKGSNVKKKTRKE

SEQ ID NO: 138789 - protein, 71 aa, Glycine max
  Coding DNA Sequence Number=SeqID_47104
MEKQWTPPSEGFLKCNVDTGFFQPQNCTGVGMVCACVMLEEGEAWGLFQALEFVASYGYKWVVFEIDSKCV

SEQ ID NO: 138790 - protein, 422 aa, Glycine max
  Coding DNA Sequence Number=SeqID_47105
  Gene Ontology: Mol. function=nucleic acid binding
  Homolog annotation: Hit_ID=A7UQU7; Match level="QueryCoverage=71%, HitCoverage=59%, E-value=1e-37, Identity=30%"; Hit description=IMP dehydrogenase/GMP reductase, putative
  Pfam annotation: Domain name=DUF1723; Domain location=146-193; Score =34.4; E_value=4.2e-07; Accession=PF08330.1; Description=Protein of unknown function (DUF1723)
MVRTRGLGRALGQVTDRGVGRGDRDDFDDAPQRRRPTASTRRQRVAVTAAHDEPDVQDDPMEASAAVEDIVANIPADTGAEAIEDEHERFPGGPSDPSVLTQYADHVACSVWTGEERLELKLSSHGRKVHNLGRPVPTIEGLVAGTGLSPLIACSRWHRETSSFHLPVGELTITLDDVSSLLHLPVIGDLHVFEPLHVDDAVQMLVDLLMVSAEFARTGHWTAVARAYLLHLLGCTLFANKSATNVHVVYLEAVRNLSMTERYAWGVTALVHMYDQLNDCWIYEHFPSVADSTADQEYVEDSPRACRWIATKKTVKNIRMPTYRERLDRLRIPDICWIPYGEHREVRDFHTIPTPPVDSWVSYDDIHDRWMHYEDHIIPVGETDIPHVSEPGASSTSAEEPRHAVVGVPSESRGGHAWLIDT

SEQ ID NO: 138791 - protein, 117 aa, Glycine max
  Coding DNA Sequence Number=SeqID_47106
MEFISISDHTSLVVTTKLVVPRGNSPFKFNNAIVDHPNFSRIVGDGWKQNIHGCSMFKVCKKLKALKAPLKNLFKQEFNNISNRVELVEAEYNSVLNSLKQNPQDPSLLALTNRIRG

SEQ ID NO: 138792 - protein, 556 aa, Glycine max
  Coding DNA Sequence Number=SeqID_47107
  Gene Ontology: Mol. function=secondary active sulfate transmembrane transporter activity; Cellular component=integral to membrane; Biological process=sulfate transport
  Homolog annotation: Hit_ID=Q9AT47; Match level="QueryCoverage=98%, HitCoverage=83%, E-value=0.0, Identity=80%"; Hit description=Sulfate transporter 2
  Pfam annotation: Domain name=Sulfate_transp; Domain location=191-502; Score=538.5; E_value=7.5e-159; Accession=PF00916.11; Description =Sulfate transporter family
MGDPADENLERKEMDVRNLSSSHGQEPYVHKVGIPPRQNLFKEFQSTVKETLFADDPLRSFKDQSKSRKLILGIEAIFPIVSWGRTYNLTKFRGDLIAGLTIASLCIPQDIGYAKLANLDPQYGLYSSFIPPLIYAVMGSSRDIAIGPVAVVSLLLGTLLQSEIDPIANPVDYRRLAFTATFFAGITQATLGVLRLGFLIDFLSHAAIVGFMGGAAITIALQQLKGFLGIAKFSKKTDVISVMHSVLSSAHHGWNWQTIVIGASFLGFLLFAKYIGKKNPKFFWVPAIAPLVSVVLSTLFVFLTRADKHGVAIVKHLEKGLNPSSVKEIYFTGDYLGKGFRIGIVAGMIALTEATAIGRTFASMKDYQLDGNKEMVALGAMNVVGSMTSCYVATGSFSRSAVNFMAGCETAVSNIVMSVVVFLTLQFLTPLFKYTPNAILATIIISAVINLVDYKAAILIWKIDKFDFVACMGAFFGVVFASVEIGLLIAVSISFAKILLQVTRPRTAILGKIPRTTVYRNIQQYPEATRVPGVLIIRVDSAIYFSNSNYVKERDH

SEQ ID NO: 138793 - protein, 287 aa, Glycine max
  Coding DNA Sequence Number=SeqID_47108
  Homolog annotation: Hit_ID=A7NYV5; Match level="QueryCoverage=11%, HitCoverage=6%, E-value=3e-09, Identity=93%"; Hit description =Chromosome chr6 scaffold_3, whole genome shotgun sequence
MPLHYNKTNGMQFMIADFFGALRARVYDDEVRKWISVVGVHFIGKKLVNLNDEALDLIHVRFFREKDRKPAEDGSAGSSASRKCSLRKKVPKVLPLDPVEEPAEASFAGSSGRTFFTFFRWNLRKNHFIFLPQEPAEEHLLPLQYPTSTFTRTEEGSSRGRTFVFNLKHQTSPMSSILRPFKRFKLIGDKDELWFPIISQMHSGSIDAAYSNAEQHNSSGCDCSFEKKNGVQSTISSENNLHSLDIGEEGATLRGPIVLIDIELEINASRAERIMKNFAIILQSSLN

SEQ ID NO: 138794 - protein, 99 aa, Glycine max
  Coding DNA Sequence Number=SeqID_47109
  Homolog annotation: Hit_ID=A7PV29; Match level="QueryCoverage=98%, HitCoverage=8%, E-value=3e-10, Identity=34%"; Hit description =Chromosome chr4 scaffold_32, whole genome shotgun sequence
MQSTLCSEWKTWKQDVMKWFSAPPSLSSSKDTQQQSYDDLYQANLQDQTIALEADPDFFKNQDTLSTIAAQSCKHEGVREVFVTTSPSNLANKWNEIVV

SEQ ID NO: 138795 - protein, 501 aa, Glycine max
  Coding DNA Sequence Number=SeqID_47110
  Gene Ontology: Mol. function=catalytic activity; Cellular component =extracellular region; Biological process=carbohydrate metabolic process
  Homolog annotation: Hit_ID=A7NV16; Match level="QueryCoverage=100%, HitCoverage=99%, E-value=0.0, Identity=70%"; Hit description =Chromosome chr18 scaffold_1, whole genome shotgun sequence
  Pfam annotation: Domain name=Cellulase; Domain location=203-494; Score=-10.4; E_value=6.4e-06; Accession=PF00150.9; Description =Cellulase (glycosyl hydrolase family 5)
  Pfam annotation: Domain name=Fascin; Domain location=75-184; Score= -2.4; E_value=0.015; Accession=PF06268.4; Description=Fascin protein
  Pfam module annotation: Pfam domain module=Cellulase::Fascin; Domain location=203-494::75-184
MTSCVNLKIWLLNFVILFSMVSLSHGRLNAQFQVKAVNLGGWLVTEGWMKPSLFDGIPNKDFLDGTGLQFKSVMTGKYLCAESGGGTILVANCTDASGWETFRLWRINEDTFRLRVFNKQFVGLDGINVVAVSNICTYSETFHIVKESDNSSRIRIKASNGYFLQAKTQELVTADVSEVREWEDDDPTIFVMTIAARLQGEFQVTNGYGPTKAPQVMKEHWSTFIVENDFKFIASNGLNAARIPVGWWIASDPNPPWPYVGGSLHALDNAFLWAQKYGLKIIIDLHAAPGSQNGFQHGGSRDGSQEWGKTNKNILQTVRVIEFLTARYAKRPSFYAVELLNEPLSPGVTLEMLNKYYKAGYDAVRRHSPTAFVVLSNRIGPSKPKELFPLANGLMRSVIDVHYYNIFDDVFENMSAQQNIDFIYTNRSSQLNNITTSNGNGPLTFVGEWVADWRVKNATKEDFQRFAKAQLDVFGRATFGWAYWALKNANKYWNLEWMIEN

SEQ ID NO: 138796 - protein, 518 aa, Glycine max
  Coding DNA Sequence Number=SeqID_47111
  Gene Ontology: Mol. function=catalytic activity; Cellular component =extracellular region; Biological process=carbohydrate metabolic process
  Homolog annotation: Hit_ID=A7NV16; Match level="QueryCoverage=99%, HitCoverage=100%, E-value=0.0, Identity=70%"; Hit description =Chromosome chr18 scaffold_1, whole genome shotgun sequence
  Pfam annotation: Domain name=Cellulase; Domain location=226-506; Score=2.1; E_value=1.3e-06; Accession=PF00150.9; Description =Cellulase (glycosyl hydrolase family 5)
  Pfam annotation: Domain name=Fascin; Domain location=77-194; Score= -6.0; E_value=0.031; Accession=PF06268.4; Description=Fascin protein
  Pfam module annotation: Pfam domain module=Cellulase::Fascin; Domain location=226-506::77-194
  Subcellular localization annotation: CTP_CleavageSite=37; ConfidenceScore=5.20e-01
MMTSYVNLKIWLLNFVTLFSILSLSHGRRANANFRVRAVNLGGWLVTEGWMKPSLFDGIPNKDFLDGTGLQFKSVTTRKYLCAESGGGTIIVANRTSASGWETFALWRLNEDTFRFRVFNKQFVGLDGINVVAVSNISTDSLTFHVVKESDNSNRVRIKASNGYFLQAKTEDLVTADGSEVNGWGDDDPSVFVMTIGKRMQGEYQVTSGYGPTKAHQVMKLLCFLHLCTHEKEHWKTFIVEDDFKFIASNGLNAVRIPIGWWIASDPTPPPPYVGGSLNALDKAFLWAQKYGLKIILDLHAAPGSQNGFEHSSSRDGSQEWGKTDETIQQTVHVIDFLTARYAKCQSLYAVELINEPLSPGVTLEALNKYYKAGYEAVRKHSSTAYVVLSNRIGPSNPRELFPLANGLMRSVIDVHYYNLFQDVFNDMTVQQNIDFIYNNRSSQLSFVTTSNGPLTFVGEWVAEWQVNGATKEDYQRFAKAQLDVYGRATFGWAYWAFKNVNNHWSLEWMVKNGYIKL

SEQ ID NO: 138797 - protein, 441 aa, Glycine max
  Coding DNA Sequence Number=SeqID_47112
  Homolog annotation: Hit_ID=A2Q4S5; Match level="QueryCoverage=48%, HitCoverage=44%, E-value=8e-15, Identity=26%"; Hit description=IMP dehydrogenase/GMP reductase, putative
  Pfam annotation: Domain name=DUF1723; Domain location=116-165; Score =36.2; E_value=1.2e-07; Accession=PF08330.1; Description=Protein of unknown function (DUF1723)
MAIKRPMEIVPPASFIYDLSQRKIIGGALEGEDNRDLDEALQRRRPTTSAHRQREADVAAAEDVHHMDDKAEEEHPELKLTFHGRKVQKFGRSVVEIKGLVAATRLSPLSACSLDTGDQGLISTFAERWYKETSNFYLLVGEVPITLDDVASLLHFPITGAFHSFETLYVNEAVLMLVKLLEVSADEARAKIVQCHGAYVRLSWRRDIYCSKCDVAHWTVVARAYLLHLLGCILFANKSATHVHLAITVENYHERNPCAYRWTSTKALPVSMYRKRLDQLTTSDVGWMPYGDHRATIPPHSLGSRLCLEDIDDRWMHFSDYLALVGQIFLMPRQCTPYYMKWFYMISHPFMRPVQLGDPVRYPPIVQDDTYVELDMPQYLVAAAAMEEAPVNASSHAKQPRHAVDVCQAISERLERLLNLRIATESTKTYDVMQDYLRIAR

SEQ ID NO: 138798 - protein, 159 aa, Glycine max
  Coding DNA Sequence Number=SeqID_47113
  Subcellular localization annotation: CTP_CleavageSite=84; ConfidenceScore=5.67e-01
TFILLSSSFLRQILLCFSPPSSSSSSHPMPTVSCTSNVAYQNVNAHPSLTASRLQDGKILVLDSIAFFASGFAACSSFKDEGASAANVSFWSVGVSENKNDDYDCESEGPYGTRSSAALIVTSSEEVSFFEAYLDEGMWKEHVIDFHIQKLKKLTKGHT

SEQ ID NO: 138799 - protein, 91 aa, Glycine max
  Coding DNA Sequence Number=SeqID_47114
  Homolog annotation: Hit_ID=Q2HU84; Match level="QueryCoverage=100%, HitCoverage=40%, E-value=1e-27, Identity=67%"; Hit description =Probable retroelement pol polyprotein-, putative
MTDYVLHGLDDGYRAIINVVNARDTPINFDDLHERLLIQELSIGAAQRQTPAPLTALNAQARPNSNDKSRHGQNPAQSTQRTGTRKPFLGR

SEQ ID NO: 138800 - protein, 53 aa, Glycine max
  Coding DNA Sequence Number=SeqID_47115
MNEEQLMYNNIMSEEVDMNVENKEDVGVKVKHVDCSDVFNTSQFFATRDEVLH

SEQ ID NO: 138801 - protein, 268 aa, Glycine max
  Coding DNA Sequence Number=SeqID_47116
MELIENMAANDHVVFGDRTHIPTKRSLLELSSQDALLVQNKLLAKQLDSLKKTLSKLPTQLQATQPTHSAVMQVGGCSIYGWAHESGCCMAQDDAAKEVNYMANQNRQGFHIGGFSGYQQGGNFNQNQGQGWRSHPGNQFNTDRGSGVSSPSSFSIPLPFIFQEAKESIDEEDPRPTSSNGACIRRSSNLPPNQGPKLYERTTKLEGTLTQFIQVSMSNHKSTELAIKSLEIQVGQLAKQIAENSLGSFGANTEKNPKEEYKAIVTRS

SEQ ID NO: 138802 - protein, 166 aa, Glycine max
  Coding DNA Sequence Number=SeqID_47117
  Gene Ontology: Mol. function=protein binding; Cellular component =endoplasmic reticulum; Biological process=vesicle-mediated transport
  Homolog annotation: Hit_ID=A7NV05; Match level="QueryCoverage=42%, HitCoverage=18%, E-value=1e-26, Identity=82%"; Hit description =Chromosome chr18 scaffold_1, whole genome shotgun sequence
  Pfam annotation: Domain name=DUF1692; Domain location=5-110; Score= -9.4; E_value=1e-07; Accession=PF07970.3; Description=Protein of unknown function (DUF1692)
MLHQKFYLKTYQILPLVFVVFQVVPTVYTDVSGHTIQSNQFSVTEHFRTGDMGRLQSLPGVFFFYDLSPIKVTFTEENVSFLHFLTNVCAIVGGRYGSSTITFHSCIIWHEYHFICVNPDRVILDVYCIQSNLNLISQSAMCPINFIIVSATLQPRYFIKDSKFLT

SEQ ID NO: 138803 - protein, 326 aa, Glycine max
  Coding DNA Sequence Number=SeqID_47118
  Gene Ontology: Mol. function=protein binding; Cellular component =endoplasmic reticulum; Biological process=vesicle-mediated transport
  Homolog annotation: Hit_ID=A7NV05; Match level="QueryCoverage=65%, HitCoverage=47%, E-value=1e-88, Identity=77%"; Hit description =Chromosome chr18 scaffold_1, whole genome shotgun sequence
MESIISKLRNLDAYPKINEDFYSRTLSGGVITLASSILMLLLFYSELRTTPFSRRFHSFKTSNRNSLSFLPLPPGLYLHAVTETKLVVDTSRAETLRINFDVTFPALPCSILSLDAMDISGEQRLDVKHDIIKKRLDSRGNVIETRQEGIGAPKIEKPLQRHGGRLEHNETYCGSCYGSEVSDDDCCNSCEDVREAYRKKGWALSNPDLIDQDCSWVNLALDGLFTSVGDGSVHLVGTGFTKSAYWLHCRLVTMTSLEQSSPLCCSWVESLQACIFICHIHCKWVQSMMLDAALELSLCHYEVEAIHSNFMMLLFGGSKSSKTVLF

SEQ ID NO: 138804 - protein, 104 aa, Glycine max
  Coding DNA Sequence Number=SeqID_47119
MELTGEMNDKATGKNKRKKKKKREKDVEEEERKEKKNVRENEGARTLSPMNHKDEDIESYENIKQRTLSLVKHKGEDVESYENIKQRTLSPMKHKGEDLESYET

SEQ ID NO: 138805 - protein, 101 aa, Glycine max
  Coding DNA Sequence Number=SeqID_47120
  Homolog annotation: Hit_ID=Q949K7; Match level="QueryCoverage=39%, HitCoverage=45%, E-value=3e-08, Identity=67%"; Hit description =Putative gag polyprotein
MSELCLVLDVVIPPKFKVPDFDKYKGTTCPKNHLKMYDLVFASERTEAGPRKGKFNYVASANLGSGGPKRKKVGKPYVVAALPAWPNFPLAAYNPMYQYPP

SEQ ID NO: 138806 - protein, 372 aa, Glycine max
  Coding DNA Sequence Number=SeqID_47121
  Gene Ontology: Mol. function=catalytic activity; Biological process =trehalose biosynthetic process
  Homolog annotation: Hit_ID=A9PCZ6; Match level="QueryCoverage=98%, HitCoverage=98%, E-value=1e-131, Identity=66%"; Hit description =Putative uncharacterized protein
  Pfam annotation: Domain name=Trehalose_PPase; Domain location=117 -350; Score=351.8; E_value=1.1e-102; Accession=PF02358.7; Description= Trehalose-phosphatase
MTNRNVNNTLVELAMSISNTSALPRATVPGIMALLGGVLGLPQKKLLMKTLEDGSVNKGGTKVINTWIDSMRASSPTRVKSTQNQDPTSPWTLYHPSALSMFDQIVCESKGKQIVTFLDYDGTLSPIVADPDKAYMSKKMRTTLKDLARHFPTAIVSGRCLDKVYNFVRLAELYYAGSHGMDIKGPTNKRSTKKENEQVLFQPASEFLPMINEVYNILVEKTKSVPGAKVENNKFCLSVHFRCVDEKSWVSLAEQVSFVLNEYPKLKLTQGRKVLEIRPTIKWDKGKALEFLLESLGYANSDNVFPIYIGDDRTDEDAFKVLRRRGHGVGILVSKIPKETDASYTLQDPTEVGQFLRHLVEWKRTSSQYHKL

SEQ ID NO: 138807 - protein, 357 aa, Glycine max
  Coding DNA Sequence Number=SeqID_47122
  Gene Ontology: Mol. function=protein dimerization activity; Cellular component=nucleus; Biological process=regulation of transcription, DNA-dependent
  Homolog annotation: Hit_ID=A4ZGS2; Match level="QueryCoverage=65%, HitCoverage=100%, E-value=1e-124, Identity=97%"; Hit description =Transcription factor bZIP83
  Pfam annotation: Domain name=bZIP_1; Domain location=61-117; Score =27.7; E_value=4.2e-05; Accession=PF00170.12; Description=bZIP transcription factor
  Pfam annotation: Domain name=bZIP_2; Domain location=61-118; Score =16.6; E_value=0.0083; Accession=PF07716.6; Description=Basic region leucine zipper
  Pfam module annotation: Pfam domain module=bZIP_1::bZIP_2; Domain location=61-117::61-118
MGIYDPFHQVNMWGDSFKIDGSLNSIAPQMLMIKPSMQNKSECTPHESREPSGDDQETNEKADTKALRRQAQNREAARKCRLRKKAYVQQLETSRVKLMQLELEIEKARKQQGMYIRSALDVSYMGSSGTINPGITLFELEYAQWIEEQDRQNQELRNTLQTQASEMQLHLLVESCLSHYSNLFRMKAEAAKADVFYLISGAWKASVERLFLWIGGSRPSQLLNIIAPQLEPLTDQQIVSINNLRLSSQQAEDALSLGLDKLQQSLVHNIPSDPLAVGHYGFEIAAAMEKGEALERFVNQADHLRQQTLIHMSRILTTAQAAKGLLAMGEYFHRLRTLSSLWTARSCDPSFPTQLSN

SEQ ID NO: 138808 - protein, 104 aa, Glycine max
  Coding DNA Sequence Number=SeqID_47123
MSTKKSGVGMRIVDGKGVNDEEKIKPSRADERDDLAVVDLLRELKETYCSGFSDFDQVESMLDLKTDLTHRSVCPSRLLNLCVRHWGEKDLNDDLEDKNNNEEE

SEQ ID NO: 138809 - protein, 23 aa, Glycine max
  Coding DNA Sequence Number=SeqID_47124
MEAILKQLSEKRRRNRINEKMKA

SEQ ID NO: 138810 - protein, 163 aa, Glycine max
  Coding DNA Sequence Number=SeqID_47125
MVFLWTGGSTGQLGLKQSSSVVSVNQFCEDLLHIWEKGWERETQGYRKRFWGTFLRAVGHNSNTRIMIHEAAFKKMHWGSQRSSPGSTPSRLSLALCFMARERCDYFSGSPERKIAESYFSMICREGLRLQPRVDPRGGWLTKHELKVKESVSKYGAWVGNNF

SEQ ID NO: 138811 - protein, 811 aa, Glycine max
  Coding DNA Sequence Number=SeqID_47126
  Gene Ontology: Mol. function=nucleic acid binding; Cellular component= nucleus; Biological process=cell division
  Homolog annotation: Hit_ID=A7NUY9; Match level="QueryCoverage=99%, HitCoverage=99%, E-value=0.0, Identity=53%"; Hit description =Chromosome chr18 scaffold_1, whole genome shotgun sequence
  Subcellular localization annotation: CTP_CleavageSite=35; ConfidenceScore=5.51e-01
MQKKLGFPISKSLDQFKSLYGSISATPKPLSSRPSADSVSSGSFANLKLTAEKLVKEQASVKTDLENANAKLKKSQEYVHALEEKLQNALNENAKLKVKQKEDEKMWKGLESKFSSTKTLCDQLTETLQQLAGLVQDAEKDKETLEYKLSASSEALDSLNKQMDGLSLKIDSAQEAIRSRDNELEKLKFGTEEREKFHRDEQCRVANVIQEKDTMIRNLEEMLTSSRLATENLNSKLEEVHLQLKVKEDEIMHHLTSQEKLEKENNDLQLCNAGLAEKLDMSLQEIKNLEESLQSLAAHLSNLDKESLNLLTKFDEMNLLYASCFQLVQQERQTFSKHAQYQYSELNNKFVVLELEKNATQMKNHELSKTVDELQKVHESTLAQLTEGSRLAAEKIRSLESEAETLISKKKDAEVLIFKLEEKAEFLLESSRSSENQVQGLLLKVSALETESKENTERLHAEISKKSEEIDTLQNERMKLEQHADSLDKEVIQLQNALEEKEKCILHYKEQEKNLEDQITENLSLLTAAESKLSEAKKQYDQMVENKQLELSRHLKEISQRNDQAINDIKRKYELEKMEIVNKEKEKADKAIAEIEGKCGQKIEECKEEQRQQLMRIQDEHTLLEHDKRQASLIAEHNEQLKRTQLQAENELREKTMFMRNDHEAQIKALRCELEDECRKLEEELHLQKSKEDRQRALLQLQWKVMSDKPKEDQEVNSKQDYSISSIKRRSSFGGKRNQHDLDSPYIDATQTPVPKLLKKMENVKTGSAVSIPKHHRKSIKGGGHPHPLNIGDLFSEGSLNPYAEDPYAFD

SEQ ID NO: 138812 - protein, 103 aa, Glycine max
  Coding DNA Sequence Number=SeqID_47127
  Gene Ontology: Mol. function=transporter activity; Cellular component= integral to membrane; Biological process=transport
  Homolog annotation: Hit_ID=A2Q6E3; Match level="QueryCoverage=86%, HitCoverage=33%, E-value=4e-26, Identity=67%"; Hit description=Major intrinsic protein
MTSDSLSVNVDSSIKSEFSTDEGHKTIHETKHFPSNIQKAIAEVVSTYILIFAGCGAALVNEKFPLTIVGIAIVSGLALTVATYSIGYVFGPNCFGCCQKSSI

SEQ ID NO: 138813 - protein, 28 aa, Glycine max
  Coding DNA Sequence Number=SeqID_47128
MGQFHQVLDPVLDGGDSVATIAELAFRQ

SEQ ID NO: 138814 - protein, 448 aa, Glycine max
  Coding DNA Sequence Number=SeqID_47129
  Homolog annotation: Hit_ID=A7NV42; Match level="QueryCoverage=88%, HitCoverage=76%, E-value=1e-111, Identity=59%"; Hit description =Chromosome chr18 scaffold_1, whole genome shotgun sequence
MARKTSNCAICENSNQASICSICVNYRLNEYNTSLKLLKDRRDSLYSKLSEVLVRKGKGDDQANWRVLQHEKLARLKEKLRQGKEQVTQGRAKIETKSADLKLKYGLLESALSTLEKNRVEQLEKFYPNLICTQSLGHVAITSERLHKQSVVIKQICKLFPQRRGAWMVAVMAVGCMDGGGNSSRIMKSVASLIFSLSAGFEPKTRCLGNAFQTIKSFGKPACIIDLHVLGDPKLLQVVIEGERGDGCCGQFDQICNARLPRALDPRSVPSEELSTSLGVLALGYGNEILIGMHVLPQGENSWSERSSSNFGVASMESERRHRLDSSGSSSFNYSLASSHSVQTHKDLQKGISLLKKSVACITAYCYNSLCLDVPSEASTFEAFAKLLATLSSSKEDMQASSTIEQVCLEYEFCYFINYFAGKCAFCAHNGKGSLVTSNLEENAGSVN

SEQ ID NO: 138815 - protein, 299 aa, Glycine max
  Coding DNA Sequence Number=SeqID_47130
  Gene Ontology: Mol. function=phosphoprotein phosphatase activity
  Homolog annotation: Hit_ID=A2Q4S5; Match level="QueryCoverage=57%, HitCoverage=27%, E-value=6e-27, Identity=38%"; Hit description=IMP dehydrogenase/GMP reductase, putative
MVATRASLLHLLGCTLFANKSATNVHVFYLEALRDLSMTKRYAWGVAALVHMYDQLNDASMSHSRQCWIYEHFPSVVDSTAEQEYDEDSPCACRWIATKKTLKSIRTPAYRERLDRLQILDVCWIPYGDHREVRDFHVRSCYSGFLRWGPVAVYYRPERVVRQFGYTQTIPSPPIDSWVSYDDIHDRWMHYEDHIVPAGEVCVVPGQCSSDYMDWFFRISHLFITLGHALDPLPHCHALQPQVIPQAPQTDIPHVPEPGALSTSAEEPRHAVEVCDDIAERLECHLSPGVVTPGSSTHE

SEQ ID NO: 138816 - protein, 113 aa, Glycine max
  Coding DNA Sequence Number=SeqID_47131
  Gene Ontology: Mol. function=protein disulfide oxidoreductase activity; Biological process=intracellular signaling cascade
  Homolog annotation: Hit_ID=A7NV39; Match level="QueryCoverage=76%, HitCoverage=13%, E-value=3e-16, Identity=47%"; Hit description =Chromosome chr18 scaffold_1, whole genome shotgun sequence
MKKKQEEEELIRKKKKQKQKRGERERPTLPCYSPGDRHRQRIMDAAHSFLKSGGLLIDFIAKVAYANLGKNEVEVLKHVSNYLDPVDSELLLDLLATSELKVTYQSYDWGLNC

SEQ ID NO: 138817 - protein, 70 aa, Glycine max
  Coding DNA Sequence Number=SeqID_47132
MAPNSLGGGRMNENAIHGAPKKRRGWRIALEGPHYSIMKHSSKLFGWRMHERKRNSWGSEKKRGWRIALE

SEQ ID NO: 138818 - protein, 262 aa, Glycine max
  Coding DNA Sequence Number=SeqID_47133
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSNLNQQTGVGAPLRNGGDLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138819 - protein, 204 aa, Glycine max
  Coding DNA Sequence Number=SeqID_47134
MPWLAWYNPGWRNHPNLRWSSPSQQQQQQQPYFQNIAGPSRPYVPPPIQQHQQQQHQQQQPQKQQIVEAPPQPSLEELVRQMTMQNMQFQQETRASIQSLTNQMGQLATQLNQQQSQNFDRLPSQSFQNPENVSAITLRSGKQCQGPQPATSSSSANEPAQLHSTPEKDDEKNLKKAAYPSSIPSKSNFQQKNGRGREGDLGNI

SEQ ID NO: 138820 - protein, 70 aa, Glycine max
  Coding DNA Sequence Number=SeqID_47135
MRFKYTPAQIFDPEIPFGAWWRMKLKKILDIERQREISEDHIRELVSIVIIHRPYFMEQGQLWSRNEAQI

SEQ ID NO: 138821 - protein, 229 aa, Glycine max
  Coding DNA Sequence Number=SeqID_47136
MWMDRFTLTLNGSQDLRRLLAKAKAMAEVCTAPEEIHGLINYWRVGTDEGRSIGLKRSNGFHLGGHVKTPENHEDKATATASSTVREAEPVLQPALNPGLDRNTAVFGRRYSPQAYPYGLPPDFTPRATPEDLSQAPTFEGQLPPYEDYPGQDDGEGDTHLGPLLHLKDPSPHELPQPNIVRHIPASPTPVKESVPFAEDRGKIEALEERLRAVEGLDNYSILGFGQIY

SEQ ID NO: 138822 - protein, 185 aa, Glycine max
  Coding DNA Sequence Number=SeqID_47137
  Homolog annotation: Hit_ID=Q86AI8; Match level="QueryCoverage=49%, HitCoverage=13%, E-value=4e-07, Identity=31%"; Hit description =Similar to Homo sapiens (Human). Mucin 2
MSESCGFGMTGPLDESISCFLIRVDPRVLVPITFRGLHALAIRGLHVLTFRGLHALAIRGLHVLTFRGLHALAIRGPHVLTFRGLHVLTIEGCTPSPSEGYTPSPSEDCMSSPSEGYTPSPSEDCMSSPSEGYTPSSSEDCMSSPSEGYTPSPSEDCMSSPSEGYTPSPSEDHTSSPSEGYTSSP

SEQ ID NO: 138823 - protein, 44 aa, Glycine max
  Coding DNA Sequence Number=SeqID_47138
MENMMKNKLMAIEWRRKKDDWRRHLKEKMSQEQAHHHRKPWIRA

SEQ ID NO: 138824 - protein, 84 aa, Glycine max
  Coding DNA Sequence Number=SeqID_47139
MYCTPSPVHQNFGQTGESVNTTNCEWMTNLFGVDLNTPNFAASYLASLQQFNAPHSFGEQGQRKKKSATYRHPPPYGTGHRLGH

SEQ ID NO: 138825 - protein, 185 aa, Glycine max
  Coding DNA Sequence Number=SeqID_47140
MANQEEWVPFADVLALLIFGVVLFANVDGLVDLAAIDAFLAYHHSKESPVVAILADLFDTFDQRVPHEGSTEEESLSPFLVRDFGAQSFKIVQRVHKAWESPLRKDKELRGIRNGIIDGYHEWLRVHTQGLDWLSKLKIINEENFEAPEEDEEVQSLKSKLGKARLTKEKFKLVATDIRKECAEL

SEQ ID NO: 138826 - protein, 178 aa, Glycine max
  Coding DNA Sequence Number=SeqID_47141
DVVRVCVETIYDGDASVPFPTAEIQYVRDTSSTFIAWPKHLVKPIADDSNHNVHLPLRRLGEAEVAAEADPLGELMKTLFCVYKNPVEVSWEATQFGLPNVGAKFFITHADLAEIISGDKCLNISILQLWTIFVVEAKLISHCMVCSSLNLYTMLRTDVNNANNTFNHGSRNHKGSCT

SEQ ID NO: 138827 - protein, 64 aa, Glycine max
  Coding DNA Sequence Number=SeqID_47142
MPLFILDVMENSSLTATDLWRANHRRLQLLIFTKWDTSEGKTVKHITNETKRGSAQKETTPELL

SEQ ID NO: 138828 - protein, 157 aa, Glycine max
  Coding DNA Sequence Number=SeqID_47143
  Gene Ontology: Biological process=transposition, DNA-mediated
  Homolog annotation: Hit_ID=Q1J7G7; Match level="QueryCoverage=26%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIHMLSNSIVSA

SEQ ID NO: 138829 - protein, 110 aa, Glycine max
  Coding DNA Sequence Number=SeqID_47144
MGTTTGTYNELKNSVWGTYRLKTEENEERTMNVKERNVTEAPRLGFSSQKQFSSAISREYEVPRRLNLSFFIPPPIYSKIGEELATQLAQASQVASSKSNLLLEEESRRP

SEQ ID NO: 138830 - protein, 255 aa, Glycine max
  Coding DNA Sequence Number=SeqID_47145
  Homolog annotation: Hit_ID=Q2HW90; Match level="QueryCoverage=83%, HitCoverage=41%, E-value=7e-23, Identity=34%"; Hit description =Putative uncharacterized protein
MVNQEEWVPFMDVLALLIFGVVLFPNVDVLVDLAAIDAFLAYHHSKESPVVAILADLFDTFERRCEKSSARIICCLPALCVWLVSHLFQQDIRHPCPLRSHRSCVEKRRVDWDQHLVGIGGRTISWFPRWKEGKEGVLFSCGDYPNVLLIGTRGCINYNLALAIRQLGYPMRPAEESLSPFFVRDFSAQSFKIIQRVHKAWESPLRKDKELRGIRNGIIGGYHEWLKVRTRGLDWLSKLIIINEENFEAPEEDEE

SEQ ID NO: 138831 - protein, 69 aa, Glycine max
  Coding DNA Sequence Number=SeqID_47146
MDVKSAFLNGLIQERDRSKKRELKSTCSRITSSRNSRRYIQEIIDIQDISRNYQKIWRCAKHMSITDRD

SEQ ID NO: 138832 - protein, 89 aa, Glycine max
  Coding DNA Sequence Number=SeqID_47147
MVGYTPSSFADLVFAGEMIKVGLKRGKFNHHAWTNEKTGANEEGENEGETHVATAVPTWKLPHQLNNIITQPISTLLITHHPVIHKGHP

SEQ ID NO: 138833 - protein, 132 aa, Glycine max
  Coding DNA Sequence Number=SeqID_47148
  Homolog annotation: Hit_ID=Q2HW90; Match level="QueryCoverage=56%, HitCoverage=14%, E-value=4e-09, Identity=44%"; Hit description =Putative uncharacterized protein
MANQEEWVLFMDVLALLIFGVVLFPNMDGLVDLAAIDAFLAYHHSKESTVVAILADLFDTFDRRCEKSSARIICCLPTLCVWLVSHLFQQDIRHPCPLRSHRSCVEKRRVDWDQHLARIRGRTINWFPRWKE

SEQ ID NO: 138834 - protein, 104 aa, Glycine max
  Coding DNA Sequence Number=SeqID_47149
MGAKHLTRTKEWSHVIEQRSPDEIRQKNVYTDNHSGIFRVSSGPPPLDDTRVQNVQTLVLCLSSGPSLLDDKKGANNHKVFSAYLGCRMTKLGFLLVFGPAASG

SEQ ID NO: 138835 - protein, 49 aa, Glycine max
  Coding DNA Sequence Number=SeqID_47150
MRKMQGLCMSEHNMRTIKIEWTISDNASRKEEMRLHCYQASRRPSMITD

SEQ ID NO: 138836 - protein, 127 aa, Glycine max
  Coding DNA Sequence Number=SeqID_47151
MSHMDPRARSGPLDASPEIEIRSWWTLGDSVGRRGYVGKLPLLGTVCRGSGGIIGNSFPILRGGTVMSPEWVWARTATGMPMWLTLGVTRTNMGMSPGKLEEGMHRQDFGQIGHGPIMLASVSQVLG

SEQ ID NO: 138837 - protein, 120 aa, Glycine max
  Coding DNA Sequence Number=SeqID_47152
  Homolog annotation: Hit_ID=A5AQZ7; Match level="QueryCoverage=32%, HitCoverage=4%, E-value=2e-07, Identity=56%"; Hit description =Putative uncharacterized protein
VSSAKAYGHYAYECPNKRSRNGYLDGQLKHEEESEKTMLSRLDGGLSEESSGSGSSSWKDKGERWGCYFCECSSWSPIKTRLLGRPWQFDKRANHDGYTNKISFMHQDKKIVLKPLSPQE

SEQ ID NO: 138838 - protein, 118 aa, Glycine max
  Coding DNA Sequence Number=SeqID_47153
MRFCSKQFVLQAKFDISEALDAKKKIWEEFAATRKTPSWQGIRKKMQEIQKNNDCPYLLSRGGYELLEKKLLDEKMKKRQHDTLMTENPALIEDPPISHSKTCQVEDGPHESIWEDDI

SEQ ID NO: 138839 - protein, 294 aa, Glycine max
  Coding DNA Sequence Number=SeqID_47154
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSISLIFGDNLGTGCGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 138840 - protein, 199 aa, Glycine max
  Coding DNA Sequence Number=SeqID_47155
MDDFAAQQHLPTIIIPTSPAKVSAGMAPTRHPLDPDKSNRALGFPALITGLCQSFGVPVAPTKVIQSPITRAFIEKYCTQRQAQGDAPQAADAPPPYQAGQAGSFDTERYLRHLVREQAANHRAHVQTHDCLYQLSLSMQSQGFASFSCPTPDQFRAEVAWPEAQAGEAPPEAPGDGEEAHEDEEMADLLDFLGGSGAT

SEQ ID NO: 138841 - protein, 166 aa, Glycine max
  Coding DNA Sequence Number=SeqID_47156
  Gene Ontology: Mol. function=spermidine synthase activity; Cellular component=cytosol; Biological process=spermidine biosynthetic process
  Homolog annotation: Hit_ID=A7HMP0; Match level="QueryCoverage=100%, HitCoverage=56%, E-value=2e-95, Identity=100%"; Hit description =Spermidine synthase
  Pfam annotation: Domain name=Spermine_synth; Domain location=1-132; Score=-58.2; E_value=6.1e-05; Accession=PF01564.8; Description =Sperminespermidine synthase
MEYLPYTASKLTDPRVELVYEDGAKFVRQFKNEFDVIIIDSTDPTAGEGGHLFTLDFYKACNEALKEDGILCAQTEGMTYDYEWGSTAYKRIKANFPLVKMYLGFMPTYPGGIWSYTYASKAGIDPVKDFNPDKVKNFREPLRYYNEEIHIAAFALPNFVKKYIEE

SEQ ID NO: 138842 - protein, 76 aa, Glycine max
  Coding DNA Sequence Number=SeqID_47157
  Subcellular localization annotation: CTP_CleavageSite=58; ConfidenceScore=5.18e-01
MHLRDQGSLPYNIEKNKMKDCKNTSGEDVSFTSRMSQSLKNSSQVLKPAPGSSSSLCRSSHNKISQNSMELGPFPL

SEQ ID NO: 138843 - protein, 105 aa, Glycine max
  Coding DNA Sequence Number=SeqID_47158
MKNRRRTVETFAKFFTENVTEMFRKRLGSDFLHGNNFSKQIRKRENKIGEMLAAQLAQASQVASSRSNSLLEESSGGPKWAWLLFAPPFLLSTPPSAFFLMILFS

SEQ ID NO: 138844 - protein, 33 aa, Glycine max
  Coding DNA Sequence Number=SeqID_47159
MDELKDLIKQVVPHGIPPYGIHETQTVLIESNY

SEQ ID NO: 138845 - protein, 121 aa, Glycine max
  Coding DNA Sequence Number=SeqID_47160
MGITVRNLTSWVRMTETVCTDNRLGISIRHLTSWFRMTESAKDDVYPPATLLHGLGLKEIFCTDNHLCISGRHLTSRVRMTETVCTDNRLGISVCHMTSRVRMIETVCTDNYLGISIRHLT

SEQ ID NO: 138846 - protein, 77 aa, Glycine max
  Coding DNA Sequence Number=SeqID_47161
HPLDPDKSNRALGFPALITGLCQSFGVPVAPTKVIRPPITRAFIEKYCTQRQAQGDAPQAAGAPPPPHQAGQAKFIH

SEQ ID NO: 138847 - protein, 65 aa, Glycine max
  Coding DNA Sequence Number=SeqID_47162
MSPTVPVPGGSSDLEQQGAVAKLIAKEGKSATLKLPFWGGPFDIQKLLGNSRTSGKCWSKPEKFR

SEQ ID NO: 138848 - protein, 65 aa, Glycine max
  Coding DNA Sequence Number=SeqID_47163
MNGSGMEKEERERRRLFKKNMSLEEAHHHHHRRPWITAWRKKEMNEGRGREEHEILFSKRALKWL

SEQ ID NO: 138849 - protein, 206 aa, Glycine max
  Coding DNA Sequence Number=SeqID_47164
  Homolog annotation: Hit_ID=UPI00006A2D9E; Match level="QueryCoverage =72%, HitCoverage=86%, E-value=4e-10, Identity=20%"; Hit description =UPI00006A2D9E related cluster
VHPWVLVPSPSEDYTSLPSEDYTFSPSEDNTSSPTEDYTFSPSEGCTPSPSEGYASSPSEGYMHALRGLHVLTFRGLHALAFRGLHGLTFRGLHILTFRGLHVLAIRGLHVLTFRGLHALTFRGLHAFTFRGLHVLAFRGLHTLSFSGMHALTFRGLDALAFKGSVPGPPPDPGGGSTVRAQLEEEAIVQPLCILGQDFTRAITKR

SEQ ID NO: 138850 - protein, 34 aa, Glycine max
  Coding DNA Sequence Number=SeqID_47165
MADSKPISTPLSEKEKLFVVIKVQTQADQDYMSK

SEQ ID NO: 138851 - protein, 50 aa, Glycine max
  Coding DNA Sequence Number=SeqID_47166
KNQDSRFKVSRIKIQGSRSQESRFKVQDLKNQDQDSRLKIQESREGSIKI

SEQ ID NO: 138852 - protein, 104 aa, Glycine max
  Coding DNA Sequence Number=SeqID_47167
MASIKFGAVAGEQCPKCMTRGNPSDLQPFDPEIDRTFHRLVRHHFIPFDHLEHSITGEFVHSVIGDFEHPDFEHYNFEHSDFEHSENMAQPPPRERTLREMGCP

SEQ ID NO: 138853 - protein, 157 aa, Glycine max
  Coding DNA Sequence Number=SeqID_47168
  Gene Ontology: Mol. function=hydrolase activity
  Homolog annotation: Hit_ID=UPI00005F8B1D; Match level="QueryCoverage =89%, HitCoverage=64%, E-value=2e-35, Identity=56%"; Hit description =COG0412: Dienelactone hydrolase and related enzymes
  Pfam annotation: Domain name=DLH; Domain location=18-157; Score= -50.3; E_value=0.00084; Accession=PF01738.9; Description=Dienelactone hydrolase family
MSLTEEFIHYHAEGKIFTGVLVRDSRNAPLPGVLLAPNMMGVASSSIEHARTIAKKGYVVLVADLYGCLPDSAEDAANRMNSLKDSPAERLILNAALARLAQLQCVNEDKLAAVGFCYGGHCVLELARSGAPLAVTACFHGTLDTRTPAEKGDIRGK

SEQ ID NO: 138854 - protein, 169 aa, Glycine max
  Coding DNA Sequence Number=SeqID_47169
HQQRFEAIKGWSFHRERRVQLREDNYPDFQGDISRRHWARLVTPLAKFNPEIVIEFYANAWPTEEGVRDMRSRVRGHWVQFDANADGFDEKAIAQLLCISGQDFARTAAGRQVRIMRTSMTTLTQIWMTLLHSNVLPSDHNFDLPLPKCQLVYAILTQMSIHMAQVIAD

SEQ ID NO: 138855 - protein, 216 aa, Glycine max
  Coding DNA Sequence Number=SeqID_47170
MGEVEEVQEQMKANMEAMKKQMATMMKAMMSTKKIMEANAVAVAATSTVAKVNPTPRSGLNQMNHPTLDMVGKDLGSMGGPHYVQIQNKHAFLPYGLPPNYTPPNVACTPSENVNNSTPILFESQQPQSDHAHVSQPMGKTHEIPHHNLADFEPCLRYATEGHPCKTLWRGLNFSPNHNPSMEKWWVTHLQALRIWSSPERGSKCVWKEVYLIILL

SEQ ID NO: 138856 - protein, 165 aa, Glycine max
  Coding DNA Sequence Number=SeqID_47171
MARAGDNGGVYHQLDESQRLFLDAWTTQMQRLLNRNKEEPYRRIAKSSSFTLKPLSLREVPTYKSNPQETQRKDAHAKVEYVKRLYDQVKVQIAKKNESYVKQAHKKRKEVVLEHGDDPEHLRTNVFQEGGNDENHETSQIQAKGPSGEGRRPKWRRTKPPSGEG

SEQ ID NO: 138857 - protein, 125 aa, Glycine max
  Coding DNA Sequence Number=SeqID_47172
MQTLSAPAKHACAPKPQCLSVEAELSASIWLIGKERHHLHPPKLDLTDQDSLPKRLGKDTDIIVPRKLLPERNMAVYYIEFDEFKEELERSHWDEELTDFGDGNIDVAIVKEFYANLYDPEDKSP

SEQ ID NO: 138858 - protein, 163 aa, Glycine max
  Coding DNA Sequence Number=SeqID_47173
MVSRGEDERDECLFHLGESHDMETCPTVEELLQRLMDWGQLEVSKGGREEPQICMQSEEKKGLAPRPFAYQSNKAVPWKYTPPAFGERVATEVDSLSAKVTNIIGLSGVTRSGRVFAPLHSAEFPSKGKAPMVQEPTDIATPQKKWILQWQKGLKRKRVFKER

SEQ ID NO: 138859 - protein, 109 aa, Glycine max
  Coding DNA Sequence Number=SeqID_47174
MEQLLHIGAACTESNPQWRVDMNQEALQILIMVNNHRGDMEETTSEAGIISNMAAPRLGAVDLRLWCPRLDYSLSQQIKILYGVDEIEAEFGIGTGTGGEHCFLGRKNN

SEQ ID NO: 138860 - protein, 65 aa, Glycine max
  Coding DNA Sequence Number=SeqID_47175
MANITASAMGTNRKRDTPSRKNMGTNTMQIHNKDTKAGVTICAAPSKIACSTGLPCSKCQLMFSM

SEQ ID NO: 138861 - protein, 68 aa, Glycine max
  Coding DNA Sequence Number=SeqID_47176
MILHEIRRPNSLKTVPTGVANCRNLPFGGRATQGSRVRLPWKENAWSRHQRLFEENVGKTGKGVVYEL

SEQ ID NO: 138862 - protein, 87 aa, Glycine max
  Coding DNA Sequence Number=SeqID_47177
  Subcellular localization annotation: CTP_CleavageSite=41; ConfidenceScore=5.06e-01
MCILTYVMTAQTNRMLLNSNVIHIHVKVVMLVRMIQTRLFAATRVKSCPGMHSRRVIASLSGCARTVGHPPISGGDPGTDKRKLLAP

SEQ ID NO: 138863 - protein, 89 aa, Glycine max
  Coding DNA Sequence Number=SeqID_47178
MDSGRFQVSVPGNSYPEGLFPPQNEMVVVAGETEGPPKCFQRVYHQLLPLQWHIRVKARSQLDCGGEFHVSPPWFERYVPDQIEVIGSQ

SEQ ID NO: 138864 - protein, 94 aa, Glycine max
  Coding DNA Sequence Number=SeqID_47179
MFGVFNEDFPLYIKYEDLSEIAHGGQCLSISVIQLWILHMNETSIQAGNADVYGFLKPQSIQRSGQLKFESESYIKNWMQNSKQEVYLGAYLNS

SEQ ID NO: 138865 - protein, 123 aa, Glycine max
  Coding DNA Sequence Number=SeqID_47180
MGEVEEVQEQMKADTEALKEKMATMMGAMMSIKEIMEVSAAYRTRARARVMGEVEEVQEQMKADMEAMKEKMTAMVEAMMSMKKIMEANMVAVAATSAVAKVNPMPPSDLNQMNHPTSDMGIL

SEQ ID NO: 138866 - protein, 106 aa, Glycine max
  Coding DNA Sequence Number=SeqID_47181
MVTWSGINLVYIIWRVMSFLGSHIEDLKNTYRDMHTETKRFGLHFDAPCSFEEQGQSSSATITHNEYTDTEQQHHHHEGGPVTQERRNLRCNRCPPSCGTGHHLGH

SEQ ID NO: 138867 - protein, 52 aa, Glycine max
  Coding DNA Sequence Number=SeqID_47182
MQVKVLLLWTLQACGRQRRRGEGRHHPLGNKPRKKEPHHQELPWIRSLKMML

SEQ ID NO: 138868 - protein, 144 aa, Glycine max
  Coding DNA Sequence Number=SeqID_47183
MTPVNRKAGTGERTREPPGGNAGNLRPVRKPFPLAAVERPSCSETDRIRCSPGATLVLAPATAVKPIHAPHHLNGEWAACSGNAIKRGGCGELAHVWHPRLYTCPLMSGCSACVPNCDADNQFPSVAEQEGQLIETMIRHWSSK

SEQ ID NO: 138869 - protein, 305 aa, Glycine max
  Coding DNA Sequence Number=SeqID_47184
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDEQTRGLGVNSCKLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 138870 - protein, 99 aa, Glycine max
  Coding DNA Sequence Number=SeqID_47185
MERSMIDVASGGALGDITLAEARNLIEKMASNSQQFSARNDAIVLRGVHETSPPQQQQHIPPFQNVAGPSKPYVPPPMQQQQQQSQQDNKQLRPLLNLP

SEQ ID NO: 138871 - protein, 43 aa, Glycine max
  Coding DNA Sequence Number=SeqID_47186
MGSKIYPKVHENPRAFFSSSSPSLLESSIQYLRGELMKHWTWI

SEQ ID NO: 138872 - protein, 162 aa, Glycine max
  Coding DNA Sequence Number=SeqID_47187
  Homolog annotation: Hit_ID=Q9LHC7; Match level="QueryCoverage=53%, HitCoverage=11%, E-value=8e-09, Identity=37%"; Hit description =Retroelement pol polyprotein-like
IGEKGNRPPRMTLGDYAYQQGPKHYNNIVIPPFNNKVVELKPTLLSLIGSHPFVGMDHEDPYTHLSTFMELCNTMGAFDKDVEAVYLRVFPFSLIDSSMQNQSSLIFPKGMMNLAVKHTKGSSLCCGGTMTSKSLEEAIVIIDSIAASDYQSHHDRAQILRK

SEQ ID NO: 138873 - protein, 63 aa, Glycine max
  Coding DNA Sequence Number=SeqID_47188
MVKVGTSYVPINVSFSPKVGPGLPAVPPVQLLTGWCVTAKAPPDISAGKCSGHAARNHHTRRA

SEQ ID NO: 138874 - protein, 73 aa, Glycine max
  Coding DNA Sequence Number=SeqID_47189
MSSREFSAYALFCLAVIACALGRIDGDPVLRETRIWATWEYVSSDGGGQQGMVGLCALCGCGKLVVHHRPTAT

SEQ ID NO: 138875 - protein, 200 aa, Glycine max
  Coding DNA Sequence Number=SeqID_47190
MTLLLSNILPSDRNANLPLQKYQLVCVVPTWGSHPQRHPVDLKKSNRDLGFPSLVTGLCRPYRAPVPPSKFMSSWHRDCARKTPSGPEEGQQGLGVASSKYGSLKVIRPPYQSSFHQEVLRPQAGAGRNTTSALGWPVVGNRRTAITSRVHLCSSTKRFEYCLHHMADCRNLPFGGRATRDSRDACSTKGIRAESPPTFI

SEQ ID NO: 138876 - protein, 68 aa, Glycine max
  Coding DNA Sequence Number=SeqID_47191
MKREKHASYSSHNSCKSLSEELRDYYEGRHSDQGVPMNPKRIKVIPKWPTPPSVQGRSPEYEEPQDLR

SEQ ID NO: 138877 - protein, 56 aa, Glycine max
  Coding DNA Sequence Number=SeqID_47192
MDKSLKVGEDEWRERERGGHEFYASNESMCPKIQGLKNPTLLGHPPYMLDKWPQIS

SEQ ID NO: 138878 - protein, 177 aa, Glycine max
  Coding DNA Sequence Number=SeqID_47193
  Homolog annotation: Hit_ID=Q6WAY4; Match level="QueryCoverage=87%, HitCoverage=28%, E-value=6e-17, Identity=35%"; Hit description =Putative uncharacterized protein
MGTNQNGKRFYQVKIKGLDVTSHKELGRLMGPLQWQAFRKVYGKILDLTTAEVFTEAVVSLAQYYDQPLRCFTFRDFQIVPTVEEFEEILGCPLGRRKPYLFSGFPPSLSKIAAVVGDSARELDRMKQTRNGVVGLPRKYLEGKAWDMANQEEWVPCADILALLIFGVVLFPSVDSL

SEQ ID NO: 138879 - protein, 50 aa, Glycine max
  Coding DNA Sequence Number=SeqID_47194
MKKIQGLQAPHGATSCGNWKGGLVPSLEEFESRSKGPTPLRAIGLRSPPN

SEQ ID NO: 138880 - protein, 55 aa, Glycine max
  Coding DNA Sequence Number=SeqID_47195
MTEARQKGVRKENRGGACHPARPGDPSCFLQKQLPSGGTIWKAQLSECYGNSRIA

SEQ ID NO: 138881 - protein, 70 aa, Glycine max
  Coding DNA Sequence Number=SeqID_47196
  Homolog annotation: Hit_ID=Q45NN4; Match level="QueryCoverage=50%, HitCoverage=18%, E-value=2e-07, Identity=74%"; Hit description =Putative NBS-LRR type disease resistance protein
MSNNIVRKCEGLALAIVSIGGLLSTKSKTVFEWQKAEMQHLKDKLAISEITAKAESKLKVTYLSSFHVSM

SEQ ID NO: 138882 - protein, 122 aa, Glycine max
  Coding DNA Sequence Number=SeqID_47197
  Homolog annotation: Hit_ID=A2Q1D6; Match level="QueryCoverage=65%, HitCoverage=12%, E-value=3e-09, Identity=42%"; Hit description =Ovarian tumour, otubain, related
MDEDQWRYDNIMSKEVDMDYENEQECGVNEPHVDCSDAFTTSQIGSRERSSFVLIGCERSGQYRCRKKEFVRRDTGSRKCGCPFKLRGKPMIGGQGWMVKLMCGIHNHELAKSLLDIHTLGD

SEQ ID NO: 138883 - protein, 47 aa, Glycine max
  Coding DNA Sequence Number=SeqID_47198
MAFASGDATPPSPKTARLMAEMIKLGDQMRKMSYDNEENDGENEKGE

SEQ ID NO: 138884 - protein, 66 aa, Glycine max
  Coding DNA Sequence Number=SeqID_47199
  Homolog annotation: Hit_ID=A5BQ91; Match level="QueryCoverage=68%, HitCoverage=6%, E-value=4e-08, Identity=55%"; Hit description =Putative uncharacterized protein
MWIWHGEVKDMQSGSQAKSFDARYGWSDKSFTSLLEVVHNLLLEDNTLPKNYYKAKKILCSIGMEY

SEQ ID NO: 138885 - protein, 51 aa, Glycine max
  Coding DNA Sequence Number=SeqID_47200
MVFHLRLVMSFKTEKRKHRLKGLSKGLIQGSINKNQAKANVQAINGAKHTK

SEQ ID NO: 138886 - protein, 171 aa, Glycine max
  Coding DNA Sequence Number=SeqID_47201
MIVAVRPERVVRQFGYIQSIPPPPVSARLSQEQIDDRWMEFADHLLPAGQPCLVPGQVSADYIEWFFRISHPFMTPTQAADQQRDAPAADPEDYIQPPSPQVPVAFDPPPYVDDYEGYEAIAQRLERVLNLRIVTAGTELYDIMQDCLTIARGGPSADGTVRARQRRRTDH

SEQ ID NO: 138887 - protein, 113 aa, Glycine max
  Coding DNA Sequence Number=SeqID_47202
  Homolog annotation: Hit_ID=A7UQU7; Match level="QueryCoverage=94%, HitCoverage=17%, E-value=6e-16, Identity=37%"; Hit description=IMP dehydrogenase/GMP reductase, putative
MGQSRGYAWGAAALVHMYDQLDEASKTTTQQIGGYLTLLQYWIYEHFPSVHQCVTDDAYEEMSPCASRWLTMKAHMKGITGASYRARCDALTVTDVCWLPYSDHRGVRGFELI

SEQ ID NO: 138888 - protein, 220 aa, Glycine max
  Coding DNA Sequence Number=SeqID_47203
MAPRKLASKRSRKDKTAEGTSSAPEYDSHRFRSAEHQQRFEAIKGWSFLQERRVQLRDDEYTDFQEEIVRRRWASLVTPMAKFDPYIVLEFYANAWPTEEGVRDMRSWVKGQWIPFDADAIGQLLGYPLVLEEGQECEYGQRRNRSDGFDEEAIAQLLCIPGQDFARTAAGRRVRIMCTNMTTLTQIWMTLLLSSIQPSDHNSDLPLPKYQLGVRHPEHG

SEQ ID NO: 138889 - protein, 122 aa, Glycine max
  Coding DNA Sequence Number=SeqID_47204
MTRGNSSDLQPFDPEIDRTFHRLVRHHFVPFNHPEHSITSEYVHYVIGDFEHPDFELYNFEHSDFEHSENMAQPPPRERTLREMAAPNFTYESLCIQYPDEDVICVLKTGLLHLLPKFHGLA

SEQ ID NO: 138890 - protein, 67 aa, Glycine max
  Coding DNA Sequence Number=SeqID_47205
  Subcellular localization annotation: CTP_CleavageSite=34; ConfidenceScore=5.63e-01
MSPLSHASNQLAWFTGSTENSHLLKRSIVRFRRRARKVSFFFRFGLFTDLKLSTCFLIDSRGGGVLE

SEQ ID NO: 138891 - protein, 71 aa, Glycine max
  Coding DNA Sequence Number=SeqID_47206
  Subcellular localization annotation: CTP_CleavageSite=63; ConfidenceScore=5.10e-01
MASLIIRDSALKFMQTTNIKHQQTTNTKHSTKQPENARKNIADSQLTGRKVRPALIPLNVTTRVVATVSTL

SEQ ID NO: 138892 - protein, 127 aa, Glycine max
  Coding DNA Sequence Number=SeqID_47207
MSGFTRNSPQISASPHQLDLAPYASEPYNAQWNAPGLLHDKHTLRSSRILGEMEVDEPWLGLWLPLNYQVDMGASGVRHWSAVEDFVVDLGMAFVDKWAAGTAVIAWVSPSSSPSSFAPVFSFVQAG

SEQ ID NO: 138893 - protein, 80 aa, Glycine max
  Coding DNA Sequence Number=SeqID_47208
MVSVTFSVKNFAKGFYRFFDVLHSFFIVLRSSTGALYPGSWEHKEWRRICDHASMFFEEDNTSRNRQERYDYLGGLSLNA

SEQ ID NO: 138894 - protein, 120 aa, Glycine max
  Coding DNA Sequence Number=SeqID_47209
  Homolog annotation: Hit_ID=Q6WAY6; Match level="QueryCoverage=100%, HitCoverage=24%, E-value=2e-12, Identity=36%"; Hit description =Putative uncharacterized protein
MEGLEDLAAIDAFLAFHHGKGSPVVAILAMHDTFDQRCEKSGAKIVCCTPALYVWLVSHLFLQEGRPVYPLQGHRSILSSCEGCPNVPLMGTRGCINYNPVLAIRQLGYPMRGVPSDESI

SEQ ID NO: 138895 - protein, 290 aa, Glycine max
  Coding DNA Sequence Number=SeqID_47210
  Homolog annotation: Hit_ID=A5AHQ6; Match level="QueryCoverage=95%, HitCoverage=30%, E-value=5e-10, Identity=22%"; Hit description =Putative uncharacterized protein
MSLKLPYYPELVRVFYSNLKIQDGTLISEVHGIPMIIDKSIFFSLTQLPSQGAPFEGTLVDDWKFDYSSHDARRMVCIDQVDMTGRLLVGSLTFDCRIMHYIIVRILMTRSSNLAQASEEDLILMWAFLTGRPIDWAHLIRYRMHKKLQSSAPLPYPQLVTLFLRHFEIPLNSKPFVQVKRSFAIGADVVTSFGYRKDMDWQWLKKDAQPPQDKHIPSPSPQRDDSSALMHEVLSELRGLRTYVGECFETVDGRINAIDARFEGLDTRITQLEEDVSYLCRCFDLPSPPS

SEQ ID NO: 138896 - protein, 150 aa, Glycine max
  Coding DNA Sequence Number=SeqID_47211
  Homolog annotation: Hit_ID=A5C8K0; Match level="QueryCoverage=89%, HitCoverage=7%, E-value=2e-11, Identity=29%"; Hit description =Putative uncharacterized protein
  Pfam annotation: Domain name=zf-CCHC; Domain location=80-97; Score =27.1; E_value=6.4e-05; Accession=PF00098.14; Description=Zinc knuckle
MELMRLNQYKENDKKKKGITLKASSSIQEGSDKEDLNEIEEDGDFSFFVKRFNKFLRNKGNQRRSNFKPKKRGEDSSSLPKCYECNQPGHLRIDCQSFKKRIERSEKKTFNDKKAKKAYITWEDNNMDSSEDSKNEVVNMSLMVKNYEKR

SEQ ID NO: 138897 - protein, 151 aa, Glycine max
  Coding DNA Sequence Number=SeqID_47212
MGIAPTKTPSEPEEVQQGPGVSSSGYGPLSVLRGARTPAARSRHHSSTEYLSPPARASGPLLIELSSRSTAPQTGAGRNTTAALGWSAAGNRRTAITSRVHLYSSTKRFEYCLHNMADQQATKSKAKGKQSTRSVTYKPSCVQLKTLKKRY

SEQ ID NO: 138898 - protein, 178 aa, Glycine max
  Coding DNA Sequence Number=SeqID_47213
MASRKRKSIGTRPIAQYDTRRFHSFEAWTRYTDNVLGRHILPKRKVEIYHTELGEFKAELERRNFHKRLTNLVDNIIDLALVKEFYANLYSSEGPSPKQVRVRGHLVRIDADNLNTFLETPVVLAEGETLPAYSRYYRRPPWEDSQERFNNSCSGVDCSLILQPGSYFPHLRPDSRSS

SEQ ID NO: 138899 - protein, 41 aa, Glycine max
  Coding DNA Sequence Number=SeqID_47214
DESSETSTPEPLIRRKRVVETQEVAATPEPPAPVADTTSPQ

SEQ ID NO: 138900 - protein, 175 aa, Glycine max
  Coding DNA Sequence Number=SeqID_47215
  Homolog annotation: Hit_ID=Q6UUU1; Match level="QueryCoverage=34%, HitCoverage=40%, E-value=1e-18, Identity=78%"; Hit description =Putative uncharacterized protein
MDQAGEERKLQLSELDEIRLEAYENAKFYQAYRYRRPRGGARYQLLFPLVRVNFELGVIMLTHINCVALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGDT

SEQ ID NO: 138901 - protein, 83 aa, Glycine max
  Coding DNA Sequence Number=SeqID_47216
PLGPFGIFLQKAVASGGSNPARLGELGGNHLPYFAINRGGRQEGRAEVLPKRFRNVFREEFRKDFNRSSTFFIRSSSFFDLQR

SEQ ID NO: 138902 - protein, 17 aa, Glycine max
  Coding DNA Sequence Number=SeqID_47217
RIPEHKGMVVPYVVQTL

SEQ ID NO: 138903 - protein, 539 aa, Glycine max
  Coding DNA Sequence Number=SeqID_47218
  Homolog annotation: Hit_ID=Q57T06; Match level="QueryCoverage=17%, HitCoverage=72%, E-value=1e-42, Identity=84%"; Hit description =Putative uncharacterized protein
MARSPGFGFYFTPLAGVLFAFPSRYWFTIGQSGVFSLGGWSPHIQTGCHVSRPTHRTHDLCILVYGAITLCCATFQTLPLTHKPIQVLGSSPFARRYWGNLGYSSFQYIYGGMNFSRHVSIFSLFQIVKEQYLKHDSKGIRTPVTAVKGRCPRPLDEGDTTPYFYDAFARYFFIRQSVIQPQVPLRLPCYDFTPVMNHKVVSALPKVKLPTSFATHSHGVTGDSNPDYDVLYEGHDDLTSSPPSSSLSLAVSFEFPAEPLATKDKGTKASLLSSLDVKSGRFNALAPEATPQGHNLQIDIVYSVDYQVFVQGAAFATGIPPDLYAFHRYTWNSTPLYETLACQFQMQFPVIPINACTLRITAAAGTELAGASSASNESGPCLSSSVAGHPLRPARDRRLGEPLPHLLANPIWAHLMARGPKVPLFGLATLCGSFPDITHPSAARHPGASSPVLPLDLHRLGIHFSSCDVKNPCHFECPHRLSDKLLESSCNAAFAHRCEVAYITLSSFRVNPLFQDFFSSTDRAVCEVIHIRRVDGGAL

SEQ ID NO: 138904 - protein, 425 aa, Glycine max
  Coding DNA Sequence Number=SeqID_47219
  Gene Ontology: Mol. function=hydrolase activity, acting on glycosyl bonds; Biological process=cell wall catabolic process
  Homolog annotation: Hit_ID=A8GA74; Match level="QueryCoverage=52%, HitCoverage=47%, E-value=1e-115, Identity=93%"; Hit description =Lytic transglycosylase catalytic
  Pfam annotation: Domain name=LysM; Domain location=133-176; Score =62.3; E_value=1.6e-15; Accession=PF01476.11; Description=LysM domain
  Pfam annotation: Domain name=LysM; Domain location=187-231; Score =36.3; E_value=1.1e-07; Accession=PF01476.11; Description=LysM domain
  Pfam module annotation: Pfam domain module=LysM::LysM; Domain location=133-176::187-231
GKPTNFWALSLPRETSIYVPKMLALSDIIKNSKKYGVKLPKTDETRALARIDVGQQIQLTQAAEMAGLSVTKMKAYNPGYKKGVTAPNGPHYIMVPKGHAEQLKDSLADGQIAVTQPTTQLAKNSGLTGGSSYKVRSGDTLSGIAKRLNVKTSDLQSWNNLRAKSAIKVGQTLQVASNTGGNSSITYQVRKGDSLASIARRHGVDINDVMRWNSTLGKGNSLQPDGRIFFRVELHQQRIVIRRAGHQYRRLYDPKIAIKHKVQRAAKSLTAVIVGEAHFAQRHLTGKVIQGIDTFAAPGVEVPGHDHRPPVAGDLLADRPQLLAVDVDSQTKVHRMDVHHHQQLAVIQRINGDQGRLGQPQQRLSLAQRAAVNRMSGRQRHHAGRVLRQHKGRHLIGRQIVGGSVAHQLRRSLRFLQQHQLRIFA

SEQ ID NO: 138905 - protein, 146 aa, Glycine max
  Coding DNA Sequence Number=SeqID_47220
  Gene Ontology: Mol. function=sodium:dicarboxylate symporter activity; Cellular component=membrane; Biological process=dicarboxylic acid transport
  Homolog annotation: Hit_ID=A8G8G8; Match level="QueryCoverage=71%, HitCoverage=23%, E-value=1e-39, Identity=82%"; Hit description =Sodium:dicarboxylate symporter precursor
MAFKKSSPACLPLNPDKSRLAEHAARMIQIYTASHPGQDFLGMKSVKISLAWQILIALVLGIIVGAVLHNQTESREWLVSNILSPAGDIFIRLIKMIVVPIVISTLIVGIAGVGDAKKLGRIGLKTIIYFEVITTVAIVVGLTLAN

SEQ ID NO: 138906 - protein, 133 aa, Glycine max
  Coding DNA Sequence Number=SeqID_47221
MTENLHDFAHENVSEALRKHLSLDFLHGNNFFHPKQLKCIAKGVRDIWNSIPSPIHRKMGEEVAAQIARGSWVASSIKCCGTLRITQQCSFWLPEYCGSLRIEHSIEHCMTLKHKMQGLIDVGWLRFEEENRL

SEQ ID NO: 138907 - protein, 96 aa, Glycine max
  Coding DNA Sequence Number=SeqID_47222
  Subcellular localization annotation: CTP_CleavageSite=39; ConfidenceScore=5.19e-01
MTATVLGVLSTSSATRPSRDDHSSGSDASSSGTTKEGVRDMRSWVRGQWIPFDADALSQFLGYPLVLEEGQECEYGQRRNRSDGSMRSHRPGDPLE

SEQ ID NO: 138908 - protein, 22 aa, Glycine max
  Coding DNA Sequence Number=SeqID_47223
MEEKLACEASMETGSLSFNEVL

SEQ ID NO: 138909 - protein, 84 aa, Glycine max
  Coding DNA Sequence Number=SeqID_47224
HDKVKFGVEEVRDADALIPIPTEEVQLVGQTLNTFVAWLTHFVKRLSEQGAVGSAKPTDRPDHDVDDPLYLMILTIPQLFLKPL

SEQ ID NO: 138910 - protein, 225 aa, Glycine max
  Coding DNA Sequence Number=SeqID_47225
  Homolog annotation: Hit_ID=A5C169; Match level="QueryCoverage=68%, HitCoverage=13%, E-value=8e-09, Identity=28%"; Hit description =Putative uncharacterized protein
MVIDQSLFYDLTQLSSEGVPFEGALNDDWKFDFSVHDARWLVCTNQADMTGRLLAGSLAFESRILHYLIVHILLPRSSNLAQVSEEDLIVMWAFHTGRQIDWAHLVRYRMHKALRLNAPLPYPHLVTLFLQHFNIPLDSEPYVPIKRSFLIGAAVIASFGYRKEHDGSWVKKGAQPIDDEGNLPVGEDSSLLQKILDRFDGLQTYVGERFDALELQVDMRFNEMD

SEQ ID NO: 138911 - protein, 148 aa, Glycine max
  Coding DNA Sequence Number=SeqID_47226
MGKLDHLEERLRAIEGGEDYAFANLKELFLEPNIITPPKFKVLDLDKYKGTICPKNHLKMQYQYNFDMVPDRMQLQNICKKGDGSFKEHAQKVEGSGGPGGTPNDGKGDDDRDGKFDHPTRTTEKTGANEEGEKEGETHAVTAIPIRP

SEQ ID NO: 138912 - protein, 51 aa, Glycine max
  Coding DNA Sequence Number=SeqID_47227
IEVAKEHHLDEDAVIPHDVAPCRAYRPWIFFINEVFFFLNINESGMEKEKR

SEQ ID NO: 138913 - protein, 43 aa, Glycine max
  Coding DNA Sequence Number=SeqID_47228
LLVKPICRLSDPSAKCTTLAAEREEVSGRRMSWTHAISEHSSC

SEQ ID NO: 138914 - protein, 176 aa, Glycine max
  Coding DNA Sequence Number=SeqID_47229
MKSLHLVTCNRLHLDDISDSFLNIFLRVFVKYFLFQENFIVKKLVLFIFFIHFSLCQKNKRTNRGTSTWLFKETREGTSLVDLWLVKDFTRLKEISRTIGCLGTGCRHRLWPNQYKSCVAAATPERSLEATSEPSAQGEGIPSPQPTADPSTPFLEMLEDPTTPVLAMDTSPPATS

SEQ ID NO: 138915 - protein, 139 aa, Glycine max
  Coding DNA Sequence Number=SeqID_47230
  Subcellular localization annotation: CTP_CleavageSite=43; ConfidenceScore=5.01e-01
ARLAKEKFKSAATHIPEGVHRVTRGKRGHCKSPCTRNQKGPARRNMGREKFRGAFWGSNNELKLRREERDRSRVQEEFGSTLGSHGAKHASYHRAIQELNQSVTHEQKLVEDFAQVYAEKEARGRVIDALHQEATMWMD

SEQ ID NO: 138916 - protein, 183 aa, Glycine max
  Coding DNA Sequence Number=SeqID_47231
  Homolog annotation: Hit_ID=A5B939; Match level="QueryCoverage=39%, HitCoverage=52%, E-value=8e-23, Identity=69%"; Hit description =Putative uncharacterized protein
MSRRARRVAAKPRARARAERSSVQILVVVANIQMRTLKAEEGKGSILPTLETAQPEVGSSGWKSTARRVVSGAPPAALENPEDRVPPTPGKGSRQNGSVTSGKGLALRAGHGGPSPEPVGCRWTARAASAARAGRRVPVGGRIGNGPFGASSPGVEQSTQNWYGQGESDCLIKTKHCDGPCGC

SEQ ID NO: 138917 - protein, 280 aa, Glycine max
  Coding DNA Sequence Number=SeqID_47232
  Gene Ontology: Mol. function=protein transporter activity; Cellular component=type II protein secretion system complex; Biological process=protein secretion by the type II secretion system
  Homolog annotation: Hit_ID=Q3KBC1; Match level="QueryCoverage=54%, HitCoverage=96%, E-value=3e-28, Identity=47%"; Hit description =General secretion pathway protein H
  Pfam annotation: Domain name=N_methyl; Domain location=130-153; Score= 29.4; E_value=1.3e-05; Accession=PF07963.3; Description=Prokaryotic N- terminal methylation motif
MACKHRHRPAARRTAVQRHRRRARRRRGRGARPAAHRAGALVDARTDAPDRGLAAATARDLHRRAHRGHAAKRGSGALRGVRPHCQAPSARCPPACRKPGGPVAGMNGRAVARPSSAAPALPARSRRTQRGFTLIELMVVLVIVGVATAALGLSIRSDPARQLRDDAQRLVERLAAAQSEVRIDGRAIAWQADADGYRFVRGAWMLDGPVPVLDPTRIDDFPRDPALRPRQWQAGPVRVAPAVPVLLTPEWFGQPWRLTLSSAAGRVEVRRDANGRFLVQ

SEQ ID NO: 138918 - protein, 198 aa, Glycine max
  Coding DNA Sequence Number=SeqID_47233
  Pfam annotation: Domain name=Transposase_23; Domain location=113-183; Score=-1.4; E_value=0.0017; Accession=PF03017.5; Description =TNP1ENSPM transposase
MAEKIKKRLEEVAQSGSTEGVIDPPSPIRRHAKWKMARTKKTGRHRDQNPSHVRPAGAIADPTNQRPSGGVDHRKSDLAGDGILQPDAIPVSVSDAITRTCIASGAIGNDPETGDSDKCGLYIKENPSHLVVLGKLYEGYTAVHNIPLLHGQVKVGVEEVKDAEASVPVPTDEVALVGQALKTFLAWLTHLVKRLSEQ

SEQ ID NO: 138919 - protein, 131 aa, Glycine max
  Coding DNA Sequence Number=SeqID_47234
MHFVIGDFEHPDFEHYNFEHSDFEHFENMAQPPPRERTLREMVAPDFTYESLCIQYPDEDVPYVLKTGLIHMLPKFHGLAGPRPSGRTSQLPSPSDFGAASSPNFYEGLSNMERSMIDVVSGRALGDIDSC

SEQ ID NO: 138920 - protein, 172 aa, Glycine max
  Coding DNA Sequence Number=SeqID_47235
  Homolog annotation: Hit_ID=Q6CQF0; Match level="QueryCoverage=30%, HitCoverage=56%, E-value=3e-07, Identity=56%"; Hit description =Kluyveromyces lactis strain NRRL Y-1140 chromosome D of strain NRRL Y- 1140 of Kluyveromyces lactis
MNPDFNQPRGGCSREVSIHPAQQHCYMFALGKRCVTPRQACPRPNGFRAQLAFKDSMVHGILQFTPSIAFRYVLHRCKSRDIRCRESLFEFLGARSAGVCVCREDEEAGRTGRRGHPLPPDGSVDFSQRRGQRTAHVAAIRTLHRTIQSVGATGGVYKGQGRSQRELMTRAY

SEQ ID NO: 138921 - protein, 30 aa, Glycine max
  Coding DNA Sequence Number=SeqID_47236
MALGHSAWRVVLPFAVRLLPGHDHAGRPGV

SEQ ID NO: 138922 - protein, 105 aa, Glycine max
  Coding DNA Sequence Number=SeqID_47237
MGEWLAQRRDEGLVTDIPDSAPHGVSVLHPATVRAGGGFAPDDAAGVGVYFVYLFVAGVAGGGAGRSVRHRAQSSAAGRAVREYRTQSESDEQRFPAAGSEPAGP

SEQ ID NO: 138923 - protein, 183 aa, Glycine max
  Coding DNA Sequence Number=SeqID_47238
EHALRCPYRTRARARVMGEVEEVQEQMKADIEAMKEQMATMMEAMMSMKKIMEANAIVVAPTSTVAKLGGTGGPHYVKIQNKHAFSPYGLPPNYTPPNVAYTPNENVNNSTSILIESQQPQFDHAHVSQPMGETHEMPQHNLVNFEPCLRYATEGEADGGIPLQNTLEGPQYHPEADPSHSTA

SEQ ID NO: 138924 - protein, 189 aa, Glycine max
  Coding DNA Sequence Number=SeqID_47239
REFAKRNLQWLSARKNPEDELSSSLSALLQICAKRTSTNKATCLSLKSDLQREFDTFLEKLCMREGSRERKVQVPESSERFCYVKIYRDASLKWKPRFLDYGKLNPLLDLPWCFYLDHIDACFVRVIQQWKLESGYKNLVVYVCLNAVLVEFSLTRGIYGRGLIRTRLGYHEESRSSSLGDSIGTHEHC

SEQ ID NO: 138925 - protein, 46 aa, Glycine max
  Coding DNA Sequence Number=SeqID_47240
MDTSKPYTRAMRGIVHEPQVPSYKVMKKDNNWYLKALHWGNEGHRA

SEQ ID NO: 138926 - protein, 97 aa, Glycine max
  Coding DNA Sequence Number=SeqID_47241
MEEQASQDSMEEQASQDSFVAHGQHPGRVRAAGANVTIKQYFGPTPRTSHTSSSIAPKDMEQLTQKIRDQLEESITEKPDAIPISIVDAISGTRTTS

SEQ ID NO: 138927 - protein, 111 aa, Glycine max
  Coding DNA Sequence Number=SeqID_47242
MNEVLSELRGLRSYVGDRFDSLDTRFAGMDIHLTQLEEDDLYCHHQKGRDCRCKCLWCFDDDHDDMMQLMQMGFSSLNSRQYFKITSHNIKMITSILGREFLIELAKGLAK

SEQ ID NO: 138928 - protein, 114 aa, Glycine max
  Coding DNA Sequence Number=SeqID_47243
NVYTDNHSGICARQRDSNVSMTDLVSAEDDQKKVYTDNHSGISARQRDSNVSMTDLVSAEDDQKKVYTDNHSGIFARQRDSNVSMTDLVRVADKSKALAPTYPQMRNSNLRSSG

SEQ ID NO: 138929 - protein, 316 aa, Glycine max
  Coding DNA Sequence Number=SeqID_47244
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=69%, HitCoverage=76%, E-value=1e-110, Identity=92%"; Hit description=Beta- lactamase TEM precursor
  Pfam annotation: Domain name=Beta-lactamase; Domain location=1-215; Score=108.8; E_value=1.6e-29; Accession=PF00144.15; Description=Beta- lactamase
MMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRQQLIDWMEADKVAGPLLRSALPAGWFIADKSGAGERGSRGIIAALGPDGKPSRIVVIYTTGSQATMDERNRPIAEIGASLIKHCVRPRRKDQRIFLRSFCSARNLLLANVKTTATSGGLFAGSRATNSFSEGNWLQQSADTKYCSSSVAVVRPPLQELCSTAYIPRSANPVTSGCCQWR

SEQ ID NO: 138930 - protein, 103 aa, Glycine max
  Coding DNA Sequence Number=SeqID_47245
MPLRKKSESERSLNSRKDGSQNIAIVTVSGLRETGLDAYRTKIVSIYAQTIHIGGKLEASIVPRGTLECYDGVFQFVLTSPFDHSVMSTLRPPARLQLTWSFT

SEQ ID NO: 138931 - protein, 159 aa, Glycine max
  Coding DNA Sequence Number=SeqID_47246
MGEVEEVQEQMKADMEAMKVQMATTMEAMMSMKKIMEANAVAVATTRAVAKYGWPHDVQIQNKYTFPPYGLPPKEDVNNSAPILIESQQPQSDHTHVSQPMGETHGMPHHNLADFEPCLRSIKNPHAMAEMGKVDHLKERLRAIEEGEDYAFANLKSYS

SEQ ID NO: 138932 - protein, 108 aa, Glycine max
  Coding DNA Sequence Number=SeqID_47247
VPPHVEDESSEDTILEPFIVEEEVGETQVRQEAAATPERSLEGTIEPPAPVVDLSSPQHATDPFTEIPEDPITPVLTLNTSPRATLVLHLTDKEDVQTQDTQDQSQEF

SEQ ID NO: 138933 - protein, 165 aa, Glycine max
  Coding DNA Sequence Number=SeqID_47248
  Homolog annotation: Hit_ID=Q2AA09; Match level="QueryCoverage=96%, HitCoverage=52%, E-value=2e-08, Identity=29%"; Hit description =Retrotransposon gag protein
MERSMIDATNGGALGDMTPAKARNLIEKMTSNSQQFSARNDAIVLRRVYEVATDSSSSTENKKLEGKLDALVNLVTQLAMNQKSTPVARVCDLCSSADHHTDLYPSLQQSEVNEQPKTYATNIYNRPPQQQNQQQQNNYDLSSNRYNPGWRNHPNLRWTSPPQQQ

SEQ ID NO: 138934 - protein, 195 aa, Glycine max
  Coding DNA Sequence Number=SeqID_47249
  Homolog annotation: Hit_ID=Q6WAY6; Match level="QueryCoverage=77%, HitCoverage=24%, E-value=3e-13, Identity=30%"; Hit description =Putative uncharacterized protein
MLSSHITIARKVQWWLSWQICLTPLTGDTRHPCPLQSYRSCAEKGRVDWDQHLAGIGGSAINWFPRWKEGKEGVLFSCGDYPNVPLIGTRGCINYNPALAIRQLGYPMRGAPTEESLSPFLVRDLGAQGLKVIQRIHKAWRNPLKKDKELRGIRNGVIGGYHGWLRIHARGLDWLSKLKVIDEENFEAPEEDEEV

SEQ ID NO: 138935 - protein, 45 aa, Glycine max
  Coding DNA Sequence Number=SeqID_47250
MAKKGVFRPYRVEERIHEYQEPLDLRSNPFQGGGNDAILSPKGIG

SEQ ID NO: 138936 - protein, 79 aa, Glycine max
  Coding DNA Sequence Number=SeqID_47251
MTLVSACYHALILRDSKRKFKWITTRVSSHVTDSSVLDDRNSSARKMHKSPRVIGLVGRGLTKGAEDDVSLCVLSCFES

SEQ ID NO: 138937 - protein, 149 aa, Glycine max
  Coding DNA Sequence Number=SeqID_47252
  Gene Ontology: Mol. function=aspartic-type endopeptidase activity; Biological process=DNA integration
  Homolog annotation: Hit_ID=A5ARL5; Match level="QueryCoverage=89%, HitCoverage=9%, E-value=3e-19, Identity=37%"; Hit description =Putative uncharacterized protein
MKTEEDELEEEVALNVLTADYQEYLQLKAAKESQTSSAISGHNSTTCTSQFGNNQSPWIIDSSASDHIAGNSSLFSSLSPPKIPHFITLADGSRVAATRISHECGTSRTIGIGHESHGLYYLKPNLSWVCNAATSPKLFHESLGHPHFI

SEQ ID NO: 138938 - protein, 138 aa, Glycine max
  Coding DNA Sequence Number=SeqID_47253
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRADATMDSIIGGEEREQADKKESIVNVVQSWLV

SEQ ID NO: 138939 - protein, 69 aa, Glycine max
  Coding DNA Sequence Number=SeqID_47254
MGAYAKDEKLLIHSFQESLTGVAVTCVSIMASDRMQLHNMCKKGAQIFQRICPKVEGSGSPSVSLNDEE

SEQ ID NO: 138940 - protein, 190 aa, Glycine max
  Coding DNA Sequence Number=SeqID_47255
  Subcellular localization annotation: CTP_CleavageSite=41; ConfidenceScore=5.44e-01
MAEPSKKRKGSSSTAAAAAHCRHGPSKASTAPIHPSLSSLRSSTLFSSDDQASTDGIIISEVHGIPMVIDQSLFFSLTNLPSQGAPFEGTIVDDWKFDYSSHDAHRMVCNDQAEMTGRLLAGSLTFDNRIMHYIIVRILLPRSSNLAQASEEDLILMWAFLTGRQIDWAHLVRYRMHKAFGPMHLSLIHI

SEQ ID NO: 138941 - protein, 60 aa, Glycine max
  Coding DNA Sequence Number=SeqID_47256
MPLQGEDESRRRLPPQEAMDKSLKVGEDEWRERKRRNTKFCASKEPTNPRSSPRFSTKCA

SEQ ID NO: 138942 - protein, 193 aa, Glycine max
  Coding DNA Sequence Number=SeqID_47257
IYPQEDGQPLVVKEKCKEVSVSSKRLAKKETHFTIKTNIKETFPLRQPPHFLFCKKTLVSTATPLGLEVIHQVKELLDEGLVRKSLNPYALLVPKIGVPTNPKRIKVIPDWPPPPTPLIELVRNHVPSWKDVHERGFQTLPYSKIPNTTNTYVFIIFTSVEGRSLEYEEPRDLRSNPLQGGGDDAILPPKSIG

SEQ ID NO: 138943 - protein, 450 aa, Glycine max
  Coding DNA Sequence Number=SeqID_47258
  Gene Ontology: Mol. function=transcription factor activity; Cellular component=intracellular; Biological process=regulation of transcription, DNA-dependent
  Homolog annotation: Hit_ID=A1G0E8; Match level="QueryCoverage=50%, HitCoverage=70%, E-value=1e-121, Identity=96%"; Hit description =Transcriptional regulator, RpiR family
  Pfam annotation: Domain name=HTH_6; Domain location=1-67; Score= -21.9; E_value=0.074; Accession=PF01418.8; Description=Helix-turn -helix domain, rpiR family
  Pfam annotation: Domain name=SIS; Domain location=85-215; Score=52.2; E_value=1.8e-12; Accession=PF01380.13; Description=SIS domain
  Pfam module annotation: Pfam domain module=HTH_6::SIS; Domain location=1-67::85-215
ALGISQSSVVKFSQKLGFKGYPDLKYSIGQDVARAGANPQQAPSEPDSGDDYLRLGDALRRSKAQAEEETRQANPREEIERIVQLLDGAPKLFVHGLGDDGLFAREFAMRLSLLGLLVVPHTDPILMLANLSAARPGDALLMFSEFGNLPQLSQLSRQFQDMGGKVISITRHTANPLRAHADAALVVCAHDRTPQVAQLLYRSAMHALLDFLFVLLCHTNPDRQQQLGGEPGADRPPAGFLTGAHVDESLVRLATTALLLAAAVSVHAAPLDGARQLIVVTSEGWDSTEGQLQAYARDGKGWHAHGQAFPVALGRTGSAWGLGLHPAQADGPQKQEGDGRSPAGIFALGSAFGYAVTRPGTAMPYQPMLDSSYCMDVPGSPFYNRIVDEKKVGSAAVKGSTEPMRLDLHNKGDVRYREGFVIAHNPDNQPGKGSCIFAHLWRTPGEATAG

SEQ ID NO: 138944 - protein, 326 aa, Glycine max
  Coding DNA Sequence Number=SeqID_47259
  Homolog annotation: Hit_ID=A5AKA6; Match level="QueryCoverage=72%, HitCoverage=26%, E-value=3e-11, Identity=21%"; Hit description =Putative uncharacterized protein
DQCLWYNSQFSSRIILDPKYLDTNFFNDETFDCYQVFQNSGLVDFMSLKLPYYPELVKVFYSNLKIQDGIISSKVYGISMIIDQSLFFSLTKLPSQGAPFERTIVDDWKFDYSSHDAHGMVCNDQAEMIGRLLARSLNFDFRIMHYIIVIILLPRSSNLAQASEEDLILMWAFLTGRQIDYAHLVRYRMHKALWANAPLPYPQLVTLFLHHFQIPLDDEPFVQVKRFFAIGAGAITSFGCRKDRNGQWLKKDALPPQDERTPSPTPQRDDSSTLLTEVLSELRGLRTYVGAGAITSFGCRKDRNGQWLKKDALPPQDERTPSPTPQ

SEQ ID NO: 138945 - protein, 127 aa, Glycine max
  Coding DNA Sequence Number=SeqID_47260
  Gene Ontology: Mol. function=RNA-directed DNA polymerase activity; Biological process=RNA-dependent DNA replication
  Homolog annotation: Hit_ID=A5BSW9; Match level="QueryCoverage=92%, HitCoverage=9%, E-value=1e-09, Identity=30%"; Hit description =Putative uncharacterized protein
MKELRRGRNASYGSHESCKSLSEELSDYYGGRHRSYTRPHSQRRENDRRSQEEMKVEQLFACHHISEERRVPLATFSFQGYALYWLTSVVRERRILGNPPAENWNDLKSALRKRHIPFDVSLFSPIS

SEQ ID NO: 138946 - protein, 98 aa, Glycine max
  Coding DNA Sequence Number=SeqID_47261
  Gene Ontology: Mol. function=transferase activity
  Homolog annotation: Hit_ID=Q8VZM1; Match level="QueryCoverage=77%, HitCoverage=8%, E-value=2e-12, Identity=52%"; Hit description =Putative N-terminal acetyltransferase
MVKLHLLNTILFAVNATVECTINIISQISLLEECEFLERALEELHIKESKIVDKLVYKEQEVSLIVKLGHLEEGEALYRALLSMNPDNYRRSLLPHIF

SEQ ID NO: 138947 - protein, 269 aa, Glycine max
  Coding DNA Sequence Number=SeqID_47262
LHALTFRGPHVLTFRGLHALAIRGLHVVTFRGLHALAIRGLHVLTFVGLHALTFRGLHVLANRGLHALTLRGLHVLANRGLHALTLRGLLVLALRGLHVLTIRGLHALTSRGLHVLALRGLPALALGTSYSHLQRTTCPRLQRTTRPRLQRVMYLQLQRTTRPRRQRVMYVHLCRATRPHLPRTTCPHLQRTTCPYLQRATRPRLRRATRPHLPRTTCPHLQRATRPRLRRATRPHHQRTACPHLQRATRPRHQRTTRPHLRRATRPHL

SEQ ID NO: 138948 - protein, 274 aa, Glycine max
  Coding DNA Sequence Number=SeqID_47263
  Homolog annotation: Hit_ID=A5BSR3; Match level="QueryCoverage=24%, HitCoverage=21%, E-value=6e-11, Identity=48%"; Hit description =Putative uncharacterized protein
MDEKRKKKLEEATQSGSTDTVIDPSSPIKRHVKWKLARTKKTGDMTSEAAKEICDKIDALEEQASQGSFVTYGRHDILTAAIGRPEHPGRVRAVGAVDATNQGPTGGFNHRKSHLTALPPEPNVGPSATRVNTKESCVDPSGNDPDTGDSYKCGLYIEEYPSRLVALGRVYEGSTTIHNIPYLADTSCQAFIRTGVVGPTKPADRPDDEVDDPLYLMTLTIPQLFLKPLQVMWDATLFDLFNENFPLYIKLEDRSEIAHDGQCLSISVIQLWIL

SEQ ID NO: 138949 - protein, 292 aa, Glycine max
  Coding DNA Sequence Number=SeqID_47264
  Homolog annotation: Hit_ID=Q6WAY6; Match level="QueryCoverage=67%, HitCoverage=31%, E-value=3e-25, Identity=37%"; Hit description =Putative uncharacterized protein
MGTNQTDKRFYQVKVKSLDTTSIKELGRLMEPLQMQAFRKTYGKILELTLAEDVLSGEGNHIFIRVSPSLSRIATVVKDSARGLDRIKQTRNGIAGLPRGYLEDKARGMANHGDWVPFMDVLALLIFGVILFPNVDGLVYLAAINAFLAYHHSKESPVVAVLADLFDTFDRRCEKSSARIICCLPALCVWLVSHLFQQDTRHPCPLLSHRSCTEKRRIDWDQLLVGIRGRTINWFPRWKEGKEGVLFSCGGYPNIPLVGTRGCINYNPALAIRHLGCPMRGAPTEESMSPFL

SEQ ID NO: 138950 - protein, 112 aa, Glycine max
  Coding DNA Sequence Number=SeqID_47265
  Homolog annotation: Hit_ID=A0ST23; Match level="QueryCoverage=28%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLVGKPVVPAALMNRPTRGERRFAYWALFRFLAH

SEQ ID NO: 138951 - protein, 368 aa, Glycine max
  Coding DNA Sequence Number=SeqID_47266
  Gene Ontology: Mol. function=diaminopimelate decarboxylase activity; Cellular component=chloroplast; Biological process=lysine biosynthetic process via diaminopimelate
  Homolog annotation: Hit_ID=Q88B24; Match level="QueryCoverage=96%, HitCoverage=87%, E-value=1e-123, Identity=60%"; Hit description =Diaminopimelate decarboxylase
  Pfam annotation: Domain name=Orn_Arg_deC_N; Domain location=1-213; Score=81.9; E_value=2.1e-21; Accession=PF02784.7; Description =Pyridoxal-dependent decarboxylase, pyridoxal binding domain
  Pfam annotation: Domain name=Orn_DAP_Arg_deC; Domain location=216 -334; Score=134.4; E_value=3.3e-37; Accession=PF00278.13; Description= Pyridoxal-dependent decarboxylase, C-terminal sheet domain
  Pfam module annotation: Pfam domain module=Orn_Arg_deC_N::Orn_DAP_Arg_ deC; Domain location=1-213::216-334
MSNVNILSLMREAGVHVDAAGFSAAATATGAAGIVFTADLFDRDTLDYVVREKIEVNAGSLDMLHQLGERSPGHRVWLRINPGFGHGHSKKTNTGGENSKHGIWHGQLAQAITLLERYRLHLVGFHLHIGSGVDYRHLERVCQAMTDIISSVDHDFEAISAGGGLSVPYKNGDQDIDVAHYFNLWDQTRRQAEKKLGHSVRLEIEPGRFLVAQSAVLVAEVRATKQMGDNHFTLVDAGFNDLMRPALYGSYHHISVLSANSRARKTEASRPTVIAGPLCESGDVFTQQQDGTVEMRELPPAHVGDYLVFHDAGAYGASMSSNYNSRPQAAEYLLDGPASRLIRTRQKITELYQRECPNLASPTTAKAI

SEQ ID NO: 138952 - protein, 236 aa, Glycine max
  Coding DNA Sequence Number=SeqID_47267
EVTDADASVLVPTDEISLEGQTLHTFLAWPTHLLKSLSQQVAASPAKPPPKPDPEIDDPLYLMTLTIPELFLRPYQVRWDSIVFGVFNPDFPLYIKHEDLSEIAHGGQCLSISSIQRSGQSQFESESDIKSWMQSSQRNRTLEDGGHPAQGTPSCLVLMMLHSLNQRLLLGGLSSRQKGSTECGYYVMHWMSTIILGTFRNNWEAYFNNPRPLEPERLKALRIQWAQFYLRVRDQA

SEQ ID NO: 138953 - protein, 67 aa, Glycine max
  Coding DNA Sequence Number=SeqID_47268
MPGADHKQPNHKGGETSSSTGAIGNIGSQNRKTGYAELSPEPLGRTISEAIIGETQVVANMLYEIDP

SEQ ID NO: 138954 - protein, 155 aa, Glycine max
  Coding DNA Sequence Number=SeqID_47269
  Homolog annotation: Hit_ID=UPI000065F7CF; Match level="QueryCoverage =88%, HitCoverage=20%, E-value=3e-08, Identity=32%"; Hit description =Homolog of Homo sapiens "Leucine-rich repeats and IQ motif containing 1
MDPRRTTRPRQQRAARPHLERTTRPRQRLHVLTIRGLHALTSRGLHVLALRGLHVLTIRGLHALTSRGLHVLALRRLLALALGTSYPHLERTKRPRLERTTCPHHQRAARPHLQRTTRPHLERTTCPHHQRAARPHLQRTTRPRLERATRPRLGY

SEQ ID NO: 138955 - protein, 95 aa, Glycine max
  Coding DNA Sequence Number=SeqID_47270
  Subcellular localization annotation: CTP_CleavageSite=45; ConfidenceScore=5.07e-01
MTVKTSDTCSSRETVTACLCVRRKYRIRRHSPFRLRNCWEGRSVRASSLLRQLAKGGCAARRLSWVTPGFSQSRRCKTTASAKLACLQVDSRGSP

SEQ ID NO: 138956 - protein, 77 aa, Glycine max
  Coding DNA Sequence Number=SeqID_47271
MARSVFALCPYFRELYGGKLKGLLVIIPKVVISLLMVSRGIILFEEHIAAVGTTSNNMLSKRKTLDEGSLLSSKSET

SEQ ID NO: 138957 - protein, 136 aa, Glycine max
  Coding DNA Sequence Number=SeqID_47272
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTSTTAIEQSLMP

SEQ ID NO: 138958 - protein, 180 aa, Glycine max
  Coding DNA Sequence Number=SeqID_47273
MAKSHIRGLDWLAKLKVVSEENFGAPEEDKEVQALKSELGKAKLAKEKFKLAATHVRKECAGLREENAITARALEQETKRARKEEYGRNKFRGALWGSNSELKLRKEERDQSRAHSMVLKEELVASSRSKRSVSQRLCETETNMLAIIAKYQEELGLAAAHEHRIADEYTQVYAKRLEEG

SEQ ID NO: 138959 - protein, 25 aa, Glycine max
  Coding DNA Sequence Number=SeqID_47274
SRNISRTLELGLLKMEAPRNLSELQ

SEQ ID NO: 138960 - protein, 76 aa, Glycine max
  Coding DNA Sequence Number=SeqID_47275
  Subcellular localization annotation: CTP_CleavageSite=80; ConfidenceScore=5.47e-01
MGVQIAPRPSWALQNIPPEGCCFWRKQPGSPGRAGKSKPRRFQNVSVTFSVKNFAKVSTVLRRSSFVLHRSSIFNG

SEQ ID NO: 138961 - protein, 95 aa, Glycine max
  Coding DNA Sequence Number=SeqID_47276
MWTGISGKGSNGQILAELVSSFFEDEPSSSCCNICRTSLRVLVRISFDFDPAKNAARWDFWFQNTKFSRSTALRNFGWDWNQSFTCSGSTLDESN

SEQ ID NO: 138962 - protein, 224 aa, Glycine max
  Coding DNA Sequence Number=SeqID_47277
RLRGFGRIDRTSCSQGASLELNHPGCLFSEDDSFAEGHDYVNQPQGCAEMAQHPPAEGSSHIAASQSRCRGSANPIPAVAPARITNQEVAMIRQQVGKENHDMMLRMIQQVATVLSPMYETSHDKEKGIKFNELSPQLRPILQYGNAHLIWRPEEMPRLGACLHALASESSRRPVGQQGSEQGAESQSRVRRSKGEREPEQQASQLGTFPATTVPQAPSDLEIT

SEQ ID NO: 138963 - protein, 179 aa, Glycine max
  Coding DNA Sequence Number=SeqID_47278
PIAFRGLPILDFRGLHILAFRGLQVLAFRGLHSLALRGLHVLALRRLHVLALRGLHVLALRGLHVLAFRGLHVLDFRGLHVLVLRGLHVLSFRGLHALALRRLHALALRELHALTFRRLHVLAFKGLHILAFRGLHAIAFRRLHILAFRGLHALAFRGLHALRGVGSSGLRIIKKGRLN

SEQ ID NO: 138964 - protein, 76 aa, Glycine max
  Coding DNA Sequence Number=SeqID_47279
  Subcellular localization annotation: CTP_CleavageSite=56; ConfidenceScore=5.28e-01
WRLSWTYLPVTGSGVYPDLSSFTGSGVYPDLSSFTGSGVYPDLSSFTGSGVYPDLSSFTRSGVIQTFVTCIKRSAP

SEQ ID NO: 138965 - protein, 73 aa, Glycine max
  Coding DNA Sequence Number=SeqID_47280
  Subcellular localization annotation: CTP_CleavageSite=28; ConfidenceScore=5.12e-01
MGEMLATQLAQASKVTSSRSNRLLEESSGGPKWACFGMSRNFTNCATMLPFEFWHVTELHKLPDDGCQVPQNG

SEQ ID NO: 138966 - protein, 185 aa, Glycine max
  Coding DNA Sequence Number=SeqID_47281
MRAGNYDIYGFLEPQSIQRSGLSQFETESYIKSWMQSSKRDVYLGAYLNGGHWQMVVILPKEHLVVWFCSLHNRPNNYLKGIINSALKGLDDAPQPKSKAPASWIVVKAVVSPVKPPQKPDPEVDDPLYLMTSTITKLFLRPYQVTWDATMFGVFNPYFPLYIKHEDLSEIAHGGQCLSISLLQL

SEQ ID NO: 138967 - protein, 212 aa, Glycine max
  Coding DNA Sequence Number=SeqID_47282
MDVTTSRRFIYKALQKAGMIPRGGHKEDSCLMHPGVLHDMETCSTVRDLLQQMIDQGRLEVSNEGEEEQHVYMQLADKEGPKKPKPLVIHFTRDTAPQRPQYPSAVSGARPMSFPYENSRAVLWRYAPPGGRKEEATDIGSLSAKVTNITGLSGITRNSHVFAPPSLPIQPANFKKKAKVTKGQNVKVIPVPDEGVLTNDFAKGREGYGKKE

SEQ ID NO: 138968 - protein, 313 aa, Glycine max
  Coding DNA Sequence Number=SeqID_47283
  Homolog annotation: Hit_ID=Q84VH5; Match level="QueryCoverage=100%, HitCoverage=48%, E-value=1e-111, Identity=67%"; Hit description =Envelope-like protein
  Subcellular localization annotation: CTP_CleavageSite=21; ConfidenceScore=5.31e-01
MATSPKETSAPGSPSVPSSPSSTKAPSNQERPEFNIQPIQMIPGSAPVPEKLVPKRQQGVKISENPSLATSPREVDTEMDKKIRNVPTSSTPNVSVPDVDKDVPTSSAPNVEALPSPSEEESTEEDDQATEETPAPKAPEPAPGDLIDLEDVESDEEPIANKLAPGIAERLQSRKGKTPIKRSGRIKTMAQKKSTPITPDTSRRSKVAIPSKKRKEISSSDSDDDVELDVSTSKRAKKSGKKVPENVPDAPLDNISFHSIGNVERWKYVYQRRLAVERELGRDALDCKEIMDLITTTGLLKTVTKLGDCYESL

SEQ ID NO: 138969 - protein, 105 aa, Glycine max
  Coding DNA Sequence Number=SeqID_47284
  Subcellular localization annotation: CTP_CleavageSite=59; ConfidenceScore=5.15e-01
LIEARNQSWKPQGPVGLFRVHWVSCGILLSSNVIYVRVVMLVRMIRTRLFAVARVKSCPSMHSSSVIASLSSCARTVGAPPISGGGPGTVKRETTGPLTGSASLG

SEQ ID NO: 138970 - protein, 158 aa, Glycine max
  Coding DNA Sequence Number=SeqID_47285
  Subcellular localization annotation: CTP_CleavageSite=83; ConfidenceScore=5.36e-01
MPPKVSSSSGRGGRSSTKGKEVLLALPEPITKKATTTSSGSPNQTGSSTHKGKLEGSLTQTSTIKSESSTQESPKPTTSKQTVADYAWSIQTLLALEDIGLTKIPKLAKKTWAEMASESDDDSETDLQKQIQKAKQTKIVCNQKPSQSLTKQESTPQP

SEQ ID NO: 138971 - protein, 89 aa, Glycine max
  Coding DNA Sequence Number=SeqID_47286
MDCHHQKGGDCGNNDLQDYFDDAKESRVKQVPKNQASRIKSQRIKIQEQLSFKIQDSRTIKIKIQGSREADLKIQEKKSRNNSQDFTRE

SEQ ID NO: 138972 - protein, 58 aa, Glycine max
  Coding DNA Sequence Number=SeqID_47287
MVGYTPSSFPDLVFAGERIKVGLKRGKSDKPAFINAKTRANEEDENEGETLAMTVIPT

SEQ ID NO: 138973 - protein, 97 aa, Glycine max
  Coding DNA Sequence Number=SeqID_47288
MIESFQQQQEMSVIELYIEVDVVGASALNMANSLLSYGNNIAGNESKVQRFVINLDNDFDNDDYMISNSYVEYSLDEEEDIDDISDTDEEGGSGTAF

SEQ ID NO: 138974 - protein, 213 aa, Glycine max
  Coding DNA Sequence Number=SeqID_47289
  Gene Ontology: Mol. function=nucleic acid binding; Biological process= RNA-dependent DNA replication
  Homolog annotation: Hit_ID=Q2AA09; Match level="QueryCoverage=81%, HitCoverage=56%, E-value=1e-09, Identity=29%"; Hit description =Retrotransposon gag protein
MERSMIDAASGGALGDMTPAEARNLIEKMASNSQQFSARNDAIVIRGVHEVATYPSASSKTKKLEGKLDALVNLVTQLALNKKSVPVARVCGLCSSADHHTDLCPSMQQPGAIEQPEAYAANIYNRPPQPQQQNQPQQSNYDLSSNRYNPGWRNHPNLRWSRPQQQQQAACSFLPKCCWPKQTIHSLHQSNNSNNPRNSQQLRPLHNLPSKNL

SEQ ID NO: 138975 - protein, 51 aa, Glycine max
  Coding DNA Sequence Number=SeqID_47290
MINAGMICPLRFHEEMPDAIKEQARVSLLCAPLMERIPKSPSIDKSQGWFH

SEQ ID NO: 138976 - protein, 98 aa, Glycine max
  Coding DNA Sequence Number=SeqID_47291
MVGYAPSSFVDLVFADERIEVGKFNHPALMNKKIGANEEAITPAKVHQPPFLREYDLNATCACHGEAPGRSIEHCRALKRKVQGLIDAGWLEFEENRL

SEQ ID NO: 138977 - protein, 129 aa, Glycine max
  Coding DNA Sequence Number=SeqID_47292
MERSMIDAASGGALGDMTPAEARNLIEKMASNSQQLSARNDAIVLRGVHEESGVNEQPKAYAANIYNRPPQHQNQQQQNNYDLSSNRYNPGWRNHPNLRWTSPPQQQQPVPPFQNVAGPSKPYVPPPMQ

SEQ ID NO: 138978 - protein, 105 aa, Glycine max
  Coding DNA Sequence Number=SeqID_47293
MSGFTRDPPQISASPHQLDLAPYASGPYNAQWNVSGLLHDKHTLRSSRILRETKVDEPWLGLWLPLNYQVVFSIGRVEWQSQYGFLPHSHPLHLPQFFFAFIQAG

SEQ ID NO: 138979 - protein, 206 aa, Glycine max
  Coding DNA Sequence Number=SeqID_47294
LHALAFRGLHVLPFKGLHVLAIRGLHDITLRGQHAVIFRGLHVLAFRGLHVLLFRGLHVLAFRGLHVLIFRGLHRATCPSLQRTTRPRLQRATRPHLQRTTRPHLQRTTRPRLQRDTCPRLQRTTRPQLQRTTHPRLQRATRLHVLAFRGLHVLTFRGLHVLAFRELNVLPFRGLHVLVVTGLHVLAFRGLDVLAYRGLHVLGGIL

SEQ ID NO: 138980 - protein, 137 aa, Glycine max
  Coding DNA Sequence Number=SeqID_47295
  Gene Ontology: Mol. function=RNA-directed DNA polymerase activity; Biological process=RNA-dependent DNA replication
  Homolog annotation: Hit_ID=Q5NRP4; Match level="QueryCoverage=52%, HitCoverage=5%, E-value=3e-09, Identity=38%"; Hit description =Putative gag-pol polyprotein, identical
MLRPTYLDWEMKVEQLFACHHISEERQVPLVALSFQGEQRIHGDPPIEYWNNLKSALRKRRIPSYYERELMRTFMRLMNHVLWEFMGSKDDDKGDDKKLKDQSKNEFKMFKIELRTLQDSREKLNSRVKNQDSRIKL

SEQ ID NO: 138981 - protein, 116 aa, Glycine max
  Coding DNA Sequence Number=SeqID_47296
MESKRVGKKKTNTQEFLYWFSNNPCLHPVSKRPAVLEISFNLVKILLQAKINKGLDVPSTRTDPQEMYPLFFSVNNPSRCTFYLYHKRCTLSSSQAVKPLILYEWGYKRILRWLVL

SEQ ID NO: 138982 - protein, 91 aa, Glycine max
  Coding DNA Sequence Number=SeqID_47297
MDYEDFNLIKEFLFMWWFDDSWWPPMAEEEFLGWFGWSFERESELVSIGENPLLALSGIFASSAIPLGSGFALSAIPLTLSATFCVECNFS

SEQ ID NO: 138983 - protein, 112 aa, Glycine max
  Coding DNA Sequence Number=SeqID_47298
MKGQDIYSSQDKATTSPSSSESEEEKGEESSEEIYPQEEGQPLVVKEKCKETLASIATPLGLEFIPQVKKLLDEGLVRKSLNPCALLVPKIGVQGRSPEYEEPQDLRSNPFQ

SEQ ID NO: 138984 - protein, 60 aa, Glycine max
  Coding DNA Sequence Number=SeqID_47299
MAYTAILLGWFRSQLTLLKKRSAISETGNLTACLGASNLNAMREGVSGSMKGCRDAKRVP

SEQ ID NO: 138985 - protein, 341 aa, Glycine max
  Coding DNA Sequence Number=SeqID_47300
  Homolog annotation: Hit_ID=Q6WAY6; Match level="QueryCoverage=42%, HitCoverage=23%, E-value=3e-12, Identity=32%"; Hit description =Putative uncharacterized protein
MPSWGKKTVSFLWVSSLLEQDCSCGRRFGERVGSYEANSKRRSGPTAKILGSQGKGYGESRRVGPVCGYTSFANLWGCPLSERGRCEKNSAHIVCCLPALFVWLVSHLFQQDIRHPCPLQSYRSCVEKRRVDWDQYLAGIGGSTINWFPRWKEGKEGVLFSSGDYPNVPLIGTRGCINYNPTLAIRQLGYPMRGAPTEESLSPFLVRDFGAQSFKIVHRVHKAWESPLRKDKELRGIRNGIISGYHECLRVHTRGLDWLSKLKIINEENFEASEEDEEVQALKLELGKARLAKEKFKLVATDIRKECAGLREENVATARALERETKRARKEEHGRDKFRGA

SEQ ID NO: 138986 - protein, 47 aa, Glycine max
  Coding DNA Sequence Number=SeqID_47301
MKHCCLPCLLVINLSFIRGCTSTITTNLCFFLVYQSSFQKPRSKERY

SEQ ID NO: 138987 - protein, 509 aa, Glycine max
  Coding DNA Sequence Number=SeqID_47302
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=98%, HitCoverage=16%, E-value=4e-61, Identity=29%"; Hit description=CTV.20
MDMGIDAAVLMCLRDIRHNQFEDSLIGTVETSLGQGPIYFNCYPNKIVSLMDRNILDSLFLNIHFHGLDMKEGSIPAALIYRIQYKVMNTCASRVLLKPQRGETTLFITDMTKANVSLPRKIKWDEVTLPERWVMDKATPSIPRPAPTIEHIKQDNSGKVEITFNRRNSFSSRIEASRSEYESARRSFSVRTRSIPVGLTRSESHNQFPTVNLQGLDTTSSIPRTTYNQEQEDDQNIDKETLRKDFYSPENEPQRRWFFQHYKGANSKQIQDKFYEFVERVKINVLFFDWFHAYAIRKDIDYPWKQDIIGDPTTNVITNWQVKDGELIQSELPPATQYQLPNIKDSNNKPVMAIPFKTKDVNEEITSKDIKSLMEQANYTNKYLQALGETIKTKVVPIQKSIEETSPSIPIEKPLFKPFKVSEKAKRKIRELRKTKSLIEGVGDNHSELLNKIGSLLKVIPDTPQASENTSKMVTRSTSKLINVINEDSDQNSDYTTEIGSVSDKYIIQ

SEQ ID NO: 138988 - protein, 162 aa, Glycine max
  Coding DNA Sequence Number=SeqID_47303
MVEREMITMMVDTLPVFYYEKLVGYMSSSFADLVFAGERIKVGLKRRKFDYVSSTSANAKRIGTTGAKRKEEDTHAVSSTPAWVKPPQTPHGTHQYAQHHPSFSAHAGNASSSAPVQPKAPTQREAPQVPTPNTTRPAGNSNAIKELPSEAISRIHPTPNDV

SEQ ID NO: 138989 - protein, 115 aa, Glycine max
  Coding DNA Sequence Number=SeqID_47304
  Subcellular localization annotation: CTP_CleavageSite=53; ConfidenceScore=5.36e-01
MYPPLFSLNNLVDVPSTRTDPQEMYPLLFSVTTTQVDVPSTCTTKDVLSNVLRQSSQSVSPSKLCEGGNKRILRRFGKLANLRKLLTKEEEEEIQEDVQRDSRVVKDLKSRYSMH

SEQ ID NO: 138990 - protein, 26 aa, Glycine max
  Coding DNA Sequence Number=SeqID_47305
MGYKMRKPRFEAKLIAMRAEFPQAAY

SEQ ID NO: 138991 - protein, 104 aa, Glycine max
  Coding DNA Sequence Number=SeqID_47306
MASMMDAMLGMKQLMESNAATDAAVSSAAEEDPTLPTVAHHPIPNMVGRERSTPGHISNPNPGYNRGTYPNGLPPSYHNTRSYVTTRVTFLPSSSKGSPLDILT

SEQ ID NO: 138992 - protein, 66 aa, Glycine max
  Coding DNA Sequence Number=SeqID_47307
MADEQSNDMDQGNEQVLQEINHNDLIRAAADDSDDIIEVTIPMENILPHDKDDNYIDDDESDADFF

SEQ ID NO: 138993 - protein, 58 aa, Glycine max
  Coding DNA Sequence Number=SeqID_47308
MSKRLQEDWARAAEEGPRVLMNRRVGCRNLPFGGRATRDSRDACSTKGIRAESPPTFI

SEQ ID NO: 138994 - protein, 106 aa, Glycine max
  Coding DNA Sequence Number=SeqID_47309
MSNIPDNEPCCKIENSILESTDPTVLESQSLSITTDHDRSMLALSEPTEFEFQSVSVTGDHDPLLRIPLTPTKRVSSDELDNERKNFEISPAEVSSNKLAKHSQPE

SEQ ID NO: 138995 - protein, 90 aa, Glycine max
  Coding DNA Sequence Number=SeqID_47310
MQHRDKTTSDENPEIGHIQTYQGNPCGVYPDLSSFTGSGVYPDLSSFTGSGVYPDLSSFPGSGVIQTFVACIKRSAPTQVHIIWYQSFGS

SEQ ID NO: 138996 - protein, 149 aa, Glycine max
  Coding DNA Sequence Number=SeqID_47311
MPRFEGLFEGQILSIQSLQELVQQRSIMSIEQFVEKAPQQHGPELENDHSSKASISGAINCKKRRLETRSNKATHHGPVPASADAPFPRVDPSSPQHATNSSIPVLEIHEGQTIPILPLDTSPPATPVWHLIDEKNVQIQDNQDQSQEF

SEQ ID NO: 138997 - protein, 136 aa, Glycine max
  Coding DNA Sequence Number=SeqID_47312
VASSRHPVDPKEPNRALGFPALVTGLCQSYRAPVPPASSCYRDIGITPARHSVDPEKSNRVLELPALITGLCRFYGVPVAPSKVIRPPTNRAFIKKYCAPRQAQGETPQQPGDGRQRATDAPPPPLEFTSAHPQKG

SEQ ID NO: 138998 - protein, 130 aa, Glycine max
  Coding DNA Sequence Number=SeqID_47313
  Subcellular localization annotation: CTP_CleavageSite=37; ConfidenceScore=5.69e-01
MATPPSSPPPPPPPTGATSQSPSTLKRTRKATRLRPLATRPVGAERPMVHVDPTTRDVPEAYLGILACDKLTRKVSTTLYVKSMTLARRSGPNFFRPIETLRGRMCEKRHKPSKNKTLLLTCCLTGVMNI

SEQ ID NO: 138999 - protein, 76 aa, Glycine max
  Coding DNA Sequence Number=SeqID_47314
MAFSIPPPLLPILTTTVLWHRLMGKKVLAVSSDVHIKDFYLQLENFLSIGIGYFSCSAPTDLLVYTVIHDILFKAK

SEQ ID NO: 139000 - protein, 58 aa, Glycine max
  Coding DNA Sequence Number=SeqID_47315
MELASSVVVIFIKRELICQYGLPRKIITENGNVHGFQNPASQFHALLTKDERSRGSNQ

SEQ ID NO: 139001 - protein, 81 aa, Glycine max
  Coding DNA Sequence Number=SeqID_47316
MLPFDFRHVSELHVMCNKGCQVPRSGQTKSVHLLGLLTENKRRYISCGSVLVEGTSTRLFKENKGGYIPCGSLLVKGFLQG

SEQ ID NO: 139002 - protein, 102 aa, Glycine max
  Coding DNA Sequence Number=SeqID_47317
MVAITPARFPQPPFFGGYDSNATCAYHGGAPGHSIEHCRALKRKMFKIESRTLQGSRGNLISRIKIQGSSFQESRSRFKTQDSRIKRRLNQDKYEKVFAKTE

SEQ ID NO: 139003 - protein, 60 aa, Glycine max
  Coding DNA Sequence Number=SeqID_47318
MWWVAATSFSGNSDCAHGVWGVVMAGRGKKGCGKIYIMDTLIDNGIRGHPMRDGHSNVYK

SEQ ID NO: 139004 - protein, 82 aa, Glycine max
  Coding DNA Sequence Number=SeqID_47319
MGAKYLKVVKRELHPNNGWSPDEIRVCGMTIICLRPPLDLLFLNDKGHRLISARLSPNLRNLNDKGSRICLYAFITRLAAPE

SEQ ID NO: 139005 - protein, 169 aa, Glycine max
  Coding DNA Sequence Number=SeqID_47320
MAKFDLGVVLEFYDNAWPTEEGVRDMRSWVRGQWIPFDADALSQFLGDPLVLEEDQQCEFNQRRNRADEFDEEAIAQLLCTPGQDFTRIAAGRRVRIMRTSMTTLTQTWMTLLLSNVLPSDHNSDLPLPKCMPPTRHPLDPDKSNRALGFPALITGLCQSFGVPVNPTN

SEQ ID NO: 139006 - protein, 85 aa, Glycine max
  Coding DNA Sequence Number=SeqID_47321
  Gene Ontology: Mol. function=organic anion transmembrane transporter activity; Cellular component=integral to membrane; Biological process=organic anion transport
  Homolog annotation: Hit_ID=A4WEA9; Match level="QueryCoverage=100%, HitCoverage=18%, E-value=2e-41, Identity=96%"; Hit description =Citrate carrier protein
MDTWKIGIIPLPLFVLAGALIAIDCLGGKLPSDIVVMVATLAFFGFACGEFGKRLPIVGKLGAAAICATFIPSALVYYGLLPDVV

SEQ ID NO: 139007 - protein, 60 aa, Glycine max
  Coding DNA Sequence Number=SeqID_47322
  Subcellular localization annotation: CTP_CleavageSite=41; ConfidenceScore=5.27e-01
MVLVAAIAATLTSIISFMLIMASIIVAIFSFKAFVSAFICSCTSSTSPITLALARVRTSS

SEQ ID NO: 139008 - protein, 232 aa, Glycine max
  Coding DNA Sequence Number=SeqID_47323
MGTRGCISYNLVLAIRKLGYPMRGAPLEDELAPVISQGFNKTNVETLQKAHKAWELKAHMQGLDWLPSLRTAKREEVEAPEEDEEVLALRTKLKQAQTVKERARREEHDRNKFRGALWGSNGELKLRSKRNLSQRLCETETNMLAIISKYQEELNLATAHEHRVADKYARVYAEKEARGRVIDSLHQEATMWMDRFALTMNRSQELPRLLAKAKAMADTYSAPEEIHRLLSY

SEQ ID NO: 139009 - protein, 73 aa, Glycine max
  Coding DNA Sequence Number=SeqID_47324
MAAEWRRKRERRRHFKEKMSLEEAHHHRRPWIRAWRKKEMNEGRGREEHEILCSKGALKSEPTSIPRFSTKCA

SEQ ID NO: 139010 - protein, 247 aa, Glycine max
  Coding DNA Sequence Number=SeqID_47325
MKADMEAMKEKMATMMEAMMSMKKIMEANAVAVAATSTVAKVNPMPPSGLNQMNHPTLDMVGKDLGSTGGPHYVQIQNKHTLAPYGLPPNYTPPNVAYTPGEDVNNSTPILIEIQQPQSDHGHVSQPMGETHEIPHLNLDNFEHRLEYATEGQAVGDIPLQNTLEGPQYHPQPYPLHSTVDKNPPAMAEMEKLDHLEERLRAIEGGGDYAFANLEELFLVPNIITPPPSSRCQTLTSTRELLAPRIL

SEQ ID NO: 139011 - protein, 216 aa, Glycine max
  Coding DNA Sequence Number=SeqID_47326
  Gene Ontology: Mol. function=tetracycline:hydrogen antiporter activity; Cellular component=integral to membrane; Biological process=response to antibiotic
  Homolog annotation: Hit_ID=O21999; Match level="QueryCoverage=27%, HitCoverage=40%, E-value=1e-23, Identity=87%"; Hit description=LacZ -alpha
MGLGKDDLGNADIVDIRGNMYKNGLGYEPGMPGRRNVPSRLRADRAWPGRISQCFASAGMMSEEEVAAVGEECEGRFFEDPKDEGLTIDFDRDVSQMMNEEEEEDVLSPELERLITQEERGGSSRVDLQACKLGTGRRLQRRDWENPGVTQLNRLAAHPPFASWRNSEEARTDRPSQQLRSLNGEWRLMRYFLLTHLCGISHRIWCTLSTICSDAA

SEQ ID NO: 139012 - protein, 396 aa, Glycine max
  Coding DNA Sequence Number=SeqID_47327
  Gene Ontology: Mol. function=protein serine/threonine kinase activity; Biological process=protein amino acid phosphorylation
  Homolog annotation: Hit_ID=A5C7H2; Match level="QueryCoverage=73%, HitCoverage=43%, E-value=6e-30, Identity=27%"; Hit description =Putative uncharacterized protein
  Pfam annotation: Domain name=B_lectin; Domain location=70-174; Score =10.3; E_value=0.00027; Accession=PF01453.15; Description=D-mannose binding lectin
  Subcellular localization annotation: CTP_CleavageSite=62; ConfidenceScore=5.35e-01
MVSPQLATWPCSMVLLQIFVVAQTRSNKIIGHSLLKKTSKASWMVSPHGQSRRNIVVGDSLLAETTSNNNNLSSWVVSPLGDFAFGFVLLEDTNNFLVFIWYAKIPEKIVVWYTNGETPASKGSKDNGNFVLVDENHQGVLWETLKDPRDTLLPSQPLEKGEKLLSRFLESNFSKGRFELLLQMDGILSIHALNSPSEYANENYCETRTEESNTSSPGTRLVFEPLGFCTLGGDQRSSCQCPKWYSLLDPNHPYGSSKLDFIQGCAEDELIGRKEDVAEYDFEVLINTDWPLSDYVLLKPFTEEQSFSFPTETQRCLGKTMIPTFIVGICEIIFVEGEKGIAQRQYKWRLQSLLILSNIWEPYQSNQRKKLRNPRNLLEMLLSLFGRHVSLLRGKG

SEQ ID NO: 139013 - protein, 29 aa, Glycine max
  Coding DNA Sequence Number=SeqID_47328
MVVFLVLSKAPHPVALLGKPKEAGVEDDE

SEQ ID NO: 139014 - protein, 89 aa, Glycine max
  Coding DNA Sequence Number=SeqID_47329
  Gene Ontology: Mol. function=structural constituent of ribosome; Cellular component=ribonucleoprotein complex; Biological process =translation
  Homolog annotation: Hit_ID=O04014; Match level="QueryCoverage=85%, HitCoverage=30%, E-value=6e-15, Identity=61%"; Hit description =Ribosomal protein S6 RPS6-1
MAHGILSRHRRKKVSKAPKIQRLITPLTLQRKRARIADKKKRIAKAKSEAAEYQKLLASRLKEQRELRSESLAKRRSKLSSVAKQSATA

SEQ ID NO: 139015 - protein, 246 aa, Glycine max
  Coding DNA Sequence Number=SeqID_47330
  Gene Ontology: Mol. function=nucleotide binding; Cellular component =chromosome; Biological process=chromosome organization and biogenesis
  Homolog annotation: Hit_ID=A7PMV4; Match level="QueryCoverage=90%, HitCoverage=45%, E-value=7e-26, Identity=46%"; Hit description =Chromosome chr14 scaffold_21, whole genome shotgun sequence
MLAELLRREKHAKIKPDPDIDAYMKDVKNEAEAYMLKELSLLKWQEKATKFALDDTGGKMDELQGNVATLEENLKAERQDVKYREDFKHVNQKIKKLEDKVEKLAKVRAELKPWEKDLIEHNGKLEVVCTEAKLLNDKALKEIGTKIGNKDWNFGVDPCSGKGNWNVPDARKAFVMSSMICDCSFNHNSSCHVEKQVDLLPKLKKNVSTLEGVPRLFDLVKVQDERMKLAFFAALRNTVVTKDLDQ

SEQ ID NO: 139016 - protein, 78 aa, Glycine max
  Coding DNA Sequence Number=SeqID_47331
  Gene Ontology: Mol. function=aspartic-type endopeptidase activity; Biological process=DNA integration
  Homolog annotation: Hit_ID=A5BFY0; Match level="QueryCoverage=94%, HitCoverage=11%, E-value=5e-22, Identity=52%"; Hit description =Putative uncharacterized protein
MHVQTGIKRYNINENSPMLWHQRLGHISIERIKRLVKDGVLNTLDFADFKTCVDCIKDMDARDQKFFITFIDDFIHNI

SEQ ID NO: 139017 - protein, 119 aa, Glycine max
  Coding DNA Sequence Number=SeqID_47332
MEPEQPIQDSSGALALDLNEDQPQDDLQPLEENEHVNRTLTENVSQIVRVIVKECIDHISESIILRKLGSKQTCPKFGGVIIKVKKRLSHEVLKVTVELSSSVGLSVHPSLSAASARLA

SEQ ID NO: 139018 - protein, 139 aa, Glycine max
  Coding DNA Sequence Number=SeqID_47333
MENHWLNVQKMLHKKVTQTIHLVATCPSRASEGDAHGCAFQRRKDARSRHQRLFVENVGKTEGNRSKIKILSSGVVFTLEECISTSHVDKSGAFAPTYPPLERKSDLRSSFFIRESSDSFYLKGDHFKALDLKNDPFYL

SEQ ID NO: 139019 - protein, 923 aa, Glycine max
  Coding DNA Sequence Number=SeqID_47334
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=95%, HitCoverage=95%, E-value=0.0, Identity=47%"; Hit description=TIR
  Pfam annotation: Domain name=AAA; Domain location=219-404; Score= -42.0; E_value=0.1; Accession=PF00004.20; Description=ATPase family associated with various cellular activities (AAA)
  Pfam annotation: Domain name=LRR_1; Domain location=630-651; Score =10.1; E_value=4.1; Accession=PF00560.24; Description=Leucine Rich Repeat
  Pfam annotation: Domain name=LRR_1; Domain location=653-675; Score =11.2; E_value=2.5; Accession=PF00560.24; Description=Leucine Rich Repeat
  Pfam annotation: Domain name=LRR_1; Domain location=677-699; Score =9.6; E_value=5.1; Accession=PF00560.24; Description=Leucine Rich Repeat
  Pfam annotation: Domain name=LRR_1; Domain location=701-723; Score =8.0; E_value=10; Accession=PF00560.24; Description=Leucine Rich Repeat
  Pfam annotation: Domain name=NACHT; Domain location=218-371; Score= -32.4; E_value=0.02; Accession=PF05729.3; Description=NACHT domain
  Pfam annotation: Domain name=NB-ARC; Domain location=181-474; Score =128.5; E_value=1.9e-35; Accession=PF00931.13; Description=NB-ARC domain
  Pfam annotation: Domain name=TIR; Domain location=21-156; Score =151.6; E_value=2.1e-42; Accession=PF01582.11; Description=TIR domain
  Pfam module annotation: Pfam domain module=AAA::LRR_1::LRR_1::LRR _1::LRR_1::NACHT::NB-ARC::TIR; Domain location=219-404::630-651::653 -675::677-699::701-723::218-371::181-474::21-156
MEFASSSSPFSKSKPQFMYDVFINFRGEDTRKKFVCHIYKALSNAGINTFIDEENIQKGMTLDELMTAIEGSQIAIVVFSKTYTESTWCLRELQKIIECHENYGQRVVPVFYHIDPSHIRHQEGDFGSALNAVAERRHSGEDLKSALSNWKRVLKKATDFSGWNERDFRNDAELVKEIVNDVLTKLEYEVLPITRFPVGLESQVQEVIRFIETTTYSCIIGIWGMGGSGKTTTAKAIYNQIHRSFMDKSFIEDIREACKRDRGQIRLQKQLLSDVLKTKVEIHSIGRGTTVIENRLSKKRLLIVLDDVNKSGQLKALCGNLQWIGEGSVIIITTRDKHLFTGLKVDYVHEMKEMHANESLELLSWHAFREAKPKEDFNELARNVVAYCGGLPLALEDLGLYLTNRTTNEWRSALSKLETTPNPHVQEILKISFDGLNDEKEKDIFLDVCCFFIGKDIAYVTEILNGCGLHSDCGIPVLIDRSLIKVEKNNKLGMHNLVQEMGREIIRQSSRKKPGKRSRLWFNVEVVDVLTKNTGTEVVEGLALKFHVNSRNCFKTCAFEKMQRLRLLQLENIQLAGDYGYLSKELRWMCWQGFPSKYIPKNFNMENVIAIDLKRSNLRLVWKEPQDLASLKILNLSHSKYLTETPDFSKLRNLEKLILKDCPRLCKVHKSIGDLRNLILLNLKDCTSLGNLPRSVYKLKSVKTLILSGCSKIDKLEEDIVQMESLTTLIAKNVVVKENNAFGDVAPMLGGLGILRSVLVQCDTELQLLKLGLAINDSCDAFLPGDNDPHWLVRMGEGNSVYFTVPENCRMKGMALCVVYLTNPKNTAAECLIYVLMVNYTKCSIKIYKQDTVISFNDVDWQGIISHLEPGDKVKIFVTFGHGFVVKKTAVYLIRTLGEPSGPLTSSKRTLKCWSHYPHHSCS

SEQ ID NO: 139020 - protein, 902 aa, Glycine max
  Coding DNA Sequence Number=SeqID_47335
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=96%, HitCoverage=83%, E-value=0.0, Identity=54%"; Hit description=TIR
  Pfam annotation: Domain name=LRR_1; Domain location=565-587; Score =0.1; E_value=3e+02; Accession=PF00560.24; Description=Leucine Rich Repeat
  Pfam annotation: Domain name=LRR_1; Domain location=631-652; Score =0.8; E_value=2.2e+02; Accession=PF00560.24; Description=Leucine Rich Repeat
  Pfam annotation: Domain name=LRR_1; Domain location=654-676; Score =8.2; E_value=9.3; Accession=PF00560.24; Description=Leucine Rich Repeat
  Pfam annotation: Domain name=LRR_1; Domain location=678-700; Score =8.4; E_value=8.4; Accession=PF00560.24; Description=Leucine Rich Repeat
  Pfam annotation: Domain name=LRR_1; Domain location=702-724; Score =10.5; E_value=3.4; Accession=PF00560.24; Description=Leucine Rich Repeat
  Pfam annotation: Domain name=NACHT; Domain location=220-372; Score= -33.9; E_value=0.027; Accession=PF05729.3; Description=NACHT domain
  Pfam annotation: Domain name=NB-ARC; Domain location=187-475; Score =127.0; E_value=5.5e-35; Accession=PF00931.13; Description=NB-ARC domain
  Pfam annotation: Domain name=TIR; Domain location=21-156; Score =138.9; E_value=1.4e-38; Accession=PF01582.11; Description=TIR domain
  Pfam module annotation: Pfam domain module=LRR_1::LRR_1::LRR_1::LRR _1::LRR_1::NACHT::NB-ARC::TIR; Domain location=565-587::631-652::654 -676::678-700::702-724::220-372::187-475::21-156
MEFASSSSPFSKSKTQWMYDVFINFRGEDIRKNFVSHLHSALLHAEVKTFLDDENLLKGMKSEELIRAIEGSQIAVVVFSKTYTESSLCLRELEKIIESHETRGQRVLPIFYEVDPSDVRQQKGDFGEALKAAAQKGFSGEHLESGLSRWSQAITKAANLPGWDESNHENDAELVEGIINFVLTKLDYGLSITKFPVGLESRVEKVIGFIENQSTKVCKVGIWGMGGLGKTTIAKGIYNRIHRSFIDKSFIEDVREVCETDGRGVTLLQEQLLSDVLKTKVEITSVGKGRTMIKGRLCGKRLLIVLDDVNKFGQLKDLCGNHEWFGQGSVLIITTRDLHLLDLLKVDYVYEIEEMDENESLQLFSWHAFGQPKPREDFNELARDVVAYCGGLPLALEVLGSHLISRTETEWESALSRLKMTPNDQIQQKLRISFDDLYDHMEKHIFLDICCFFIGKDKVYVTHILNGCGLHADIGLTVLIERSLVKVEKNNKLAMHNLLREMGREIIREGSRKKLGKRSRLWFDEDVVEILTEKTGTEAIEGLALKLHSNKRYCFKADAFAEMKRLRLLQLDNVELTGDYRYLSKQLRWISWKGFSLKYIPKSFYLEGAIAIDLKHSSLRLVWKEPQVLQWLKFLNLSHSKYLKETPDFSKLPNLEKLILTDCSSLLKVHQSIGDLQNLLFINLKDCKSLSNLPRSIYKLKSLRTLILSGCSKIDTLDEDIMQMESLTTLIAENTAVKQVPFPIVSSKGIGYISIYGYEGFSHHVYLSIMRSWMLPKMNPLSCIRSFSGTSSSPIPMDMQNKNLSDLAPPISNFRSVVVQCETEIQLFNQIRTILDDVYGANFSELEITSYTSQSSNHSVKSYLIGIGDFEQVFISLSNSISEVPFFIFIYIPSLIILAINY

SEQ ID NO: 139021 - protein, 350 aa, Glycine max
  Coding DNA Sequence Number=SeqID_47336
  Gene Ontology: Mol. function=ATP binding; Cellular component =intrinsic to membrane; Biological process=defense response
  Homolog annotation: Hit_ID=Q96435; Match level="QueryCoverage=12%, HitCoverage=25%, E-value=8e-14, Identity=86%"; Hit description =Disease resistance protein homolog
  Pfam annotation: Domain name=LRRNT_2; Domain location=230-266; Score =21.7; E_value=0.0027; Accession=PF08263.3; Description=Leucine rich repeat N-terminal domain
MEEMDENESLELFSCHAFGEAKPTEDFDELARNVVAYCGGLPLALEGKSLFLSFLHFFLSPQLLHRGTAGDEGAGASTSSRHSLSLSGDSEARGRPFGTTTSPEGGNMQSKMALAYSYPRSDHSCPPATSRTPPATALFARHRSRGTALAPCTLRRTSDLSSARDGVVVDDAEAEVGMKEPMHHDAVAELEDLEGEDRTGEEDQREREESELQCIVGGCFSDDAEHWIKVEALKAIKGKLIDINGNLSNWDRGDPCTSDWTGVMCSNTTVDNDVCAVPLVVHYQLKSPGFLDFHTYVREFESFLTNGLTIHTNQLFIEHFGWEEGRLRMNLKVFPEYIGNGSSHMFTTSE

SEQ ID NO: 139022 - protein, 29 aa, Glycine max
  Coding DNA Sequence Number=SeqID_47337
MISFREAEFIKQCFPWSLTWFWREERLVF

SEQ ID NO: 139023 - protein, 112 aa, Glycine max
  Coding DNA Sequence Number=SeqID_47338
  Subcellular localization annotation: CTP_CleavageSite=72; ConfidenceScore=5.06e-01
MLLPPTQPPPLVHIPPTLPTPNPNQTLGLDPPLETTISQTLPPPTHSNIAQPLNHSPSTQPSPLSLEEHTTYAKFRKQGSIITMVITFIAKIFYRIANVSLPINTTSRIEGL

SEQ ID NO: 139024 - protein, 113 aa, Glycine max
  Coding DNA Sequence Number=SeqID_47339
MLGDGQWPREEGSKVGPVGDGVASAQHFTPLLRSNFRMNETIRPEGAAKKSLIIQDIPCQCPKCSPELLQCTTSVGTSQGPDAQLATTSDERLPATSIQFHRARWKTFMSTPA

SEQ ID NO: 139025 - protein, 254 aa, Glycine max
  Coding DNA Sequence Number=SeqID_47340
  Gene Ontology: Mol. function=ubiquitin-protein ligase activity; Cellular component=ubiquitin ligase complex; Biological process =response to abscisic acid stimulus
  Homolog annotation: Hit_ID=Q9SRS9; Match level="QueryCoverage=97%, HitCoverage=97%, E-value=2e-96, Identity=64%"; Hit description=E3 ubiquitin-protein ligase CHIP
  Pfam annotation: Domain name=TPR_1; Domain location=11-44; Score =23.1; E_value=0.0011; Accession=PF00515.19; Description =Tetratricopeptide repeat
  Pfam annotation: Domain name=TPR_1; Domain location=45-78; Score =24.6; E_value=0.00037; Accession=PF00515.19; Description =Tetratricopeptide repeat
  Pfam annotation: Domain name=TPR_2; Domain location=11-44; Score =18.7; E_value=0.023; Accession=PF07719.8; Description=Tetratricopepti de repeat
  Pfam annotation: Domain name=TPR_2; Domain location=45-78; Score =16.8; E_value=0.081; Accession=PF07719.8; Description=Tetratricopepti de repeat
  Pfam annotation: Domain name=U-box; Domain location=176-250; Score =136.5; E_value=7.5e-38; Accession=PF04564.6; Description=U-box domain
  Pfam module annotation: Pfam domain module=TPR_1::TPR_1::TPR_2::TPR _2::U-box; Domain location=11-44::45-78::11-44::45-78::176-250
MGPNAAAAKQAEKLRIDGNTYFKKDRFGAAIDAYTEAITLCPNVPVYWTNRALCHLKRNDWERVEEDSRKAIQLDSNSVKALDLGRGANPKGYMVEEIWQELAKAKYLEWERLSSKRSWELQCLKEACESALKEKHFLDFSQMEGFVDDATTSQSEQLEALERVFNTAAEADTPTEVPDYLCCRITLDIFHDPVITPSGLTYERAVILEHLQKVGKFDPITREPLDPSQLVPNLAIKEAVEAFLDKHGWAYKIE

SEQ ID NO: 139026 - protein, 43 aa, Glycine max
  Coding DNA Sequence Number=SeqID_47341
MDRRLQEDWAKDARECPRILMSLRVGYPRKVGIFSPCILGHLD

SEQ ID NO: 139027 - protein, 94 aa, Glycine max
  Coding DNA Sequence Number=SeqID_47342
MLQRTVEWILPTPTPYRLVEPVQVIEVTSFEEDPEEDPEELPPELAVDALDFLEGNEDPLPEVDSPEDVMSASEADSTEESGPGEMATSGGSSS

SEQ ID NO: 139028 - protein, 246 aa, Glycine max
  Coding DNA Sequence Number=SeqID_47343
  Homolog annotation: Hit_ID=A5BKX7; Match level="QueryCoverage=62%, HitCoverage=39%, E-value=1e-07, Identity=28%"; Hit description =Putative uncharacterized protein
MEKSSKRRKGSSSSTTTVGHHRHDPSGTLVDDWKPTYPSLDARKMVCAANANISGRLRAGSFTFECRIMHYILCRVLLPHSTNLTQATEEGLILMWTLQTRRQIDWAHLVCYRMHKALRANSPLSYPHLVTLFLKHFKVPLTNEPSVKIKRSFTVGAVAVASFGYKKYLDGQWVHKQDYQANAPDERTPSPPPRDPSPALLNDVLNEIWDLRAFVCKRFDSMDSRIIGLEDDMGFIRRCFDPPTDP

SEQ ID NO: 139029 - protein, 116 aa, Glycine max
  Coding DNA Sequence Number=SeqID_47344
MASYGVSSKFIFLLDWLIAALASALYARRNNTERRRKILQDRTTQPIPEEPQSSESSSIFLEPREPELGASMAYIMAGDQPRRVTLEDYSSSSVPQFFASIACRKFKHPILLTLIL

SEQ ID NO: 139030 - protein, 96 aa, Glycine max
  Coding DNA Sequence Number=SeqID_47345
MAYAYEASIAQEPQSEPQPQPKATPETTPQTSPVTTPILEVSEEEDGIADTDHAADMAETQITWDPWPTTAQDIPQPAQDAHSSPQDEPTAAQEEP

SEQ ID NO: 139031 - protein, 52 aa, Glycine max
  Coding DNA Sequence Number=SeqID_47346
MAAEWRRKKDDWRCHLKEKMSQEEAHHHKKSWITIVQPTNPRSSPRFSTKCA

SEQ ID NO: 139032 - protein, 139 aa, Glycine max
  Coding DNA Sequence Number=SeqID_47347
  Homolog annotation: Hit_ID=A5BXY9; Match level="QueryCoverage=79%, HitCoverage=8%, E-value=2e-10, Identity=33%"; Hit description =Putative uncharacterized protein
MWMRLSNIKLHRGGRDENTSHPFNPRYAILTESSMFDFSKLSIHKQGDGERMAKFKKYVEMLQGKKEEPPIEKLTWGVLHEVRATRHLEDKGCFTISITLGNLFIDHALLDLGASCNLMPHSFLEKIGRLNLKPTNMTL

SEQ ID NO: 139033 - protein, 119 aa, Glycine max
  Coding DNA Sequence Number=SeqID_47348
MAFLIIFLLLHSAAIKIQKAKDSIDEEDLRPTSSTWSYLKQPWITSLTWLKESIHIGIPRSHTRLNHMPIVVKIKDSQTLTTMSYFRKIFMLYVQWEAIIMCPKHDSVEVSFMMMMNQD

SEQ ID NO: 139034 - protein, 157 aa, Glycine max
  Coding DNA Sequence Number=SeqID_47349
  Gene Ontology: Mol. function=binding
  Homolog annotation: Hit_ID=A7PZ14; Match level="QueryCoverage=73%, HitCoverage=4%, E-value=3e-40, Identity=67%"; Hit description =Chromosome chr4 scaffold_39, whole genome shotgun sequence
MSHEDFQSLMIPSSVKMLKHNPEIMLESVGILLKYVNLDLILAQARHANEGRRDVALAIVQSLSPKFSNPIALDTMFNAIKAIIKGSEGRLAFPYQRVGMVNAIHELSNAPDGKYLIKYVIFFYHTTRMMGMYYYISTLTWILVHGNYTQFPATQQM

SEQ ID NO: 139035 - protein, 94 aa, Glycine max
  Coding DNA Sequence Number=SeqID_47350
MVRLLKTLRCLWMGSVKVVRGPYRECDEEPLKGEEISMKDLSLGGVMIRARLKKLQEEFNKKMTSLMNRGGNRSDRPTGAYDMAYIKSDLNWPI

SEQ ID NO: 139036 - protein, 125 aa, Glycine max
  Coding DNA Sequence Number=SeqID_47351
MTRSNPCDLQPFDPEINRTFHRLVRHSVHPGHSVHFEHSEYSDFEHSTTNFHTENMVQPPPRERTLREMAAPDFTYESLCIQYLDEGVPYVLKTGLIHLLPKFHGLAGEDPHKHLKEFHIVCSTM

SEQ ID NO: 139037 - protein, 127 aa, Glycine max
  Coding DNA Sequence Number=SeqID_47352
  Gene Ontology: Cellular component=nucleus; Biological process =regulation of transcription, DNA-dependent
  Homolog annotation: Hit_ID=A7QDZ6; Match level="QueryCoverage=74%, HitCoverage=36%, E-value=1e-30, Identity=66%"; Hit description =Chromosome chr4 scaffold_83, whole genome shotgun sequence
MKLMVYSLLVTWIWDLGDCIFLITYVNGFCSYRYQHLKLYPEDESSPQSMKKLVVVESYNEIVFPEPSEVFLAYVQNHHVVNVPRLPAVPSDTVNDKERGDSKDHPLTQWFLNFSEADELLKLAAAR

SEQ ID NO: 139038 - protein, 291 aa, Glycine max
  Coding DNA Sequence Number=SeqID_47353
  Gene Ontology: Mol. function=triacylglycerol lipase activity; Biological process=lipid metabolic process
  Homolog annotation: Hit_ID=A7R189; Match level="QueryCoverage=92%, HitCoverage=38%, E-value=4e-87, Identity=62%"; Hit description =Chromosome undetermined scaffold_341, whole genome shotgun sequence
  Pfam annotation: Domain name=Lipase_3; Domain location=12-109; Score=- 2.1; E_value=0.00078; Accession=PF01764.16; Description=Lipase (class 3)
MGFMARAKGIPALELYRLAQKKKRKLVLCGHSLGGAVAALATLAILRVIAASSSSKDNENVSIKCITFSQPPVGNAALKDYVNRKGWQQYFKSYCIPEDLVPRILSPAYFHHYNAQTLPGPSENETNSSILRKHEQGVGKPKQKDVEQLVLGVGPVQRSFWRLSRLVPLEGLRRQLSKHRERRINFVETNSLPGSLANTLIEEEVVAPQPLEIQEGSDGISLKPLPETDKHSLEVPTNGKTDTKSNVMTGDEIKWRRVPYLPSYVPFGQFFTFLLFPGVLLLHVIVYCACT

SEQ ID NO: 139039 - protein, 427 aa, Glycine max
  Coding DNA Sequence Number=SeqID_47354
MGPFGWQRGGKQLRKANKNLGRITLQKLAVLVGEPSNWILTEALMPYGSAIDTRRKQGGPTARLPTSKLARQEGYIVLLLHAIFSRCDGTGPLAPVQEMGRLSDVHELARQLDQFVIGGLKLYVNIPKYGRDTTMKGTTQPETTRYEPKQQHIARHWGQHRGASRSSLTIDIPLTDKKWFSEAWVRRMTNLTWFDRLEEDPLWDFGADITPKYLGDDMVLLLGLSDDRAERMMQEEKKYIQQIVAAMGDVVDVDNDVEEARRVDRARVVEEINRGFDSYICQRRRDLWSSEEIDSDESCFRTPTSASPVAPSDNDDMHHSQASRNTVEPRQSPLAFNTENDGVGIVKLPSGLSEDEDPEGNPSDQRVKSRMSTSSRTALCVERDGGHVGFYSRWIRWIEGCLSSACVERDGGHGTHKGGGQIGAHTT

SEQ ID NO: 139040 - protein, 37 aa, Glycine max
  Coding DNA Sequence Number=SeqID_47355
MAQKPYGNFYPNLVDYRSSLANNSMDHDRMTKRVRPT

SEQ ID NO: 139041 - protein, 69 aa, Glycine max
  Coding DNA Sequence Number=SeqID_47356
METYWISKRQKSLEKRVKSLLEWEMKKVDLGVARLLRGDLLDLQETKVVEKEGEELARVGDEEGGLGSW

SEQ ID NO: 139042 - protein, 168 aa, Glycine max
  Coding DNA Sequence Number=SeqID_47357
  Subcellular localization annotation: CTP_CleavageSite=66; ConfidenceScore=5.10e-01
MATPPSSPPLPPSTGVASHSPSTSKQFKYDLTSKWVLATNKDNVDDTVCKKYDISKEKWAQFCQSRRETLRGRMCEKRHRPSRNKTTPHVLSRGGYEYLENKLMEEKKKKQLDEAAKSRSTYTVIDPPSSIRRHVKWKMAHTKKIGQMTYEAAKEIANKIDSLEEQAS

SEQ ID NO: 139043 - protein, 292 aa, Glycine max
  Coding DNA Sequence Number=SeqID_47358
  Homolog annotation: Hit_ID=A7QYY4; Match level="QueryCoverage=95%, HitCoverage=79%, E-value=1e-117, Identity=78%"; Hit description =Chromosome undetermined scaffold_259, whole genome shotgun sequence
MNMDEESEKVAVELAAQGVIGKRVDEMESDFMMALDYMIQLAENDQDDKRKSLLEVIKETVLSHLTKKCPPHVQVIGLLCRTPKKESRHELLRRVAAGGGVFKGENELKMHIPAANLNDIANQADDLLEAMETRPVIPDRKLLARLVLIREEARNMMGGGITDERNHRGFYTLPQPEVDFLAKLVALKPGKNVLDMIRNVMQGKDEGADKSGNNDEDDTTNGDPAEFLGRPLVTGEKTLPVRPGMFLETVSKVLSGLYAGTDSGITAQHLEWVYSLSLYRFTIFSISKINVL

SEQ ID NO: 139044 - protein, 92 aa, Glycine max
  Coding DNA Sequence Number=SeqID_47359
MCFSLEVWEGITSDDLSSLGQCASNYLERFYRIFHPFMSLPQLREPPRHPPMMHDDTFIVPDPPMLPAHSAVMPQPHALAVVDPDMPQHAAA

SEQ ID NO: 139045 - protein, 139 aa, Glycine max
  Coding DNA Sequence Number=SeqID_47360
MVEEAETRRRNVPRRRSINSEKKQKHEEEAFHLTPATMAATKMKKKQKREEEAFTWEEDAESRREEEEERRRCRISKKKQKKKQKQNRPRKEEEEAGVGEKEARHSSSNPYPPKPNILVGWVQILYANSLGWVELNFLH

SEQ ID NO: 139046 - protein, 155 aa, Glycine max
  Coding DNA Sequence Number=SeqID_47361
  Subcellular localization annotation: CTP_CleavageSite=58; ConfidenceScore=5.28e-01
MDRLLVASPKAYQTQGPPLVSLDKTQDRHAPGRISKGSQNPRSSIGESHFSKSSQNPRSSIGESRVSKGLSNPSPVLDESHLSKGSSNPRMLQPYGINIGLKEDSNPVTPKAYTPKSPSEPLPPDSDNAGRVIVQFIAYNTSNFTSSVNYTLIHN

SEQ ID NO: 139047 - protein, 1027 aa, Glycine max
  Coding DNA Sequence Number=SeqID_47362
  Gene Ontology: Mol. function=transmembrane receptor activity; Cellular component=intrinsic to membrane; Biological process=innate immune response
  Homolog annotation: Hit_ID=A2Q6C2; Match level="QueryCoverage=82%, HitCoverage=96%, E-value=0.0, Identity=46%"; Hit description=TIR
  Pfam annotation: Domain name=AAA; Domain location=215-440; Score= -41.5; E_value=0.09; Accession=PF00004.20; Description=ATPase family associated with various cellular activities (AAA)
  Pfam annotation: Domain name=LRR_1; Domain location=521-543; Score =2.1; E_value=1.2e+02; Accession=PF00560.24; Description=Leucine Rich Repeat
  Pfam annotation: Domain name=LRR_1; Domain location=584-605; Score =2.2; E_value=1.2e+02; Accession=PF00560.24; Description=Leucine Rich Repeat
  Pfam annotation: Domain name=LRR_1; Domain location=607-636; Score =7.9; E_value=10; Accession=PF00560.24; Description=Leucine Rich Repeat
  Pfam annotation: Domain name=LRR_1; Domain location=638-660; Score =8.6; E_value=8; Accession=PF00560.24; Description=Leucine Rich Repeat
  Pfam annotation: Domain name=NACHT; Domain location=214-368; Score= -24.1; E_value=0.0045; Accession=PF05729.3; Description=NACHT domain
  Pfam annotation: Domain name=NB-ARC; Domain location=176-474; Score =88.0; E_value=3e-23; Accession=PF00931.13; Description=NB-ARC domain
  Pfam annotation: Domain name=TIR; Domain location=21-151; Score =108.0; E_value=2.9e-29; Accession=PF01582.11; Description=TIR domain
  Pfam module annotation: Pfam domain module=AAA::LRR_1::LRR_1::LRR _1::LRR_1::NACHT::NB-ARC::TIR; Domain location=215-440::521-543::584 -605::607-636::638-660::214-368::176-474::21-151
MEFASSSSSFPKSKSRWTYDVFINFSGEDLRKNFISHLSYALSKAGINTVLDGQQMELEELMKPEKSQISIVVFSKSYTESTWCLDELAKIIEIHETYGQRVVVVFYEIDPSHVRDQKGDFGKGLKAAARKRFSEEHLESGLSRWSQALTKAANFSGLDLKNCRDEAELVKQIVNDVLNKLEYEVRSVTKFPVGLESRVQEVIRFIENQSTKVCIIGIWGMGGVGKTTTAKAIYSQIHRRFMDKSFIESIRSVCETDSKGHVHLQEQLLSDVLNTKVKIHSIGMGTTIIEKRLSGKRVLIVLDDVNEIGQLEDLCGNCEWFGQGSVIIITTRDVGLLNLFKVDYVYKMEEMDENESLELFCLHAFGEPNPREDFNELARNVVAYCGGLPLALKVLGSNLRGRSNEEWENIAYVTDILNGCGLHADIGIPVLIERSLIKIEKNNKLGMHPLLQQMGREIIRGSSIKEPFIEPGKQSRLWFHEDVLDVLIKNTGTIAIEGLALQLHLSIRDCFKAEAFQEMKRLRLLRLDHVQLTGDYGYLSKQLRWIYWKGFPLNYIPNNFYLEGVIAIDLKHSNLKLLWKKTQWLKILNLSHSKYLTETPDFSGLPSLEKLILKDCPRLRKDCTSLSNLPREIYKLKSVETLILSGCLNIDILEEDIVQMESLTTLISDNTAVKQHLLHNDLGDLPPMLSSISNLRSFLVQCDTEFQLDKQVKAMHIVYGVNYTELENSKNYLRSDFIGIDRYQVFNTLTDDSISEEMGTIEAWRDVLLPGDNHPYWLTHTGEGHSVCFTVPEDCPLKGMALCVGYSSTPKIMATKCLISVVMGIVSHFGPGDKVKIFVLFDHGLVVKKTAVYLACDKSIGKEMEPPPSAEKFRNMLVAKELVTGLVPFGMVIADKLKVVAVVAVLLLKLLVFLVFNVMFLNSKEITIRFGRREFFYHWAVGAIQSAGIRDSIDQHEKVRDLLKVIEDQFITSDKALASTLIMKFSSLMLTSVKEERLVMEIGESSLLTTACGKKKATKSQANQKGS

SEQ ID NO: 139048 - protein, 103 aa, Glycine max
  Coding DNA Sequence Number=SeqID_47363
MSNTIRIEKFNGKNNFNLWRIKMRALLKEQRVWAYVASASVKKEVASESKEKVFVSKIEELAEQEEKAHSLILLSLSDEVLYEVANEEIASGLWLKLEKLYMT

SEQ ID NO: 139049 - protein, 57 aa, Glycine max
  Coding DNA Sequence Number=SeqID_47364
MTDEDTCPLCHDKAKSMEHAFRDCTWTDESGIWNNPIQGCMKLNHDGAYLLAVGVTS

SEQ ID NO: 139050 - protein, 21 aa, Glycine max
  Coding DNA Sequence Number=SeqID_47365
MVVFLVLSKAPHPVALLGFLK

SEQ ID NO: 139051 - protein, 88 aa, Glycine max
  Coding DNA Sequence Number=SeqID_47366
MDQSSKVYIKLEDVHDEVVKSLENLGCEVLKELPPMVVKLYEKIKTLKDNLGKEVMDSEEVIVFYFCGKVGHETHKCKDLPEKDNPSQ

SEQ ID NO: 139052 - protein, 65 aa, Glycine max
  Coding DNA Sequence Number=SeqID_47367
MHYQKRKTLDEASLLSSESETQHDHRSTSTPYGLLSKEAKRSSCAKQTVGLSAHSPLSAASTHLA

SEQ ID NO: 139053 - protein, 282 aa, Glycine max
  Coding DNA Sequence Number=SeqID_47368
KNERLSTGSLDGKKEESGFLFRAEGAPLEEELAPIIARGFNKTNVEALQKVRKAWDMVQKKDKELRGSNNGSIGGYRKWLKAHMQGLDWLSSLRTTKREEVEAPEEDEEVQALRAELEQAQIVKERFKSAALKIRKENAELRNVNIATTKALEQETKRARREEHGQNKFRRALWGSNNELKLRREERDQSRVDSLILKEELKELNLATAHEHKVADEYAQVYAKKEARGRVIDSLHQEATMWMDRFALTLNGSQELPRLLAKAKAMADTYSAPEEIHGLLNY

SEQ ID NO: 139054 - protein, 82 aa, Glycine max
  Coding DNA Sequence Number=SeqID_47369
MAPKKLSAKRSRRDTAAKGTSAAPEERRVQLRNNEYMDFQEEIARRHWTSLVTPMAKFDPDIVLEFYANAWPTEEGVRDMQS

SEQ ID NO: 139055 - protein, 118 aa, Glycine max
  Coding DNA Sequence Number=SeqID_47370
MDNAKRRRAGTQDEGRHLIGLKRCPIMAFHLRRQVEYAANMAPSNPGQQKSPRQCSARGKRQKERRPNAQLQIPPRPGKIEALEERLRAVEGLGNYPFSDLADLCLMPNIVIPPKFKY

SEQ ID NO: 139056 - protein, 15 aa, Glycine max
  Coding DNA Sequence Number=SeqID_47371
MADQQATKSKAKGRT

SEQ ID NO: 139057 - protein, 190 aa, Glycine max
  Coding DNA Sequence Number=SeqID_47372
DPCDSRWAVVLQGRTICIGHHVDGSTLDVTDMPSFSKDMPSSTVEQEEDDVYANRTDHEEGLWENIRTAMATPPTSPQQSENHPEVTLKRTRQSMRFRSLMTRFLDGPRPIVNVNPATGKGSGPHKEKFHSYLGVVAREKVLIVHANWNVVPDDLKSLIWKDILRKFDIPEGENAKKEGDVNSCSKMEAI

SEQ ID NO: 139058 - protein, 184 aa, Glycine max
  Coding DNA Sequence Number=SeqID_47373
  Homolog annotation: Hit_ID=Q8GEG1; Match level="QueryCoverage=59%, HitCoverage=81%, E-value=1e-55, Identity=92%"; Hit description =Putative uncharacterized protein
MTVKTSDTCSSRRRSQLVCKRMPGADKPVRARQRMRKEKIPHQAPFAIQAAQLLGRAIGAGLFAITPAGARGMCCKAIKLGSGPLTSITKIDAQVRGGETRQDYKDTRRFPLEAPSCALLFRPCRLPDTCPPFSLREAWRFLIAHAVGISVRCRSFAPSWAVCTNPPFSPTVAPYPVTIVLSQT

SEQ ID NO: 139059 - protein, 228 aa, Glycine max
  Coding DNA Sequence Number=SeqID_47374
  Homolog annotation: Hit_ID=A9ZFK9; Match level="QueryCoverage=28%, HitCoverage=98%, E-value=3e-11, Identity=60%"; Hit description =Putative uncharacterized protein
AHEGAFQGETPGILIVLSGFATSDLSVDFCDARQGGGAYGKTPATRPFYGSWPFAGLLLTCSLLRYPLILWITVLPPLSELIPLAAAERPSAASHWHDRFPDWKAGSERNAINGSFDVAPPPLQLRQEQKASLPGNVLVPNPTAPYPVHRVEIGRIAVAVEHNSCDLWGQEWRVVTLMKTLMLHRDGTIDGGDRSAVTVVELLKDRGFGEWIRGRRRFANGLEGSGKE

SEQ ID NO: 139060 - protein, 117 aa, Glycine max
  Coding DNA Sequence Number=SeqID_47375
MTDLVSAEDDVNLRVSTGFRTPIDEGRRRRISLLRVIRLFVLQTAKSLYWITTRVFPPVSVTQKQQKVYTDNHSGISGRQRDSKVSMTDLVSAEDYVNLRVSTGLSCVIDEGRRRRR

SEQ ID NO: 139061 - protein, 99 aa, Glycine max
  Coding DNA Sequence Number=SeqID_47376
MGDQEETQEQMKADMSALKEQMASMIEAMLGMRQIMEKNVATATTVSSAAEADPTLLATAHHPPPNTVGQERSTLGHSSNPHLGYNRVAYPYGLPPNDA

SEQ ID NO: 139062 - protein, 64 aa, Glycine max
  Coding DNA Sequence Number=SeqID_47377
RGASVTLPRCFRKQIREGFRPFFIRSSFFNGTAPLQPFYRKKGEEVQKPTARPGDDYVAQAEFL

SEQ ID NO: 139063 - protein, 79 aa, Glycine max
  Coding DNA Sequence Number=SeqID_47378
  Subcellular localization annotation: CTP_CleavageSite=25; ConfidenceScore=5.17e-01
MEVMSDSNGLNFSLGGLIQAHNISRCSKFNNGSSREIQMVHNISRRLKLSNGSFREIQMVITFHSEVQFRRITYRDARN

SEQ ID NO: 139064 - protein, 92 aa, Glycine max
  Coding DNA Sequence Number=SeqID_47379
  Subcellular localization annotation: CTP_CleavageSite=49; ConfidenceScore=5.68e-01
MKDQINTSSGDVSSTSRTSQSLTDSSHALKMASSSSSVLCQSSHSLADRCKRRKSGALNGWLAKPTDWLSEQIKISTSQTYLINLKLKGNDY

SEQ ID NO: 139065 - protein, 95 aa, Glycine max
  Coding DNA Sequence Number=SeqID_47380
MRNELIKELGKWSQDYIKLFGGTERFEQLRLSLYVDGLSKVSVDKWMDITKMRYVIASRYNVYLKDRSLSLTAYGIFVVKQFISSGKTVANCICR

SEQ ID NO: 139066 - protein, 86 aa, Glycine max
  Coding DNA Sequence Number=SeqID_47381
  Gene Ontology: Mol. function=aspartic-type endopeptidase activity; Biological process=RNA-dependent DNA replication
  Homolog annotation: Hit_ID=A2Y2J4; Match level="QueryCoverage=73%, HitCoverage=11%, E-value=1e-09, Identity=42%"; Hit description =Putative uncharacterized protein
MEGGIGPILDLTPKEEKRIKGLKSKERKVPLATLSFQGYALYWWTSFVSERRIHGNPPVKYWNDLKNALRKRHIPSYYERGLMDKL

SEQ ID NO: 139067 - protein, 151 aa, Glycine max
  Coding DNA Sequence Number=SeqID_47382
  Homolog annotation: Hit_ID=Q2HW90; Match level="QueryCoverage=84%, HitCoverage=33%, E-value=2e-12, Identity=30%"; Hit description =Putative uncharacterized protein
VTSLKELGQLMGQLQRQAFRKAYGKIWDLAMVEVSIEAIASLAQYYDQSLRCFTFGDFQLSPMVEEFEEILGFPLGGGDHTSSQARTLAARDEWVPFIDVLALLIFGGALFPNMDRLVDLAAIDAFLAYHDHKESLVVAMLADLYDTYDRR

SEQ ID NO: 139068 - protein, 119 aa, Glycine max
  Coding DNA Sequence Number=SeqID_47383
  Subcellular localization annotation: CTP_CleavageSite=87; ConfidenceScore=5.28e-01
MPRFAYRLSGSSSSHFSAPVGAHFQRDRACKTPSGPKEVQQGPGVLALITGLYRFYGVAVALNRVIRPLLTGLSSRSTTPPGKRRVRHHSRRQQTHRHHLQSSPQLIHKKAGALPTTHG

SEQ ID NO: 139069 - protein, 66 aa, Glycine max
  Coding DNA Sequence Number=SeqID_47384
LHESKGLKRSSEKWSRTRKHHAHSRHLLEDPKGQIMDKCLVKLQTKFQEDPTINKGWKAFLPRQLM

SEQ ID NO: 139070 - protein, 133 aa, Glycine max
  Coding DNA Sequence Number=SeqID_47385
MAAQLIHDHVVMECLKGVWETLEGNQRYRFRGTIRLTATSLVHPEEPARTLQQPVEWILPTPTPYRLVEPVQVIKDPEELPPEPAMDALDLPEDDEDPLPDVDSPEDIMSASEADSTEESGPRGTAISDDSSS

SEQ ID NO: 139071 - protein, 175 aa, Glycine max
  Coding DNA Sequence Number=SeqID_47386
MSASDHAIMRDRVHQPTKKSLLELSSHDSLLAQNKLLARQLEILTETLGCTICGERQGYTQGGFSGIQQGPYNQQGQWRSHPGNQFNKDQGGPSNRPIQQGPNIFQRTTKLEETLTQFMQVTMSNYKSTESALKDLEVHVGQLAKRITDKSSNSFVANTEKNPKEECKAMMTRSK

SEQ ID NO: 139072 - protein, 155 aa, Glycine max
  Coding DNA Sequence Number=SeqID_47387
MRGYRMVIRTFCQPGAHEPVDALRLTSSSAPFVILTHETNALFCAFGHPEMASPMTCGGTAWLSAPFVNQGQTSPLTRANEAVDAQRLTSSSSSFVIQGQQVRWQVEIPYGHSHLSSTEANEFDGIKMMLGQLPYPNFIWGPLFGGMQPPLDRLE

SEQ ID NO: 139073 - protein, 69 aa, Glycine max
  Coding DNA Sequence Number=SeqID_47388
  Homolog annotation: Hit_ID=Q83SY1; Match level="QueryCoverage=42%, HitCoverage=74%, E-value=5e-10, Identity=100%"; Hit description =Putative uncharacterized protein
MVHPGGFEPPTARFVAEYSIQLSYGCIGKWRGALQPLGHLTLRVLANRAFELCFRSSALRGAHITFPDL

SEQ ID NO: 139074 - protein, 207 aa, Glycine max
  Coding DNA Sequence Number=SeqID_47389
  Homolog annotation: Hit_ID=Q2HW90; Match level="QueryCoverage=90%, HitCoverage=44%, E-value=9e-11, Identity=26%"; Hit description =Putative uncharacterized protein
MGSSQMPSLKKRFYQVKVKSLGITNLKELGKLMGQLQRKAFRKAYGEIRDLAMVEVSTEAIASLAQRPYLFSGFYPSLARISKIVQISAQELDHRKQVENGVVGIPRKYLEEKARILAGKGEWAPFIDVLALLIFGGVLFLNVDGLVDLATIDAFLAYHNHKESPVVAMLADLYGTFDRRCEKNNTRIVCCTPTLYVWLVLHLFHQE

SEQ ID NO: 139075 - protein, 266 aa, Glycine max
  Coding DNA Sequence Number=SeqID_47390
  Gene Ontology: Mol. function=hydrolase activity; Cellular component =membrane fraction; Biological process=metabolic process
  Homolog annotation: Hit_ID=Q1GY49; Match level="QueryCoverage=77%, HitCoverage=99%, E-value=1e-102, Identity=86%"; Hit description =Isochorismatase hydrolase
  Pfam annotation: Domain name=Isochorismatase; Domain location=67-230; Score=185.8; E_value=1.1e-52; Accession=PF00857.11; Description =Isochorismatase family
  Pfam annotation: Domain name=Pirin_C; Domain location=2-58; Score =16.9; E_value=5.8e-07; Accession=PF05726.4; Description=Pirin C -terminal region
  Pfam module annotation: Pfam domain module=Isochorismatase::Pirin_C; Domain location=67-230::2-58
MQREGNELVLQAQQDTVLLLLNGEPLNEPVVGHGPFVMNTWEEIDQAINDYNQGRIFIMKNKPYVRLDRDNAVVLLVDHQAGLLSLVRDIEPDRFKNNVLALADAAKFFNLPTILTTSFESGPNGPLMPELKALFPDAPYIARPGQINAWDNEDFVKAIKATGKKQLIIAGVVTEVCVAFPALAAIEEGFDVFVVTDASGTFNEITRDAAWDRMSAAGAQLMSWFGVACELHRDWRRDIEGLGTLCANHIPDYRNLMTAFNALQGK

SEQ ID NO: 139076 - protein, 80 aa, Glycine max
  Coding DNA Sequence Number=SeqID_47391
MGYASRGKHATKKLLLGKEDIVSDRCGVSRYKVKDNDECSSDESTKKGPLAKMMQKTLHGMQMGETTMECSAIRLIPPSG

SEQ ID NO: 139077 - protein, 137 aa, Glycine max
  Coding DNA Sequence Number=SeqID_47392
MSISPYGSISWDRAHKTPSGPGGAQQGPGVSNFGYESLIAPARHLVDPEKSNRVLGFPALIMGLCQFYRVPVAPNKRPQAGAGRDTTAAWGWLAEGNRCTAATSSRRPSPKPKVSKSTRSVTDKSSRVQLKTLKKRY

SEQ ID NO: 139078 - protein, 16 aa, Glycine max
  Coding DNA Sequence Number=SeqID_47393
MDARVANASAIDSLPE

SEQ ID NO: 139079 - protein, 63 aa, Glycine max
  Coding DNA Sequence Number=SeqID_47394
MVENHHEIAHDNVSEALRKRLGRWLPPSSPRRAGLLPPEGTAFCWNTLEGPSGLGCYLHTPFY

SEQ ID NO: 139080 - protein, 169 aa, Glycine max
  Coding DNA Sequence Number=SeqID_47395
MAKFDPEIVLEFYANAWPTEEGVRDMRSWVRGQWIPFDADAIGQLLGYPLVLEEGQECEYGQRRNRSDGFDEEAIAQLLCIPGQDFARTTAGRRVRIMRTNMTTLTQIWMTLLLSNILPSDHNSDLPLPKCMAPTRHPLDPDKSNRALGFPALITGLCQSSGVPIAPTK

SEQ ID NO: 139081 - protein, 38 aa, Glycine max
  Coding DNA Sequence Number=SeqID_47396
MKMLLIPHDKMNGSGMEKEEREEMPLQGEDESRRSSPP

SEQ ID NO: 139082 - protein, 185 aa, Glycine max
  Coding DNA Sequence Number=SeqID_47397
MQRYSKEFARHGMRREERTESLGEATVRDDEVKASEESDEVQALKAELERARVVEEKFKAAIVSSNSEEVKGIIMGQRHDLEGRAKACLSETEGNMWAIIDECKEKLNLAATHEQRLEDEYAKISAEREARERVIDSLHQEATVWMDRFALTLSESQELPRLLTKAKAMGDTYSAPKEIHGLLSY

SEQ ID NO: 139083 - protein, 198 aa, Glycine max
  Coding DNA Sequence Number=SeqID_47398
  Gene Ontology: Mol. function=DNA binding
  Homolog annotation: Hit_ID=A6T4T5; Match level="QueryCoverage=99%, HitCoverage=82%, E-value=1e-96, Identity=88%"; Hit description=Sugar fermentation stimulation protein homolog
  Pfam annotation: Domain name=SfsA; Domain location=1-191; Score =269.0; E_value=9.6e-78; Accession=PF03749.4; Description=Sugar fermentation stimulation protein
MTGCAAPGDTVWYSTSDNPKRKYAHTWELTETRQGAVICVNTLRANTLAKEAVLAGNIPELAGYNILKSEVKYGEENSRIDLMLQAEDRRNCYIEVKSVTLAEKEYGYFPDAVTARGQKHLRELMSVAAAGHRAVILFAVLHSAIDRFSPAHHIDAKYAQLLIEAQEKGVEILAWKAELSTKMMTLNKPIAVALTPGN

SEQ ID NO: 139084 - protein, 197 aa, Glycine max
  Coding DNA Sequence Number=SeqID_47399
MLIPRIPSLLLLREKKFMTRRPSTFTRHCSESGPCLSPSVADHPLGPATDHRLGKLLPHQLANQTRAPPRADSSFCSSAYGVLAAVSSCCSPPKGRFLRVTHPSATGNTTSRPTCMYKADSEFSSIPRHNLYPGASYSTGVRSQKYSPPTPRVIPRASYPFSIIIRSRHTNRKTYIGFRDNQARTDNFHHVKVTLYR

SEQ ID NO: 139085 - protein, 181 aa, Glycine max
  Coding DNA Sequence Number=SeqID_47400
ETPGIFIVRSGFATSDLSVDFCDARQGGGAYGKTPATRPFYADTARRSRTTERSESVSEEAEERPIRKPPLPARNSYDHDYEFELGYPLISVFSIPTVFAIRVVVGRNMFRFTFVTDLASNADAVLNWNRSSRRRGIACSVTEPDNGSDEKVLSLGISSLSLTDIKLHKLEFDEMKTFDLN

SEQ ID NO: 139086 - protein, 275 aa, Glycine max
  Coding DNA Sequence Number=SeqID_47401
MKRTRKTSRLRSLSTRPPGAERPVVHVDPATGKADSPHRKKLRTYLGIVARDKVDVTYENWKEVPTAQKDLIWEDIQRLLTVGRKGSYYRPSGRDGGSLNQTSRGNGPLQPIRTVLRTLSLFFKKAHAIQNQNTAPHILSRGGYDYLEQKLLDEKTKKKLEEAAQSGSVDGVIDPPSPVRRHVKWKMARTKKTGEMTTEAAKEIAEKIIPLRSRPHRDPSSPMDVKMLSPLLLDVQSTLDVSVLLEPVSPSSNTLDRLHGRPAVLPLCLLMNCSS

SEQ ID NO: 139087 - protein, 248 aa, Glycine max
  Coding DNA Sequence Number=SeqID_47402
QHYRNEAVVVVAAPRLQKYSSFDDQSGEKPLLLPIQSLKSRSSEEDIDVQSLNMSMSSKRFSSYSNRKAEVEVVDVDVDVDVQYLNRSTTFKRSTISQGFSSNSNRKTEVIMLSSNTYVIMLSLNTEDSVRKKGFYKSCPPPPPPTMFQKSVFMKPRFDGSSNEAPSFNKELKRSFTSERTTPVGKKSHEENKSMQGTLFRSNKFMGHASVRLMSQPAEKESLLVESDDDDDDDDTETKDQDIEGGRT

SEQ ID NO: 139088 - protein, 99 aa, Glycine max
  Coding DNA Sequence Number=SeqID_47403
  Subcellular localization annotation: CTP_CleavageSite=44; ConfidenceScore=5.10e-01
MQLADKESPKKPKPLVIHFTRDAAPQNHRGSSTLSGSKSIPFPYKNSKAAPWRYAPQKPNERKEKATDIDSFSAKVTNITGLSSVTRSGHIFAVPDLPV

SEQ ID NO: 139089 - protein, 137 aa, Glycine max
  Coding DNA Sequence Number=SeqID_47404
MSLERTTRPHHQRAARPHLQRTTCPRLERATRRPLGTSYPHRCTPLFKDYTSSPSENCMSSPSVGLHALTFRGLHVLANRGLPHPHLERTTRPRQQRVARPHLERTTRPRQQRAARPHLQRTTCPRQQRATRPHLGY

SEQ ID NO: 139090 - protein, 307 aa, Glycine max
  Coding DNA Sequence Number=SeqID_47405
  Gene Ontology: Mol. function=transporter activity; Cellular component= membrane; Biological process=transport
  Homolog annotation: Hit_ID=A3HS32; Match level="QueryCoverage=99%, HitCoverage=40%, E-value=1e-105, Identity=61%"; Hit description =Putative TonB-dependent outer membrane protein
YIGFGQFTWFKTLGKHELLTGLTYRYTYYDDNTPATADPKDLNRNKPTNTNLPGIFVQDQITFDKNNTLLLGLRYDYNSLHGHIVTPRVNYKWSSDDKSNVLRVSFGNGYRVANVFTEDHAALTGAREVFFINDLRPETSWNGNLNFVKKMSVGDSFIGFDATAFYTYFNNKIVADYDTDPNKIIYDNLDGHAVSQGVSLNLDIILPIGIKILAGATAMDVYSKKDGIRTRQLFTEKFTGTWNIGYMLKNLGLTVDYTGNIYGPMRLPLLSETDPRRAYSPWWSIQNIQLTKRMGGKTEIYGGVKIS

SEQ ID NO: 139091 - protein, 245 aa, Glycine max
  Coding DNA Sequence Number=SeqID_47406
  Homolog annotation: Hit_ID=A7UQU7; Match level="QueryCoverage=93%, HitCoverage=55%, E-value=3e-14, Identity=24%"; Hit description=IMP dehydrogenase/GMP reductase, putative
  Pfam annotation: Domain name=DUF1723; Domain location=43-92; Score =60.4; E_value=6e-15; Accession=PF08330.1; Description=Protein of unknown function (DUF1723)
ERPDLKLVSHGRKVDKIGRPAPEIEGMIAATGLSPLIRCSVITTDPGLIFAFVERWHRETSTFHLPVGELTITLDDVASLLHVPITGALHKFEPLITSYAIGLLTKLLKGQTMGCSSPHVSAPLGGLYSFCQQEFNPSAALVHTYKHMNDASQASTRQVGCYITLLQHFPTVHTCVVHDAYDEGSPRAYRWLMGKAHMTGIKGAPYWRRMDALTMTDRVLRQFGFIQTVPPPPVCDSLTGDDIDD

SEQ ID NO: 139092 - protein, 49 aa, Glycine max
  Coding DNA Sequence Number=SeqID_47407
MGWPFEQRPFVHLSWYLVGLRHLMGIGLVVGTKMDGSKGKEVSGLGEGQ

SEQ ID NO: 139093 - protein, 322 aa, Glycine max
  Coding DNA Sequence Number=SeqID_47408
  Gene Ontology: Mol. function=DNA-directed DNA polymerase activity; Cellular component=delta DNA polymerase complex; Biological process =DNA replication
  Homolog annotation: Hit_ID=A4W825; Match level="QueryCoverage=75%, HitCoverage=70%, E-value=1e-106, Identity=80%"; Hit description=DNA polymerase III, delta subunit
  Pfam annotation: Domain name=DNA_pol3_delta; Domain location=81-322; Score=219.4; E_value=8.3e-63; Accession=PF06144.4; Description=DNA polymerase III, delta subunit
  Pfam annotation: Domain name=RplB; Domain location=1-64; Score=-13.5; E_value=0.00052; Accession=PF04390.3; Description=Rare lipoprotein B family
  Pfam module annotation: Pfam domain module=DNA_pol3_delta::RplB; Domain location=81-322::1-64
MAVNAAVLIPGKDIYPISTKVYRSFFDNPQTALAKDAEQQIIINEMYDKAAEQLIRKLPAIAALYPEQLRAQLNEGLRAAYLLLGNDPLLLQESLDAVRHAAAAQGFDEHHTVQLDNNTDWNALFSLCQAMSLFASRQTIQILLPENGPNAAINEQLATLVSLLHSDLLLIVRGNKLTKAQENAAWFTQLATHAVQVTCQTPEQAHLPKWVAARAMQNKLQLDDAANQLLCYCYEGNLLALAQALDRLALLWPDGKLTLPRVEQAVNDAAHFTPFHWVDALLSAKSKRALHILQQLRLEGSEPVILLRTLQRELLLLIALKR

SEQ ID NO: 139094 - protein, 159 aa, Glycine max
  Coding DNA Sequence Number=SeqID_47409
  Subcellular localization annotation: CTP_CleavageSite=32; ConfidenceScore=5.19e-01
MAEPSKKRNGTSSRSQRHSGSQETPIPSSIPSGSLFSSEEQRIRYTNLFSSRSIIDPKFIDMDLFSNESFECFQAFENSNLIPFTSLKLPVYSDLVKAFYSNLEIQEGTLMSEVYGIKMVIDQSLFYDLTKLPSEGVPFEGALIDDWKFDFSVHDARRL

SEQ ID NO: 139095 - protein, 129 aa, Glycine max
  Coding DNA Sequence Number=SeqID_47410
  Homolog annotation: Hit_ID=A8G9A3; Match level="QueryCoverage=96%, HitCoverage=95%, E-value=1e-36, Identity=56%"; Hit description =Putative uncharacterized protein
MKIAIVLFFTLTLISALVQYLYYRRYKKEFSEFYQRYVQSAHPLPPFVIFADNLGLLGVSIKAQWFRWILNGRKIKIGKNAFLSPKTYEFVNENTSQRLKNWLRKDFILSVLKMGCLALMCIFAFLSKA

SEQ ID NO: 139096 - protein, 81 aa, Glycine max
  Coding DNA Sequence Number=SeqID_47411
MQSQGLALPPEPMVGPSGPRVSTKESCVDPSGIDPKTGDSDKCGLYIEANPPRLVALGRVYEGSTVHNIPLLPGQVKVVLR

SEQ ID NO: 139097 - protein, 126 aa, Glycine max
  Coding DNA Sequence Number=SeqID_47412
  Subcellular localization annotation: CTP_CleavageSite=93; ConfidenceScore=5.15e-01
MTLLLSNILPSDRNADLPLRKDRAHKTPSGPGKVQQGPRVSSSGYGPLSVLQGARTPPPPARGCARRTPGGPKEVQQGPGVSSSDYGPLSVLRSARRPNKVIRPRINRAFIKKYCAPRRAQGETPQ

SEQ ID NO: 139098 - protein, 81 aa, Glycine max
  Coding DNA Sequence Number=SeqID_47413
MVGYTPSSFIDLVFASKKIEVDLKRGKFNHPAWTNEKTGANKEGEDDVFRHFTEHLVGACLGINSKRTGTMWHAPLLQNAL

SEQ ID NO: 139099 - protein, 300 aa, Glycine max
  Coding DNA Sequence Number=SeqID_47414
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=45%, E-value=1e-151, Identity=77%"; Hit description =Photosystem I P700 chlorophyll a apoprotein A1
  Pfam annotation: Domain name=PsaA_PsaB; Domain location=1-300; Score =137.9; E_value=2.8e-38; Accession=PF00223.10; Description =Photosystem I psaApsaB protein
AWLSDPTHIRPSAQVVWPIVGQEILNGDVGGGFRGIQITSAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNW

SEQ ID NO: 139100 - protein, 19 aa, Glycine max
  Coding DNA Sequence Number=SeqID_47415
EVILGHFPTSNDTPNVQDR

SEQ ID NO: 139101 - protein, 52 aa, Glycine max
  Coding DNA Sequence Number=SeqID_47416
  Homolog annotation: Hit_ID=A7QMV8; Match level="QueryCoverage=98%, HitCoverage=4%, E-value=3e-10, Identity=68%"; Hit description =Chromosome chr14 scaffold_128, whole genome shotgun sequence
MVPNTIQTQFVVNAVEADKHPVILLSSSIIKFAEQCLSPEMRASVFSPRLME

SEQ ID NO: 139102 - protein, 71 aa, Glycine max
  Coding DNA Sequence Number=SeqID_47417
MFDTLKTDGEFDHFKLGNGGKMKVEDIGNTRMKLHDDTIQTFSNVRVQVYWFKVGMEGVQKETLGVVKTEK

SEQ ID NO: 139103 - protein, 93 aa, Glycine max
  Coding DNA Sequence Number=SeqID_47418
  Subcellular localization annotation: CTP_CleavageSite=41; ConfidenceScore=5.08e-01
PWSCQALITGLCQFYGVPVTSSKGIRPPTNRAFIKKYCVPRQARGETPQQPGDGRQRATDAPPSPLEFTSAHPQKAIKRPAQDVKEALLGGNL

SEQ ID NO: 139104 - protein, 18 aa, Glycine max
  Coding DNA Sequence Number=SeqID_47419
KVIRVAWWYWKKTSACEE

SEQ ID NO: 139105 - protein, 236 aa, Glycine max
  Coding DNA Sequence Number=SeqID_47420
MTTLTQTWMTLLLSNIQPSDHNSDLPLPKCQLVYAILTRMSIHVAQLIADAIYLFAGMPPTRNPLDPDKSNMALGFLALITGLCQSFGVPVAPRKVIRPPITRAFIEKYCTARQAQGGDPQAPDAQPPPPQADPAGSFDTERYLRHLVHQQAANHRAHVQTHDSLYQLSLSLQSQGFASFPCPTPDQFRAKVTWPGDWPEAQAVEAPAEAPGEAEEAREDEEMTDLLDFLGRSGAT

SEQ ID NO: 139106 - protein, 80 aa, Glycine max
  Coding DNA Sequence Number=SeqID_47421
MCFLQLGLEEEIGALFEGRFLSLGGVYGESPRYHLSQRALRGRAKERLTGALSKGGKVRGVTTNVLFVENVGKTEGNRSK

SEQ ID NO: 139107 - protein, 247 aa, Glycine max
  Coding DNA Sequence Number=SeqID_47422
MSASDHAILRDGTHQPTKKSLLELTSHDTLLAQNKLLAKQLEILTETLGHRLYHFVVKLVRQANAFLLTITLKKFISWESAEARQGQWRTHPGNQFNKDQGGSSNSPIQQGPNIFQRTTKLEETLTQFMQVTMSNHKSTESTLKNLEVQMGQLPKQIADKSSNSFGANTENNPKEECKAVMTRSKRFVEAEDEENVVDKEQLSEKTVVEFKKNYVKVKENQEKGKKIMVQNKEMEDQEKEKEREKEI

SEQ ID NO: 139108 - protein, 150 aa, Glycine max
  Coding DNA Sequence Number=SeqID_47423
MASMMEAMLGMRQLMEKNVATAAADEKGTHLGHRNPHLGYNREAYPYGLPPNYTLPVMHDDAGHAPSPILEGEPPRQPDEVHDDHREYAQGDVNFYPPIPVERPAPNTLPQHNLTAQPIFLSTEGPPSAAEDRRKLDLLKERLRAVEGFW

SEQ ID NO: 139109 - protein, 119 aa, Glycine max
  Coding DNA Sequence Number=SeqID_47424
PFISCGPFGEVIEIKETSPTNFATPLTLELLEQGSRGRVCRVKHLPLHRSRSRRCIDGVRSGLLPLPERGISKQPGEPHLFQFQRLSPIEVGSNGQSSIPPRNRFFARAVRRWFEDFDA

SEQ ID NO: 139110 - protein, 32 aa, Glycine max
  Coding DNA Sequence Number=SeqID_47425
RAGYFTPKLFGAPGKPGASLGEPGVNPFDLPF

SEQ ID NO: 139111 - protein, 127 aa, Glycine max
  Coding DNA Sequence Number=SeqID_47426
MSNFPPRISANLHQLDFAPYVSGSYNAQWNASELLHDKHMLHSCCILGKMEASFLENFFPGWCLGLSYPNFVRGPLLGDMRPFFGPCEEATWLAWASWARLGELGGNHLPYFAINRGGSEEEKGSAP

SEQ ID NO: 139112 - protein, 179 aa, Glycine max
  Coding DNA Sequence Number=SeqID_47427
MENAKHMATPMSIACYLDKDETGQLIDIKQYRGSSSTTTAASHRRQGTSGNPPAPVPPSLSSPRSSTLFSSDDQRQRYYSQFCNRVILDPKYLDLEFFDGETFYCYQVFQNSGLIDFMSLKLPYFPELVKVFYNNLKIQNGILYSEVQNIPSVIDQSLFFSLTKLPSQGVPFEGTLVDD

SEQ ID NO: 139113 - protein, 103 aa, Glycine max
  Coding DNA Sequence Number=SeqID_47428
MFLQKAVASGGSNLACLGELGGKLLPYFPINRGRSEGEKCSALLIFNRSSTFFSRSSSFFGLQPDKNNLTKHFVHKELRRSDFLITTKEYVGARETPSSTAKR

SEQ ID NO: 139114 - protein, 603 aa, Glycine max
  Coding DNA Sequence Number=SeqID_47429
  Gene Ontology: Mol. function=nucleoside-triphosphatase activity; Cellular component=spliceosome; Biological process=riboflavin biosynthetic process
  Homolog annotation: Hit_ID=P43329; Match level="QueryCoverage=97%, HitCoverage=45%, E-value=0.0, Identity=93%"; Hit description=ATP -dependent RNA helicase hrpA
  Pfam annotation: Domain name=DEAD; Domain location=93-250; Score= -17.3; E_value=0.00083; Accession=PF00270.20; Description=DEADDEAH box helicase
  Pfam annotation: Domain name=HA2; Domain location=477-572; Score =108.0; E_value=2.8e-29; Accession=PF04408.14; Description=Helicase associated domain (HA2)
  Pfam annotation: Domain name=Helicase_C; Domain location=325-417; Score=44.8; E_value=3.1e-10; Accession=PF00271.22; Description =Helicase conserved C-terminal domain
  Pfam annotation: Domain name=NACHT; Domain location=107-280; Score= -28.4; E_value=0.0097; Accession=PF05729.3; Description=NACHT domain
  Pfam module annotation: Pfam domain module=DEAD::HA2::Helicase _C::NACHT; Domain location=93-250::477-572::325-417::107-280
MRDFSGRALPDNVMTEQQKITFSQLYERLDGLMLRDKSRYSRRLHGAKKVKNPDAQQAILHEMAREIEQAAGKVVLREAARPAITYPENLPVSQKKQEILEAVRDHQVVIVAGETGSGKTTQLPKICMELGRGLKGLIGHTQPRRLAARTVANRIAEELQSEPGGCIGYKVRFSDHVSENTMVKLMTDGILLAEIQQDRLLMQYDTIIIDEAHERSLNIDFLLGYLKELLPRRPDLKIIITSATIDPERFSKHFNNAPIIEVSGRTYPVEVRYRPIVEEADDTERDQLQAIFDAVDELGNESAGDILIFMSGEREIRDTADALSKRDLRHTEILPLYARLSNSEQNRVFQPHGGRRIVLATNVAETSLTVPGIKYVIDPGTARISRYSYRTKVQRLPIEPVSQASANQRKGRCGRVSEGICIRLYSEDDFLSRPEFTDPEILRTNLASVILQMTALGLGDIAAFPFVEAPDKRNIQDGVRLLEELGAITTDEQATVYKLTPLGRQLSQLPVDPRLARMVLEAQKHGCVREAMIITSALSIQDPRERPMDKQQASDEKHRRFHDKESDFLAFVSLWNYLGEQQKALSSNQFRRQCRVDFLNYLR

SEQ ID NO: 139115 - protein, 138 aa, Glycine max
  Coding DNA Sequence Number=SeqID_47430
MAPKKLSTKRSRRDATGEGSSAASEFDSHCFQSAKHQQRFEAIKGWSFHRERRVQLMEDEYPDFQGEIARRHWPRLVTPMAKFDPEILVLGRPADFGGRPSSVNSARGGAKKTVSMRKPSPSYCAYRGRISPGPLQRG

SEQ ID NO: 139116 - protein, 182 aa, Glycine max
  Coding DNA Sequence Number=SeqID_47431
  Homolog annotation: Hit_ID=Q5NRP4; Match level="QueryCoverage=53%, HitCoverage=6%, E-value=3e-08, Identity=33%"; Hit description =Putative gag-pol polyprotein, identical
  Pfam annotation: Domain name=zf-CCHC; Domain location=114-131; Score =22.6; E_value=0.00058; Accession=PF00098.14; Description=Zinc knuckle
LSEELRDYYEGRHRSHLRPHSHRRENERKPQEVNIKTPYFHGKDNVEANLDWEIRVEQHLKEVYFKILWLSTLIKERPGQGILGVTPSKPKDDKGKTIEKQAPKASMQEKTSSIKCFKCLGRGHITSQCPTTKTMIMRGQDIYSRQDEATTSPSSSESEKAKGEEIYPQEEGQPLVVKEKCR

SEQ ID NO: 139117 - protein, 80 aa, Glycine max
  Coding DNA Sequence Number=SeqID_47432
  Subcellular localization annotation: CTP_CleavageSite=15; ConfidenceScore=5.11e-01
MTLFAGGRRAQKTTCSASYQAFRLTTAKKNVYTDNHSGISARQRDSNLSMTDLVSMEDDVNLRVSTGLSAAIDDGRRRRR

SEQ ID NO: 139118 - protein, 142 aa, Glycine max
  Coding DNA Sequence Number=SeqID_47433
MDLGISQSCGSAPSQEIEQIGHLLVHAGLICIAGSLCGRLPCLSLRPISGPCDLCPELIRGRAWKRRETLALQAKAELVEAVMGLHVCPVVGRLLANKMPQIPLCVNDLAGSARGGGGGASGACGSPPYACLAVQYFFMKAQ

SEQ ID NO: 139119 - protein, 53 aa, Glycine max
  Coding DNA Sequence Number=SeqID_47434
MEIKECREEEDIHKNLILVRQQPVPTSSPQMYPLLEPQRMYPPMCWDKEFSGG

SEQ ID NO: 139120 - protein, 192 aa, Glycine max
  Coding DNA Sequence Number=SeqID_47435
MTGPLHESISCFLIGWTLGNTSTYHLQRTTRPRLKGLHVLAIRGSHALAFVGLHALTFQGLQPSPSEGYTSSPSEGYTSSTIRGLHALAFRTTTSSPSEDNTSSPSAFVGLDALTFRGLHILAFRGLHVLTFRGLHVLAIRGLHVLAISGLHALAFVGLHAFTFRGLHVLTFRGLHVLAFRGLHALTFRGLH

SEQ ID NO: 139121 - protein, 78 aa, Glycine max
  Coding DNA Sequence Number=SeqID_47436
MDIHGKDSKGKGEGSNEDSQVDETETNDDLPREWKASRDNPLDNIIGDISKGEYARSRHQRLFEENVGKTGKDVVYKL

SEQ ID NO: 139122 - protein, 69 aa, Glycine max
  Coding DNA Sequence Number=SeqID_47437
MQLLSAFHVSPLSSAKLLVTRKHVILCFQIGSIRQKGKRRSRDESRHHEKAGRTKSVSYLCFPLISDER

SEQ ID NO: 139123 - protein, 150 aa, Glycine max
  Coding DNA Sequence Number=SeqID_47438
  Gene Ontology: Mol. function=microtubule motor activity; Cellular component=microtubule associated complex; Biological process =microtubule-based movement
  Homolog annotation: Hit_ID=A2Q2F8; Match level="QueryCoverage=61%, HitCoverage=14%, E-value=6e-23, Identity=63%"; Hit description =Kinesin, motor region
MLPFDFRCVTETYGLCINIFWFSGMSWNFTNCLMMGAKHLTRTKERSHVIKQRSPDEIRKKDYDIALVGAFRREKDKDMELQALRDEIQASMKLVRQREDDIQSLKMRLRFREAGIKRLQTDASEKISAETHLLKEKEEHLKEIEVLRAQ

SEQ ID NO: 139124 - protein, 159 aa, Glycine max
  Coding DNA Sequence Number=SeqID_47439
MRGAPREGSMSPFLVRDLGAQNSKTIQRIHKAWETPLRKDQELRGIRNGIIGGYHEWLKPEEDEEVQALKSELGKAKLAKEKFKLAATHIRKECAGLREENAITAKALEQETKRARKEEYGRNKFRGALWGSNNELKLRREERDQSRAHSMVLKEELMA

SEQ ID NO: 139125 - protein, 233 aa, Glycine max
  Coding DNA Sequence Number=SeqID_47440
  Gene Ontology: Mol. function=electron carrier activity; Cellular component=integral to thylakoid membrane; Biological process =electron transport
  Homolog annotation: Hit_ID=P49161; Match level="QueryCoverage=100%, HitCoverage=100%, E-value=5e-70, Identity=91%"; Hit description =Apocytochrome f precursor
  Pfam annotation: Domain name=Apocytochr_F_C; Domain location=115-233; Score=293.5; E_value=4.2e-85; Accession=PF01333.10; Description =Apocytochrome F, C-terminal
MQTRNAFSCIKEGITRSISISIMIYIIIRAPISNAYPIFAQQGYENPREATGRIVCANCHLANKPVDIEVPQAVLPDTVFEAVVRIPYDMQVKQVLANGGNRGRGQIYLDGSKSNNNVYNATAAGMVKKIIRKEKGGYEITIVDALDGREVIDIIPPGPELLVSEGESIKLDQPLTSNPNVGGFGQGDAEIVLQDPLRVQGLLFFFASIILAQIFLVLKKKQFEKVQLSEMNF

SEQ ID NO: 139126 - protein, 136 aa, Glycine max
  Coding DNA Sequence Number=SeqID_47441
  Homolog annotation: Hit_ID=A5BS59; Match level="QueryCoverage=46%, HitCoverage=7%, E-value=7e-09, Identity=45%"; Hit description =Putative uncharacterized protein
MGIPKSQIASVADILDLKTHEGGEVTFGGIGKGKISGIGKIGIPFLAFIGNILYVEEVTMELTLEMLSFDHSKKRMKFVHDHPQDQIIGDQIEGVKTRLPFKDLASCALVVEIEPKTLEEALTDDDLIIAMEEELH

SEQ ID NO: 139127 - protein, 42 aa, Glycine max
  Coding DNA Sequence Number=SeqID_47442
MENNMTCQSIVGSKEMNENTKNESKSAQMEAWGCWKESSHKL

SEQ ID NO: 139128 - protein, 162 aa, Glycine max
  Coding DNA Sequence Number=SeqID_47443
  Homolog annotation: Hit_ID=Q6WAY6; Match level="QueryCoverage=76%, HitCoverage=21%, E-value=4e-14, Identity=35%"; Hit description =Putative uncharacterized protein
MREASWDRLLASKEGASVNWFPRWKEGRTGVLILCGGFPNVPLIGTRGCISYNPVLAIIQLGYPMRGAPLEEELAPIIVRGVNNTNVEALQKVHKVWEMVQKKGKELGGSNNEPIGGYHRWLKAHMQGLGWLPSLRTTKGLEVEATEEDEEVRALRVELEKV

SEQ ID NO: 139129 - protein, 184 aa, Glycine max
  Coding DNA Sequence Number=SeqID_47444
  Gene Ontology: Mol. function=phosphoprotein phosphatase activity; Biological process=intracellular signaling cascade
  Homolog annotation: Hit_ID=A7R8Y3; Match level="QueryCoverage=94%, HitCoverage=56%, E-value=4e-23, Identity=34%"; Hit description =Chromosome undetermined scaffold_3090, whole genome shotgun sequence
MWAWERCTTLAPKRTPPVIENKPLELRWLRRGNQHIGNDDLIFLWEPYTATAMSALPPICLVGSVAWCAVVPLICFHAVEWHQPDIVLQQFGMQQPILECPSQPLNIHGLTLKGKQAKNWFQLLAPMISQWNNRAEFRIDVYPRQEGLLSFNSDYMVRYRRKMKMFVDPKNANTTTLAEVAETL

SEQ ID NO: 139130 - protein, 237 aa, Glycine max
  Coding DNA Sequence Number=SeqID_47445
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=99%, HitCoverage=35%, E-value=1e-125, Identity=82%"; Hit description =Photosystem I P700 chlorophyll a apoprotein A1
  Pfam annotation: Domain name=PsaA_PsaB; Domain location=15-237; Score= -178.5; E_value=0.00092; Accession=PF00223.10; Description =Photosystem I psaApsaB protein
SHRTSFEEWAKPGHFSRTIAKGPDTTTWIWNLHADAHDFDSHTNDLEEISRKVFSAHFGQLSIIFLWLSGMYFHGARFSNYEAWLSDPTHIRPSAQIWRASGITSELQLYCTAIGALVFAALMLFAGWFHYHKAAPKLAWFQDVESMLNHHLTGLLGLGSLSWAGHQIHVSLPINQFLNAAVDPKEIPLPHEFILNRDLLAQLYPSFAEGATPFFTLNWSKYAEFLTFRGGLDPVTG

SEQ ID NO: 139131 - protein, 139 aa, Glycine max
  Coding DNA Sequence Number=SeqID_47446
  Subcellular localization annotation: CTP_CleavageSite=62; ConfidenceScore=5.53e-01
MPISPNRSISWSVPSRHRGSAHKTPGGAQQGPGVSSSGYGPLGSARKTPSGPRGAQQGPGVSSSGYGPLSVLQGARSPQQRIAPARHLVDPKKSNRVLELPALIMGLCQFYRVSVAPNKVIRPPTNRAFIKKYCALRQA

SEQ ID NO: 139132 - protein, 81 aa, Glycine max
  Coding DNA Sequence Number=SeqID_47447
  Gene Ontology: Mol. function=aspartic-type endopeptidase activity; Biological process=DNA integration
  Homolog annotation: Hit_ID=Q60D13; Match level="QueryCoverage=96%, HitCoverage=11%, E-value=3e-13, Identity=47%"; Hit description =Putative gag and pol polyprotein, identical
MESEMITLATASEEASWLRSLLAEIPLWERPIPVVLIHCDRAVRVDHVCTDDNLADPLTKGLAREKVHYISKRMGLLPLLR

SEQ ID NO: 139133 - protein, 78 aa, Glycine max
  Coding DNA Sequence Number=SeqID_47448
MGVQIAPMPTWALQNIPPECGCYWRKQPGSPGRAGRQPPPLFCYKIGEEVKKKRESRKGFDRSSTFFIRSSSFFDLQR

SEQ ID NO: 139134 - protein, 75 aa, Glycine max
  Coding DNA Sequence Number=SeqID_47449
MAFRTTCMAVLKMARNVFAPCPYFRNLHGRKLKGLLVIIPKVVISLLTVSRGIIPFEEHIAVVGTTSNNTLSKMF

SEQ ID NO: 139135 - protein, 97 aa, Glycine max
  Coding DNA Sequence Number=SeqID_47450
MVQVCTIKFRTAYPNFMKIQWLQCEGFSSKLRCNIEIPNGENSQNWVANMVLKFHDDPTVNVSKIVVFLRQVWWTAGKRKGFERRKGKTKMRPKRAT

SEQ ID NO: 139136 - protein, 90 aa, Glycine max
  Coding DNA Sequence Number=SeqID_47451
MGVQIAPSHWALQIFLQKAVASGGSNLARLGELGGNHLPYFAINRGGSEEGRAEALPKRFRNVFREEFRKSFNRSSTFFIRSSSFFDLQR

SEQ ID NO: 139137 - protein, 60 aa, Glycine max
  Coding DNA Sequence Number=SeqID_47452
MPKDRGTCLDFRDCHHQKRGDCRQRIKLNALMMPKFHMRLKALFKTKKLKIFKMDDQDNL

SEQ ID NO: 139138 - protein, 177 aa, Glycine max
  Coding DNA Sequence Number=SeqID_47453
MEDGFSQGSVPIILGRPFMKTARTKIDVYADTLSMEFGDITIFLYFVLKPLDHVVDEYMTDLYSNLHASHSSCIESEIVLDHMSEFDAESESETNIDCMSGGGVLPLKIDFIESDRTNHVSGSTHTSDFLYEVKAEKASPSTTVQPTTPELKPLPSNLNTLTWMIAEFSSDYICLPF

SEQ ID NO: 139139 - protein, 162 aa, Glycine max
  Coding DNA Sequence Number=SeqID_47454
  Pfam annotation: Domain name=zf-CCHC; Domain location=47-64; Score =21.5; E_value=0.00084; Accession=PF00098.14; Description=Zinc knuckle
MALTLIQRKDQGQGILGVRPSKPKDDKGKTIEKQPLKASMQEKTISMKCFKCLGRGHITSQCPTKKTMIMRGQDIYSSQDEATTSPSSSKSEEAKGEESSEEIYPQEEGQPLMVKEECKEVLLGTKSPQIGGVMNALGGATLVCKITRAPNIFMICVHRDSL

SEQ ID NO: 139140 - protein, 81 aa, Glycine max
  Coding DNA Sequence Number=SeqID_47455
MVCFGGKFGSECFGLSLFLFLFSVGRESRQHTGFELAIKGKGPLQVVACRTAGHDVCQGVGLASGSGIKGMSHIISMTHMQ

SEQ ID NO: 139141 - protein, 103 aa, Glycine max
  Coding DNA Sequence Number=SeqID_47456
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=80%, HitCoverage=24%, E-value=2e-35, Identity=77%"; Hit description =Acetyl-coenzyme A carboxylase carboxyl transferase subunit beta
MGSSDRIELSIDSGTWNPMDEDMVSLDPIEFHSEEEPYKDRIDSYQRKTGLTEAVQTVWGSAVGEKITRLVEYATNQLLPLILGMCVRRSAYARRKFELDPNG

SEQ ID NO: 139142 - protein, 387 aa, Glycine max
  Coding DNA Sequence Number=SeqID_47457
  Homolog annotation: Hit_ID=Q6WAY6; Match level="QueryCoverage=43%, HitCoverage=37%, E-value=3e-16, Identity=30%"; Hit description =Putative uncharacterized protein
MASQEKWGPFADILALLIFGVVLFPNVGSLVDLAAIDAFLAYHHSKESSVVAILADLFDTFDRSAINWFPRWKEGKEGVLFSCGDYPNVPLIGTRGCINYNPALAIRQLGYPMRGAPTEESLSPFLVRDLGAQGLKVIQRIHKAWRSPLRKDKELRGIRNGVIGGYHGWLRIHTRGLDWLSKLKVIDEENFEALEEDEEVRALKLELGKARLAKDKFKSAATHIRKECTELQEENAATARALEQETKRARKEEYGREKFRGALWGSKNELKLRREERDRSRVHGMILKEELVACASSKRSLAQHLEATEQSMLAIIGQYKEELNQSMAHEQKLVEDFAQVYAEKEARGRVIDALHQEATIWMDRFALTLNGSQDLPRLLAKAKAMAE

SEQ ID NO: 139143 - protein, 134 aa, Glycine max
  Coding DNA Sequence Number=SeqID_47458
MAYVDDVIGVSVDKVIDGKAEVPFPTSEIKYVRQALNIFIAWPTPLVKLDSAISPKKVAEAVDGVKDVVVDDPLRELIKCLVDIYDNPIQFVWDGSKFGIPNVDSTLFFTYADVNEITTGDKWLNIAILQLWTM

SEQ ID NO: 139144 - protein, 172 aa, Glycine max
  Coding DNA Sequence Number=SeqID_47459
MERRFPPTCPGILWKHYESPESHFSTKEGGACRLSRPDLFASGRPSSSRYHRTCSPLADEDADNHEMTTLVSACYRTLESDGRNETFSQSRPEDADISEKGKVQMTMLVSACYQTLESEGRKETFSWSRPEDADISMKGADDYPEDADISLKGVEDHVGLCMLPDPWVMIAK

SEQ ID NO: 139145 - protein, 102 aa, Glycine max
  Coding DNA Sequence Number=SeqID_47460
MEHIILIAKKAQEYNCNETRAGRGVEAKLHGESKVIQRTIQENPRSIKNNSRLQDKNQEEFKTQEESLESRIKNQDSRFKISRIKIKIQDSRLKNQEKAQSR

SEQ ID NO: 139146 - protein, 142 aa, Glycine max
  Coding DNA Sequence Number=SeqID_47461
MAHTKKTGEMTTEAAKEIAEKIGTQGSFIPHGRQDVLTAAIGRPEHLGRVCAAGAGVTIKQYFGSAPRTSRSSSFLPPEELQQLTQQIRDQLEESITEKVTRQLMALFSQMQSQMQSQGLALPPEPLVGPLRSSSEHKGELY

SEQ ID NO: 139147 - protein, 99 aa, Glycine max
  Coding DNA Sequence Number=SeqID_47462
MSQHISVTLWILPYNYLKAIINSALKGLDDAPQPKSKATARWIVVKCNRQKGSTECGYYVMHWMSTIILGSFSNNWKAIIRAREIKGTSDLVGTVLSPS

SEQ ID NO: 139148 - protein, 43 aa, Glycine max
  Coding DNA Sequence Number=SeqID_47463
MATKGGVVDKSEALAPTYPPMRNSDLLRGEKKGSLAHGILVGN

SEQ ID NO: 139149 - protein, 27 aa, Glycine max
  Coding DNA Sequence Number=SeqID_47464
DFVEILHRSSSFFTVLHPFFVRPSFFN

SEQ ID NO: 139150 - protein, 66 aa, Glycine max
  Coding DNA Sequence Number=SeqID_47465
MTFMGLRRINGEWRIGVQRYTRTSRGSRLVIGGCMNSARQWHSWGSVKETRLENCTKQSLRMAPNS

SEQ ID NO: 139151 - protein, 111 aa, Glycine max
  Coding DNA Sequence Number=SeqID_47466
  Subcellular localization annotation: CTP_CleavageSite=58; ConfidenceScore=5.35e-01
MNPKGPSSFVFSDYTKKKISLLAMNPKGRYSFVSSDSTKEQTCSLNQVDHLLKTFITKTSSKSSWKLCFYRMVELEEREVKPHREETEVVNLGIGREKKEVKVASCICTNA

SEQ ID NO: 139152 - protein, 152 aa, Glycine max
  Coding DNA Sequence Number=SeqID_47467
MALTRHPLDPDKSNRALGFPALITGLCQLFGVPVAPSKVIQPPITQAFIEKYCTQRPAQGDATQAAEAPPPHQAGPAGSFDSEQYLRHVSQGFTSFPCPTPDQFRAKVAWPGDWPEAQAGEAPVEAPGEADEAREDEEMTDVLDFLGGSGAT

SEQ ID NO: 139153 - protein, 183 aa, Glycine max
  Coding DNA Sequence Number=SeqID_47468
  Homolog annotation: Hit_ID=Q2HW90; Match level="QueryCoverage=73%, HitCoverage=32%, E-value=6e-15, Identity=33%"; Hit description =Putative uncharacterized protein
YGKIWDLARVEVSMEPIASLSQYYDQPLRCFTFEDFQLVPTVKEFEEILGYPLGGRKPYLFSGFYPSTTRVAKVVKISAQELDRANWLSFIDILALLIFGVILFPNMEGLVDLAAIDAFLAFHHGKESPVVAILAMYDTILSSCEGCPMRGVPSDESITPFIARGFSDHNARVLQGVRKAWDV

SEQ ID NO: 139154 - protein, 280 aa, Glycine max
  Coding DNA Sequence Number=SeqID_47469
MAKFDPDIVLEFYANAWPTEEGVRDMRSWVRGQWIPFDADAISQFLGYPLVLEEGQECEYGQRRNWSDGFDEEAITHLLCIPGQDFARTAAGRRVRIMHTNMTTLTQIWMTLLLNNIQPSDHNSDLPLPKCQLVYTILTWMSIHVAQLIADAIYLFAGMAPTRHPLDPDKSNRAMGFPALITGLCQSFGVPVAPSKVIQPPITRAFIEKYCTQRQAQGDAPAACRRAATSSGWAEVAWPGDWPEARAGEAPAEAPDEADEAREDEEMTNLLDFFGGSGAT

SEQ ID NO: 139155 - protein, 185 aa, Glycine max
  Coding DNA Sequence Number=SeqID_47470
  Gene Ontology: Mol. function=nucleic acid binding; Biological process= proteolysis
  Homolog annotation: Hit_ID=Q7XG75; Match level="QueryCoverage=44%, HitCoverage=14%, E-value=1e-09, Identity=39%"; Hit description=Zinc knuckle family protein
AVASILEEGTHFSNSSSPDSPSSRESAAHLPEVASMADEHQQRVTLEDYSSSSMSQFFTSIARNLFEGLPNEDPYAYLATFIEICNTVKIAGVPDEAIRLSLFLFSLAGEAKRWLHSFKGCTIYGEVHETGQCIPIEENNQEVLYMGNQQRQGYTQGGFLGFQQGPYNQQGQWRSHPGNQFNKDQ

SEQ ID NO: 139156 - protein, 201 aa, Glycine max
  Coding DNA Sequence Number=SeqID_47471
  Homolog annotation: Hit_ID=UPI00006A2939; Match level="QueryCoverage =76%, HitCoverage=75%, E-value=3e-07, Identity=27%"; Hit description =UPI00006A2939 related cluster
LDAFTFRGLHAFTFTGLHVLPIRGLHALNLRGLHVLPIRGLHVLVFGGPHRTTRPRLQRAVRPRHQRQQALTFRGLHVLTIRGLLVLAFRGLHALAIRGLHAFTIRGLHVLAITRLHVLTIRGQHALTFRGLHVLAFRGLHVHNLHRNSRPNLHRAVRPRHQRATRPNLYRARRLYLQRTTRLHLHRTTRPPHQRATRPQP

SEQ ID NO: 139157 - protein, 199 aa, Glycine max
  Coding DNA Sequence Number=SeqID_47472
  Homolog annotation: Hit_ID=UPI00006A2D9E; Match level="QueryCoverage =87%, HitCoverage=92%, E-value=9e-16, Identity=18%"; Hit description =UPI00006A2D9E related cluster
GLHVLAIRGLHALTFRGLHVFAFRGSCTFTFRGLHVLIIRGIHAFTFRGLHILAFKGIHALTFKGLHALIFKGLHALTFRGLHALTFKGLHALAFRGLHVLAFRGLHALTFRGLHALAFRGLDVLSLRGLYVLPLRGLHVFAFGGLHTLAFRGLHVPLFRRGHALAFRGRHVLAFEGLRSPSPFEGYASSLSVGSISTP

SEQ ID NO: 139158 - protein, 177 aa, Glycine max
  Coding DNA Sequence Number=SeqID_47473
  Gene Ontology: Mol. function=helicase activity; Biological process =viral genome replication
  Homolog annotation: Hit_ID=Q9LW42; Match level="QueryCoverage=94%, HitCoverage=10%, E-value=4e-36, Identity=43%"; Hit description =Helicase-like protein
MFQPQTVLDSNGYPVYHRRNDDRTISKNGVIIDNRYIVPYNAKLLKKYQTHINIEWCNQNTSITYLFKYINKGYDRVTVVFVYDANGGALENPITQNDEIKEYADCRYISPCEATWRIFCFPIHARKPAVEKLHFHLLRQHSVIYEDDDDIDDILSKPSISDSKFLAWMNNNKYFSE

SEQ ID NO: 139159 - protein, 95 aa, Glycine max
  Coding DNA Sequence Number=SeqID_47474
MSGKSVPSYEKKMQLSQEPLNKKPRGLARKSMVETNFMELYGAATVQEKLVSTFMRDKDQHVSHHQQVPRRIKSSHGPRAQSGGRVCLSVSVKGG

SEQ ID NO: 139160 - protein, 90 aa, Glycine max
  Coding DNA Sequence Number=SeqID_47475
MTSEAAKEIVEKIEQASQGSFVPHGRQDLLTAAIGRPEHPSHVRVAEVGVTIKQYFGPAERTSRTSSSIAPEELEQLTQQIRDQLEESIT

SEQ ID NO: 139161 - protein, 108 aa, Glycine max
  Coding DNA Sequence Number=SeqID_47476
MVAHNFQRFLEISSSSILNIVAVGTTNENVSSKRKTLDEASLSSSESETQHDHRSTSTSYVSMDSGLGSSSSMDSFASWKMNGNGMEKEEREEKPLQGEDESRRSLPP

SEQ ID NO: 139162 - protein, 129 aa, Glycine max
  Coding DNA Sequence Number=SeqID_47477
MEHTPIVVLAHAYDTFNLRCKKSSVDLSVPCKGIACVPKREKKIGRNSWQDPKCPLVAIYPSAEGRREGSRCERFGSCFYAWGRRETLRHWTINYLLVFDKERNVKGCSTKAGILLLCILDCDEELRPT

SEQ ID NO: 139163 - protein, 47 aa, Glycine max
  Coding DNA Sequence Number=SeqID_47478
MNKKQWKRSGRKRRRGEGRHHPLGNKPRKKELHHQELPWIRSLKRML

SEQ ID NO: 139164 - protein, 66 aa, Glycine max
  Coding DNA Sequence Number=SeqID_47479
VADSDDEGSTNLRTNPLQEGGDDAILPRRGPITRAMARGLQEDWARDVGEDPRVLMSLRIDFGSMG

SEQ ID NO: 139165 - protein, 196 aa, Glycine max
  Coding DNA Sequence Number=SeqID_47480
MLVQMKGTFYLKLVKVFYTCARADMEGNLFSTINGVEMVINALVWKVVVGLDMARIRKFEESVDGYNKMQTYRGMLLDPARNLRNFLGVGSLTTENRMLMYLITYILTLRSINHAQVTDDDLKIMYGLKSACRFIDYFNIDVSNKIVDFTKAFNEVTERHLKKLRMRFFEHKWIMAREPPAAANMDQMEEEAKDES

SEQ ID NO: 139166 - protein, 70 aa, Glycine max
  Coding DNA Sequence Number=SeqID_47481
MGQLQRQAFRKAYGIRPPKASRKWGGRNTEKIFGAIDVFLAYHNHKESPVVAMLADLYDTLDRRCEGGIL

SEQ ID NO: 139167 - protein, 148 aa, Glycine max
  Coding DNA Sequence Number=SeqID_47482
  Homolog annotation: Hit_ID=A5AZ88; Match level="QueryCoverage=47%, HitCoverage=7%, E-value=2e-07, Identity=39%"; Hit description =Putative uncharacterized protein
MKLWDEVVENLLKKYFPKLKTAEGKVAISSFHQLPDESLSEALERFRGLLRKTPTHDGLRPQSKQLLDASTGGCTLCGGAHESGCCIPNQKKIAHEVNYMGNQPRGNFNTSGFPRFQNNQQYQQQRQWQNHPGNQFNRDQGGSSTRPQ

SEQ ID NO: 139168 - protein, 83 aa, Glycine max
  Coding DNA Sequence Number=SeqID_47483
MKHLKTYQGNPCGVYLDLSSFTGSGVYPDLSSFTGSGVYPDLSSFIGSGVYPDLSSFTGSGVYPDLSSFTGSGVIQISGTCIK

SEQ ID NO: 139169 - protein, 187 aa, Glycine max
  Coding DNA Sequence Number=SeqID_47484
  Homolog annotation: Hit_ID=Q2HW90; Match level="QueryCoverage=69%, HitCoverage=31%, E-value=1e-07, Identity=26%"; Hit description =Putative uncharacterized protein
MGSSQKPSLKKRFYQVKIKSLEVTSLRELGQLMGQLQQQAFRKAYGEIWDLARDFQLVPTVEEFEEILGFPLGGRKPYLFFGFYPSTTRVAKVVKISAPELDRVKQNRNGVVGVPRKFVLFPNMEGLVDLAVIDAFFAFHHGKKSPVVAILAMYDTFDRGCEKSGTRIVCCALALYVWLVSHLFLQE

SEQ ID NO: 139170 - protein, 22 aa, Glycine max
  Coding DNA Sequence Number=SeqID_47485
VSSRVAQGNNSKAKLNEKFTGT

SEQ ID NO: 139171 - protein, 135 aa, Glycine max
  Coding DNA Sequence Number=SeqID_47486
MLQVDSRGSPGSLLGLSHSMVAHSSLRIETSQAIYLLSQRGSLLGLSHPMVAHSSLRIETSQAIYLLSQRDLLKLEDRNFSSYLSSLSERLSTWIDSLYGGSLKLEDKDFPNYLSSLSERLFLTLRSGFTLVLDG

SEQ ID NO: 139172 - protein, 572 aa, Glycine max
  Coding DNA Sequence Number=SeqID_47487
  Gene Ontology: Mol. function=nucleoside-triphosphatase activity; Biological process=riboflavin biosynthetic process
  Homolog annotation: Hit_ID=A4WA94; Match level="QueryCoverage=100%, HitCoverage=44%, E-value=0.0, Identity=90%"; Hit description=ATP -dependent helicase HrpA
MATEKVTVYGLPVVAARKVNYSQIDPALCRELFIRHALVEGDWQTRHAFFRENLKLRAEVEELEHKSRRRDILVDDEALFEFYDQRISHDVISARHFDSWWKKASKETPDLLNFEKSMLIKEGAESVSKLDYPNFWHQGNLKLRLTYQFEPGADADGVTVHIPLPLLNQVDESGFEWQIPGLRRELVIALIKSLPKPVRRNFVPAPNYAEAFLGRVTPLELPLLDALEREFRRMTGTTIDRDDWNWDQVPDHLKISFRVVDDKNKKLLEGRSLGELKEALKGKVQETLSAVADDGIEQSGLHIWSFGQLPESYEQKRGNYKVKAWPALVDERDSVAIKLFDNPQEQQQMMWRGLRRLSAEHPVADQLGLYFNPYGKVLDLIDDCISCGVDKLIHEAGGPVWTEEGFAQLHEKVRAELNDTVVEIAKQVEQILTTVFNINKRLKGRVDMTMALGLSDVKAQMAGLVYRGFVTGNGFNRLGDTLRYLQAIEKRLEKMAIDPHRDRAQMLKVESVQQAWQQWLNKLPPARRDDEDVQGIRWMIEELRVSFFAQQLGTPYPISDKRILQAMEQISA

SEQ ID NO: 139173 - protein, 75 aa, Glycine max
  Coding DNA Sequence Number=SeqID_47488
MKMLLIPHDVSSIGASEWRMKRERRRHFKEKMSLEEAHHHKRPWIRAWRKKEMNEGRGREEHEIMCSKRALKSEV

SEQ ID NO: 139174 - protein, 377 aa, Glycine max
  Coding DNA Sequence Number=SeqID_47489
  Gene Ontology: Mol. function=oxidoreductase activity, acting on single donors with incorporation of molecular oxygen, incorporation of two atoms of oxygen; Biological process=electron transport
  Homolog annotation: Hit_ID=A8GKL6; Match level="QueryCoverage=74%, HitCoverage=100%, E-value=1e-144, Identity=89%"; Hit description =Taurine dioxygenase
  Pfam annotation: Domain name=TauD; Domain location=101-375; Score =400.1; E_value=3.4e-117; Accession=PF02668.7; Description=Taurine catabolism dioxygenase TauD, TfdA family
VCRGRRAQRGAGEGACRPGVGRHALAGAAFRGAAERAAGDPDRYSHRAGRRLVDAVSGDRRGVGRHRRDCGDCIWAGAGAACPAAPIDPVAWSTAMNERLNITPLGPYIGALVENVELARPLGDGQFEQLYHALLKHQVLFFRNQPITPLQQRDLAGRFGDLHIHPVYPHATDVEEIIVLDTHDDNPPDNDNWHTDVTFIDNPPLGAILAAKTLPSTGGDTLWASGIAAYEALSAPFRTLLAGLRAEHDFTKSFPEHKHRGSVEEHQRWQQAVQKNPPLLHPVVRTHPVSGRQALFVNEGFTTRIVDLAPKESDALLNFLFAHITKPEFQVRWRWQENDVAIWDNRVTQHYANADYLPQRRIMHRATILGDRPFYKA

SEQ ID NO: 139175 - protein, 81 aa, Glycine max
  Coding DNA Sequence Number=SeqID_47490
MQRLTSSFALLLILTREVRYRMVIHTFHQPGANEPVDAQRLTSSSAPFVVQGQRVRWQAEIPYDRSLLSSTKANEFNGIKM

SEQ ID NO: 139176 - protein, 101 aa, Glycine max
  Coding DNA Sequence Number=SeqID_47491
  Homolog annotation: Hit_ID=A5BP71; Match level="QueryCoverage=46%, HitCoverage=12%, E-value=2e-11, Identity=61%"; Hit description =Putative uncharacterized protein
  Pfam annotation: Domain name=zf-CCHC; Domain location=77-94; Score =13.5; E_value=0.014; Accession=PF00098.14; Description=Zinc knuckle
MFEVEEAYDPMSQRGGQKWSVNLNDCYYQCGNEDAILPSDESWTLVPDPSFIRMKGRPRSTRLRNEMDWREPSQTRQKCGRCGVQGHNRRNCPLQSNQGSC

SEQ ID NO: 139177 - protein, 136 aa, Glycine max
  Coding DNA Sequence Number=SeqID_47492
LMNQVIAFPLKNTLRKFITWEINRDKDTTKEDFQGSSKRTTKLEETLAQFTQVTMSNHKSIESTLKNLEIQVGQLAKQLAEKSSSSFGANTENNPKEECEAVMTRSRKLVAAEDKDVVALKEQFALKDTTDKKKNE

SEQ ID NO: 139178 - protein, 62 aa, Glycine max
  Coding DNA Sequence Number=SeqID_47493
MMEACLWGFYGGWIFQLQWGLLMVIFHHGDATEDKGKEVASLRSFLEKTSLRSFFEKTSLRS

SEQ ID NO: 139179 - protein, 97 aa, Glycine max
  Coding DNA Sequence Number=SeqID_47494
MESCALTHIALIVVLFIVLLRQQLRHHIHLLISKEQNKSREKLGKRKREKMKGRVRRRNGSWWPGQILGLDHLSTSHLTSPHSGTPVKLLRKEDSNK

SEQ ID NO: 139180 - protein, 147 aa, Glycine max
  Coding DNA Sequence Number=SeqID_47495
MLVSTCYHTLSLTDSKRVCAGYRIGRLRVLMDSQVMIAKGGVVDKSEAFAPTYPQFVMRNSDLHADIFGKGVDDHLVCWVSISLGVSEGRGADNRKVSPHATRLSDRWIAKMCAGYRRVSLHATELLGHSNKRWGGQQKEGFCSYVS

SEQ ID NO: 139181 - protein, 99 aa, Glycine max
  Coding DNA Sequence Number=SeqID_47496
MKRLKQSNAATAVATSTVVEADPALLTATHHPIPNIVGRERSTLGHVSNPHPGYNRGAYPYDLPPKYTPPAMHEDMGHITPLILEGEPPWHPDGVHENP

SEQ ID NO: 139182 - protein, 18 aa, Glycine max
  Coding DNA Sequence Number=SeqID_47497
MGLYFCGLPSVSPNGMQT

SEQ ID NO: 139183 - protein, 191 aa, Glycine max
  Coding DNA Sequence Number=SeqID_47498
MSSFSDGDFSSLTSYPELRRSEFLIGGYVGARASLLSTIPPFVAMTQELLCPMASRDQVLVILHPRYAEIPYGLSAPFCHPEAAGPMTSRDQRLTQSSAPFVPPGTTKSFTCGNFMVTRDSRQPRGAKLVSYADFRGPLLEDMRPFFGPCEERQVTVTRDSRQPRGAKLVSYTDFRVPLLDDMRPFFGPCE

SEQ ID NO: 139184 - protein, 99 aa, Glycine max
  Coding DNA Sequence Number=SeqID_47499
GTSFVVQVEGTSTWVVVTENKRGYISCGSVQVEGTSTWVVVTENKRGYISCGSVQVEGTFTWLFKENKGGYIRCRSLLVKAFTRLKRNLKDRRSLGDWM

SEQ ID NO: 139185 - protein, 125 aa, Glycine max
  Coding DNA Sequence Number=SeqID_47500
MSRLLTPKQQCRPSICIGEIDNKVDTAHGHDSHMCRLSMLKHNLTLDETKLELHKAKPHGQIREGADVRSCAAMIMNEGQMRISQSKGEIITFRNLNLKEPCFFPFLHEIFLIPWKNSTLVSFAF

SEQ ID NO: 139186 - protein, 105 aa, Glycine max
  Coding DNA Sequence Number=SeqID_47501
MSKSCGFGMTDPLDESISCFLKRVDPWVLIPIAFRGLHVLTLRGLHVLALRGLHVLTTRGLHALTSRGLHVLALRGLPALALGTSYPHLQRTTCPHFQRATRPHH

SEQ ID NO: 139187 - protein, 103 aa, Glycine max
  Coding DNA Sequence Number=SeqID_47502
  Subcellular localization annotation: CTP_CleavageSite=53; ConfidenceScore=5.59e-01
MYPPLFSLNNQVDVPSTSTNPKEMYLLLFSVTTTQVDVPSTCTTKDVPSNVLRQSSQAVSPLKLCKGETKDISGGRRETRKEFRRLVLGEFFLAKGEENEKDE

SEQ ID NO: 139188 - protein, 16 aa, Glycine max
  Coding DNA Sequence Number=SeqID_47503
GERKVEEMLLNWGKAK

SEQ ID NO: 139189 - protein, 199 aa, Glycine max
  Coding DNA Sequence Number=SeqID_47504
  Gene Ontology: Mol. function=acetoin dehydrogenase activity; Cellular component=cellular_component; Biological process=metabolic process
  Homolog annotation: Hit_ID=Q48436; Match level="QueryCoverage=67%, HitCoverage=52%, E-value=3e-68, Identity=94%"; Hit description =Acetoin(diacetyl) reductase
  Pfam annotation: Domain name=CSD; Domain location=138-198; Score =14.1; E_value=0.00012; Accession=PF00313.13; Description='Cold -shock' DNA-binding domain
AAIDAFRKEGHGGKIINACSQAGHTGNPELAVYSSSKFAVRGLTQTAARDLAPLGITVNAYCPGIVKTPMWAEIDRQVSEAAGKPLGYGTETFAKRITLGRLSEPEDVAACVSYLAGPDSDYMTGQSLLIDGGMVVTAMNGTITTWFKDKGFGFIKDENGDNRYFHVIKVANPDLIKKDAAVTFEPTTNNKGLSAYAVK

SEQ ID NO: 139190 - protein, 22 aa, Glycine max
  Coding DNA Sequence Number=SeqID_47505
MTLAIMNLWTLLLGNGAKFDRG

SEQ ID NO: 139191 - protein, 198 aa, Glycine max
  Coding DNA Sequence Number=SeqID_47506
MESRAPSGPFLVSRTGDAGMNRKLGYGAQLRANLDPTKGVGRLRQQDGGHGKSKSAKDARPIPRPSGARDQAPMSRRARRSLQNSRARARAERSSVQILVVVANIQMRTLKAEEGERFHVNGTLHMGKGSRQNGSVTSGKGLALRAGHGGPSPEPVGCRWTARAASAARAGRRVPVGGRIGNGPFGASSPGVEQSTQN

SEQ ID NO: 139192 - protein, 59 aa, Glycine max
  Coding DNA Sequence Number=SeqID_47507
GSRPPRHPVDPEKPNRVLGFPALITGVCQFYRVPVAPSKVIRPPTNRAFIKKYCAPRQA

SEQ ID NO: 139193 - protein, 188 aa, Glycine max
  Coding DNA Sequence Number=SeqID_47508
MEDLYKRWTEHLNSTRPRVSIPPLELSPYNQHEEERNPNLEEGSPNLEKLLTQFKETTESTQQAIANAEIQIGKLVEAQEESPANEHDSREEDKEKVEEKAHQVEEYLQVDMQPESILQVKTFPHQLIVKEERHGEYQNALSIILSLINDTSPPMIWTILPNYMRFMEFLAKRRNCKEDMFFVTFMPP

SEQ ID NO: 139194 - protein, 108 aa, Glycine max
  Coding DNA Sequence Number=SeqID_47509
RQAQGDAPQAADAPPPHQAGPAGSFDTEQYLRHLVRQQAANHRAHSQGFTSFPCPTPDQFRAEVAWPGDWPEARAGEAPTEAPDEADEAHEDKEMTDLLDFLGGSGAT

SEQ ID NO: 139195 - protein, 55 aa, Glycine max
  Coding DNA Sequence Number=SeqID_47510
MNLRGRQVEITDPLCPFYNNLDEDAVHLFFNCSKEPYVWDPIYVQSTSGTSSLFT

SEQ ID NO: 139196 - protein, 119 aa, Glycine max
  Coding DNA Sequence Number=SeqID_47511
VLYTKVSRIHRLTTTKKDSQVSSKVPTISKDNGDHTLRTTKLEETLAQFMQVTMSNHKSTESALKNHEIQNRKEECKVVVTRSRKLVAAEDEDVVALKEQVALKDTTVKKKNKVTDAMS

SEQ ID NO: 139197 - protein, 48 aa, Glycine max
  Coding DNA Sequence Number=SeqID_47512
MLAAQASSVRPGELSSPRQAQLAQASQVASSRSNSLLEEYSGGPKWAW

SEQ ID NO: 139198 - protein, 51 aa, Glycine max; identical to SEQ ID NO: 118079
  Coding DNA Sequence Number=SeqID_47513

SEQ ID NO: 139199 - protein, 290 aa, Glycine max
  Coding DNA Sequence Number=SeqID_47514
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTLRADQRLIFAKSWPRASRYQQGHQDLFILRSDLPSQWLLFLSAVPPVQLLTGWCVTAKAPPDISAGKCSGRVPFAIQAAQLLGRAIGAGLFAITPAGERGMCCKAIKLGNARVFPEFDIGQRDLSETAYKAFSNYPSHSFLPYNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139200 - protein, 103 aa, Glycine max
  Coding DNA Sequence Number=SeqID_47515
MTKSKGKDPLEGLGGPMTRARARKAKEALQQVLSILFEYKPKFQGEKSKVGFSSSCNKGPIGNLGISLLGDQMVADLLAVGGDFWLPTISVTLSHLVCFNSLG

SEQ ID NO: 139201 - protein, 87 aa, Glycine max
  Coding DNA Sequence Number=SeqID_47516
MAAQLIRDRVEMECLEGAWETLEGNTRCRFRGTIRFTATSLVHPDEPARTLQRTAEWTAPWISFVYFLGWVYLGLTVSHHYGHLCSG

SEQ ID NO: 139202 - protein, 66 aa, Glycine max
  Coding DNA Sequence Number=SeqID_47517
MTRLVSRGHFRVGPLQFLEARLMSQVYESEKDHVEGRGLDSRRSLVIGVTEKEFQLDTQLDIENHM

SEQ ID NO: 139203 - protein, 237 aa, Glycine max
  Coding DNA Sequence Number=SeqID_47518
  Homolog annotation: Hit_ID=A5C692; Match level="QueryCoverage=54%, HitCoverage=7%, E-value=2e-13, Identity=34%"; Hit description =Putative uncharacterized protein
  Pfam annotation: Domain name=DUF1497; Domain location=62-117; Score =9.4; E_value=0.079; Accession=PF07384.2; Description=Protein of unknown function (DUF1497)
MTIEESIHVTFDETNITSPRKEFLDDIADSLEDTQNEERNLKRKRDEENEDVQDDIVQENDDLPKEWKTSRNLPLDNIIGDISKGEFSIDMQSEFEMSMMAKYCKELIKRFGMENSKHLATPMNTSCYLDKGWSCCWAMASSSKPETCLLLWLYYHCDVSSIGACRPRIFFINGFLCFLEDEWQWNGERKRERRRHFKEKMSLEEAHHHRRPWIRAWRKKEMNEGRGREEHEILCSK

SEQ ID NO: 139204 - protein, 148 aa, Glycine max
  Coding DNA Sequence Number=SeqID_47519
MGTRGCISYNLVLAIRQLGYPMRGAPLEDELTPIISRGFNKTNMETLQKDKELRGSNNGPIGGYRKWLKAHVHGLDWLPSLRTAKREEVEAPEEDEEVQALRVELEQAQTVKERFKSAALKIRKENAELRDINVATTKALEHENQEGS

SEQ ID NO: 139205 - protein, 113 aa, Glycine max
  Coding DNA Sequence Number=SeqID_47520
MLRKRYGSASAWIFFTETIFLNNFERGRSAKKAEPFFFFTPPPIYSKNRGGACHPACPGEQGCFLQKQQPSGGKIWKAQLSKKLRKLTDCAKTPLFDFRHITEFHGLRKPASF

SEQ ID NO: 139206 - protein, 127 aa, Glycine max
  Coding DNA Sequence Number=SeqID_47521
MLSATEESGRASIPRPHAKCEISVLSIAIVFSQAQRMTGAKLKSTYSHYVRGIRVQWQNHLGNQFNRDQGGSSTRPQQQMPSLYDRTTKMEDTLAQFMQVSMSNQKSTESVIKNLEVQVGQLCKEVS

SEQ ID NO: 139207 - protein, 108 aa, Glycine max
  Coding DNA Sequence Number=SeqID_47522
EYRSLEQTDQWLALTFQWKLNKQRCVRERMSILSISFSIVTVDSTSDSPQISASPYQLDFTLYASGSYNAQWNAPGLLHDKHTLRSSRILRKMEVVFVIGSAVDRLCG

SEQ ID NO: 139208 - protein, 62 aa, Glycine max
  Coding DNA Sequence Number=SeqID_47523
MGLGFPQIMVFLGFNNLGSRRGFIHRSSAGAADESWIGCSGSMTGVDGWVSSGTGAGDGSGI

SEQ ID NO: 139209 - protein, 315 aa, Glycine max
  Coding DNA Sequence Number=SeqID_47524
VRGQVVRFDADTINDFLDTPVILEDGEEYTAYTRYLSTHPDPDTIAATLCTPGGRFVLNADGLPWKLLRKDMTTLAQTWSVLSYYDLAPTSHTSDVNLDRARLIYGLVSRMDMDVGSFISQQISQIAQSSTSRLGFPALITALCDIQGVVSDTLIFESLSPAINLAYVKKNCWNPADPSITFPGPRRTRTRASASAPEAPLPTQSPSQPSQRPRHPPASTSASMDMHGQMLRSLHVGQQLIMENMHRLSLHLQMDPPLTTPEAYRQRVAWPGDQPSTDRGEEPSGAAEDPAVDKDLIADLATADWGPWADLGGGS

SEQ ID NO: 139210 - protein, 124 aa, Glycine max
  Coding DNA Sequence Number=SeqID_47525
  Homolog annotation: Hit_ID=A0PAV3; Match level="QueryCoverage=30%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIRAYRVSQAHRGQPKVAGRLEIGGRDT

SEQ ID NO: 139211 - protein, 97 aa, Glycine max
  Coding DNA Sequence Number=SeqID_47526
SLADYIIIPFLTYGMLWNLTNYATMLPFDFRGVTEPYGFTLQGPNKGRMSSSKGPRTKLGYDSVLRCHEAYKASRTCTKWKLACGASMEAGSLSFNE

SEQ ID NO: 139212 - protein, 165 aa, Glycine max
  Coding DNA Sequence Number=SeqID_47527
MVKVGTSYVPINVSFRQKLAQGFPVHRDLSRALSFEHDSANGVRSQVLIRKVRRVMLHQLSDLVGFMFLSAVPPVQLLTGWSAHNSHTSIPSRTSAPSVAGPRRCANSPLHPALRLHCAAFTVGEPVPFAHSRLIGNCWEGRSVRLSLLPAGAKGGCVQRRLLVG

SEQ ID NO: 139213 - protein, 56 aa, Glycine max
  Coding DNA Sequence Number=SeqID_47528
MCIATDYNVKSIGGFTLSIHLWAWERYPTLAPSFIPPQQQNASLAYSLFGSLSLDM

SEQ ID NO: 139214 - protein, 101 aa, Glycine max
  Coding DNA Sequence Number=SeqID_47529
MSLHVLYLYAFSRFPPRDFRSVVSLVTIFQRNEHGFEAFSPHGQDHLGLPSGVETKHERQKPIKVLKDERKRGWGHDRPIVALLCAKQAGNAWASHPCTKL

SEQ ID NO: 139215 - protein, 33 aa, Glycine max
  Coding DNA Sequence Number=SeqID_47530
MDPVKYIFEKPPLTGRITRWQGMASGLCGILKQ

SEQ ID NO: 139216 - protein, 137 aa, Glycine max
  Coding DNA Sequence Number=SeqID_47531
  Homolog annotation: Hit_ID=UPI00016621D1; Match level="QueryCoverage =89%, HitCoverage=40%, E-value=8e-13, Identity=36%"; Hit description =UPI00016621D1 related cluster
MSPIFKGGHALTFRGLHTLAIRGLHVLTFVGLHALTFRGPHILTFRRLHALAIRGLHVLTFRGLHALVFRGLRVLTFRGLHVLTYRRLHALAIRGLHVLTFRVLQALAIRRMHVLTFRGLHVLTFVGQHALTFRGPH

SEQ ID NO: 139217 - protein, 279 aa, Glycine max
  Coding DNA Sequence Number=SeqID_47532
  Gene Ontology: Mol. function=3-deoxy-7-phosphoheptulonate synthase activity; Cellular component=cytoplasm; Biological process=aromatic amino acid family biosynthetic process
  Homolog annotation: Hit_ID=A4W9P2; Match level="QueryCoverage=100%, HitCoverage=78%, E-value=1e-142, Identity=90%"; Hit description=3 -deoxy-D-arabinoheptulosonate-7-phosphate synthase
  Pfam annotation: Domain name=DAHP_synth_1; Domain location=24-279; Score=402.4; E_value=6.9e-118; Accession=PF00793.11; Description =DAHP synthetase I family
MNKTDELRTARIDSLVTPAELAQRHPVSATVAEHVTASRRRIEKILNGEDPRLLVVIGPCSIHDLDAAMDYAKRLQGLRDKYQHRLEIVMRTYFEKPRTVVGWKGLISDPDLNGSYRVNHGIELARKLLLQVNELGVPTATEFLDMVTGQFIADLISWGAIGARTTESQIHREMASALSCPVGFKNGTDGNTRIAVDAIRAARASHMFLSPDKSGHMTIYQTSGNPYGHIIMRGGKKPNYHAEDIAAACESLAEFDLPEHLVVDFSHGNCQKQHRRQLD

SEQ ID NO: 139218 - protein, 321 aa, Glycine max
  Coding DNA Sequence Number=SeqID_47533
  Homolog annotation: Hit_ID=Q84VH5; Match level="QueryCoverage=100%, HitCoverage=52%, E-value=1e-120, Identity=67%"; Hit description =Envelope-like protein
  Subcellular localization annotation: CTP_CleavageSite=17; ConfidenceScore=5.29e-01
MATSPKDTASPGSPSVPSSPLSTKAPSNQEQPKFHIQPIQMIPGQAPEKLVPKRQQGVKISENPSLATSPREVDPEMDKKIRGIVSSILKNASVPDADEDKRGINREEDQASEETPAPRAPEPAPGDLIDLRSRSDEEPIANRLAPGIAERLQSRKGKTPIKRSGRIKTMAQKRSTPITPTTSRRSKVAIPSKKRKEISSSDSDDDVELDVSTSKRAKKSGRKVPGNVPDAPLDNISFHSIGNVEKWKYVYQRRLAVERELGRDALDCKETMDLIKAAGLLKTVTKLGDCYEGLVREFIVNIPSDITNRKSDDYQKVFVRG

SEQ ID NO: 139219 - protein, 67 aa, Glycine max
  Coding DNA Sequence Number=SeqID_47534
MTNEEHRTKNDVEVDYGCDSPSSRLFIGIEGTWLICSSPRRAGACLGELLLQSEVTLLTQASWLLHP

SEQ ID NO: 139220 - protein, 102 aa, Glycine max
  Coding DNA Sequence Number=SeqID_47535
MVKVGTSYVPINVSFSPKVGPGLPAHSCPSIGYQLIRNTVAQGECPGVPVERFCEEKLTGQHEYVNTDSLFQGPNWSSYRGGGRSRTSGYPPGAGIRWKSYF

SEQ ID NO: 139221 - protein, 224 aa, Glycine max
  Coding DNA Sequence Number=SeqID_47536
  Gene Ontology: Mol. function=chloramphenicol O-acetyltransferase activity; Biological process=response to antibiotic
  Homolog annotation: Hit_ID=P62577; Match level="QueryCoverage=71%, HitCoverage=73%, E-value=4e-88, Identity=96%"; Hit description =Chloramphenicol acetyltransferase
  Pfam annotation: Domain name=CAT; Domain location=6-181; Score=282.6; E_value=7.7e-82; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWMIFLRSFGLRVISCSENEKTALQGGFSKWLRPVVLLHVFPGWTQDDSYRIRRSGRTERGVRAYSPAWSELPTRN

SEQ ID NO: 139222 - protein, 70 aa, Glycine max
  Coding DNA Sequence Number=SeqID_47537
MGGKCAESPPTFIRGKRRKNRKRRGLRTLNAKGLGVVFTHGEGCFPYSYVFLNCDKEIRPMQFFQKGRIK

SEQ ID NO: 139223 - protein, 65 aa, Glycine max
  Coding DNA Sequence Number=SeqID_47538
MSVKNLVGRLEGDQSGSQYFARMLQPYGINIGLKEHSNRVTPKAYTPKSLSGSLPPDSGSIQKTF

SEQ ID NO: 139224 - protein, 242 aa, Glycine max
  Coding DNA Sequence Number=SeqID_47539
  Gene Ontology: Mol. function=RNA-directed RNA polymerase activity
  Homolog annotation: Hit_ID=A7PEI0; Match level="QueryCoverage=35%, HitCoverage=10%, E-value=6e-13, Identity=44%"; Hit description =Chromosome chr11 scaffold_13, whole genome shotgun sequence
MAISFISLLAMSVVLATCFFVHRHCIRRERPRAPLITAHQEHVLYALKTIVLVRSSGFRPVVTCMPNFFHKFNINSAPCNSIPLDSSVKKSSEFSPGELEEELFRLFLKTRFQPSYGMGVSENSWMTLMDRLLTLNNYCTNENEKERVKENMLKLIDIYYEALDAPKSGRNLEASWANVPVFPRQISPSGVVLETISPDGVVSKIITAWGSFLRACKTLTGVSEQPATPSGDMTVQSLSRRS

SEQ ID NO: 139225 - protein, 369 aa, Glycine max
  Coding DNA Sequence Number=SeqID_47540
  Gene Ontology: Mol. function=delta14-sterol reductase activity; Cellular component=integral to membrane; Biological process=steroid biosynthetic process
  Homolog annotation: Hit_ID=Q9LDR4; Match level="QueryCoverage=87%, HitCoverage=76%, E-value=1e-128, Identity=69%"; Hit description =Delta(14)-sterol reductase
  Pfam annotation: Domain name=DUF1295; Domain location=112-360; Score=- 88.2; E_value=0.0032; Accession=PF06966.3; Description=Protein of unknown function (DUF1295)
  Pfam annotation: Domain name=ERG4_ERG24; Domain location=3-369; Score= 11.7; E_value=9.5e-14; Accession=PF01222.8; Description=Ergosterol biosynthesis ERG4ERG24 family
  Pfam module annotation: Pfam domain module=DUF1295::ERG4_ERG24; Domain location=112-360::3-369
MELVYTIAAMVCSRFFCWLHFSGSVPRWVLCLPLPYQTEDLSCCPQLLPSVFLYVTLILHFSGCKSQSKGSSLKPHLSGNLIHDWWFGIQLNPQFMGIDLKFFFVRAGMMGWLLINLSILMKSIQDGTLSQSMILYQLFCALYILDYFVHEEYMTSTGLTLEVQTLGWGSICGLVEGQSQTITITPLSPKDISSAFREGRGWDIIAERLGFMLVFGDLVWIPFSFSIQGWWLLMNSVELTPAAIVANCFVFLIGYMVFRGANKQKHVFKKNPKAPIWGKPPKVIGGKLLASGYWGIARHCNYLGDLMLALSFSLPCGISSPIPYFYPIYLLILLIWRERRDEARCAEKYREIWAEYRKLVPWRILPYVY

SEQ ID NO: 139226 - protein, 518 aa, Glycine max
  Coding DNA Sequence Number=SeqID_47541
  Gene Ontology: Mol. function=transferase activity, transferring glycosyl groups; Cellular component=integral to membrane; Biological process=cell wall organization and biogenesis
  Homolog annotation: Hit_ID=A7PPK8; Match level="QueryCoverage=99%, HitCoverage=96%, E-value=0.0, Identity=73%"; Hit description =Chromosome chr8 scaffold_23, whole genome shotgun sequence
  Pfam annotation: Domain name=Glycos_transf_2; Domain location=90-265; Score=26.0; E_value=0.00014; Accession=PF00535.17; Description =Glycosyl transferase
MESFQGDRDDISYQMGLIWSQVKEPVIVPMLRVAVFLCLAMSLMMLVERVYMGIVICLVKLFSRRPEKRYKWEPMKDDVELGNSSYPMVLVQVPMYNEREVYQLSIGAACGLSWPSDRIIIQVLDDSTNPTIKELVQMECSRWASKGVNIKYEVRDNRDGYKAGALKEGMKRSYVKQCDYVAIFDADFQPEPDFLWRTVPFLVNNPELGLVQARWKFVNANECLMTRMQEMSLDYHFTVEQEVGSCTYAFFGFNGTAGVWRISALYESGGWNHRTTVEDMDLAVRASLRGWKFLYLPNLKVKNELPSTLNAYRFQQHRWSCGPANLFMKMFMEIMRNRVSLYKKIYVIYSFFFVRKVVAHLNTFMFYCIVLPATVVVPEVVVPKWGAVYIPSIITLLNAVGTPRSLHLLVFWILFENTMSLHRTKATIIGLLEGSRANEWIVTQKGKPPKSRFRISAYLSIFVVFVMNIVRIHHMLELLVGFYLFFCGCYDIMFGKNRYYIFLYIQSIAFFIMAFGYV

SEQ ID NO: 139227 - protein, 404 aa, Glycine max
  Coding DNA Sequence Number=SeqID_47542
  Gene Ontology: Mol. function=DNA binding; Cellular component =mitochondrion
  Homolog annotation: Hit_ID=A7PPL2; Match level="QueryCoverage=80%, HitCoverage=90%, E-value=3e-68, Identity=49%"; Hit description =Chromosome chr8 scaffold_23, whole genome shotgun sequence
  Pfam annotation: Domain name=AT_hook; Domain location=88-100; Score =20.3; E_value=0.0073; Accession=PF02178.10; Description=AT hook motif
  Pfam annotation: Domain name=DUF296; Domain location=162-307; Score =138.8; E_value=1.5e-38; Accession=PF03479.6; Description=Domain of unknown function (DUF296)
  Pfam module annotation: Pfam domain module=AT_hook::DUF296; Domain location=88-100::162-307
  Subcellular localization annotation: CTP_CleavageSite=39; ConfidenceScore=5.62e-01
MEPTTTLNNIINNNNTVPAGSPPPPPPPSVPQPMNMNVNMNMNVGNTEGTTPAVPTPTPAPTPAPTTMVPAVPAPTTTTPGSLDLFGKKKRGRPRKYDADGNLRVSATPPPPPGFTLSTPSSEFSSSKRGRGKHNTTFGNNNYQQLYSSFGEVFANTAGGDFVPHVVTVYTGEDVAGKIVSFAQKGPRGICILSANGAISNVTIRQPGSSGGILTYEAWSLRSKCFLKAEYQLLEEIWAKLDKLFREHLYDKKIVVADNSGMKSRTGGLSVSLAGPDGRVIGGGVAGLLTAAGPIQIVVGSFMQNGYKAQKRKYQREQQIVATPTSAGPEIVTAVRPISQTNADGENFLIPMSQMPDQNQRESVSVSSDKQNLDATPDAATWNGSEEYSDQRTSPDINISLPDE

SEQ ID NO: 139228 - protein, 146 aa, Glycine max
  Coding DNA Sequence Number=SeqID_47543
MVEHGNESTKFLLWDCECAELIGQSVDEVNRLKIEDGDVNLNVSPQALDRLLGCLLAFKVKVQPKFGNAVVLKYSPDLDLINFVLDMLPDIVVVLAIYWTFIILNLRVAMHVHMSYVEKPRQWWWCCCGLGMTALKSVLPFIYPEE

SEQ ID NO: 139229 - protein, 70 aa, Glycine max
  Coding DNA Sequence Number=SeqID_47544
  Homolog annotation: Hit_ID=A7Q9W5; Match level="QueryCoverage=70%, HitCoverage=12%, E-value=3e-07, Identity=58%"; Hit description =Chromosome chr8 scaffold_68, whole genome shotgun sequence
MSGRSYPPLFMIAGGVHGEGENENAVVFGWEGVMGMVLNGWRWRVAVDPGFPFKVLMEELWGHAGQVQFE

SEQ ID NO: 139230 - protein, 160 aa, Glycine max
  Coding DNA Sequence Number=SeqID_47545
  Gene Ontology: Mol. function=transferase activity; Cellular component= cytoplasm; Biological process=amino acid biosynthetic process
  Homolog annotation: Hit_ID=A7UQU8; Match level="QueryCoverage=92%, HitCoverage=26%, E-value=1e-56, Identity=78%"; Hit description =Homeodomain-like; Uridylate kinase
MGVQTRVQTSVAMQEFAEPYNRQRAIRHLEKGRVVIFGGIGFGAGTPLFSTDIAAALRASEPSAYIPLYLAVNAEAVLKGTNVDGVYDCNSRDNNFTFEHISFRELGSRGVTSMDMSALTFCEENAIPVVVFNLLEPGNISKALCGEQWEMLAMTEILEE

SEQ ID NO: 139231 - protein, 419 aa, Glycine max
  Coding DNA Sequence Number=SeqID_47546
  Gene Ontology: Mol. function=transferase activity; Cellular component= membrane; Biological process=metabolic process
  Homolog annotation: Hit_ID=A7PPN8; Match level="QueryCoverage=79%, HitCoverage=92%, E-value=1e-172, Identity=83%"; Hit description =Chromosome chr8 scaffold_23, whole genome shotgun sequence
  Pfam annotation: Domain name=Exostosin; Domain location=92-380; Score= 235.9; E_value=9.3e-68; Accession=PF03016.6; Description=Exostosin family
MKETEVFNVSKPEFNLAPVNKPDESHPRLKQKRKFSFLDRTEVVLAQARAAIREARNRNRTLDSDYVPTGPMYWNAKAFHRSYLEMEKQFKVFVYEEGETPVFHNGPCKSIYSMEGNFIHAIEMNDHFRTKDPKKAHVFFLPFSVVMMVRFVYERDSRDFGPIKKTVIDYVNLIATRYPYWNRSLGADHFMLACHDWGPEASFSLPYLHKNSIRVLCNANTSEGFKPAKDVSFPEINLQTGSINGFVGGPSASKRSILAFFAGGVHGPIRPILLEHWENKDEDIQVHKYLPKGVSYYGMLRKSKFCLCPSGYEVASPRVVEAIYTGCVPVLISEHYVPPFSDVLNWKSFSVELSVKDIPILKDILMSISPRQHIRMQRRVGQIRRHFEVHSPPKRFDVFHMILHSVWLRRLNFRVRDDQ

SEQ ID NO: 139232 - protein, 102 aa, Glycine max
  Coding DNA Sequence Number=SeqID_47547
  Homolog annotation: Hit_ID=Q1SN17; Match level="QueryCoverage=99%, HitCoverage=32%, E-value=6e-13, Identity=31%"; Hit description =Transposase, putative
MAKSLVGHSYVGRLTKDKKIIIVDMTKSMVKPRNILLTLKEHNANSYTTIKQIYNAKSAYLSSIRDSTYKTNRYKLPLLDFVGVTPMGMTFSVGFAYLEGEI

SEQ ID NO: 139233 - protein, 325 aa, Glycine max
  Coding DNA Sequence Number=SeqID_47548
  Homolog annotation: Hit_ID=Q2HTA0; Match level="QueryCoverage=24%, HitCoverage=13%, E-value=4e-08, Identity=42%"; Hit description=IMP dehydrogenase/GMP reductase, related
  Pfam annotation: Domain name=DUF1723; Domain location=88-137; Score =49.7; E_value=1e-11; Accession=PF08330.1; Description=Protein of unknown function (DUF1723)
MVRTKDLGRALSKVIGRALRRKDVQHVDHAIDEVHEQPQEVAADDEVVDAGLSSHGRKIQKFDRPVVEIEGLVAATRLSPLIARSLDTGDRRLISAFAEMWDKETSCFHLPVGEVTIALNDVAFLLHLPITGVFHNFETLHVDEVVLLLIKLLEVSADEANAETGCAAIWVCSEYSSTHFDVKIMLEDIDDRWIHFSKYLASVGRICVVPGQCAADYIDRDPARHPPVVQDDTYVKPDIPQYLVAAAAMKEGPTDARSHVEQLQHTVDACQAIAERLERLLNLRIVTEGTEIYRVMEDCLRIARGVTTERNVYVWSRRRRRMEDA

SEQ ID NO: 139234 - protein, 89 aa, Glycine max
  Coding DNA Sequence Number=SeqID_47549
MLLYIRVSERDTILLRPEVDVTVTERVHRHAVSADANGSDAPELHESREEVVFLDVWVEVSDREGKKKKGKRVRVTECEDLACTQTKVD

SEQ ID NO: 139235 - protein, 221 aa, Glycine max
  Coding DNA Sequence Number=SeqID_47550
  Gene Ontology: Mol. function=aspartic-type endopeptidase activity; Cellular component=cellulose and pectin-containing cell wall; Biological process=proteolysis
  Homolog annotation: Hit_ID=A7QJ96; Match level="QueryCoverage=95%, HitCoverage=35%, E-value=6e-52, Identity=53%"; Hit description =Chromosome chr8 scaffold_106, whole genome shotgun sequence
LLVIMHTCGALMGSEIELNFFDTVGSSTAALIPCSDPICTSRVQGAAAECSPRVNQCSYTFQYGDGSGTSGYYVSDAMYFSLIMGQPPAVNSSATIVFGCVQSMEGWEHMKSRTEWESWMSLSFWREMWDMLGEKRCSISQSGDLTKTDKAVDGIFGFGPGPLSVVSQLSSRGITPKVFSHCLKGDGDGGGVLVLGEILEPSIVYSPLVPSQNVQGISERN

SEQ ID NO: 139236 - protein, 82 aa, Glycine max
  Coding DNA Sequence Number=SeqID_47551
MVSHTESKGVILGISEASVKPVFFLDASLVPLTTFYHKMTNVVSMTIQIGSSKAFGRQYLIVIFMTFQWKAKNALGLEGKAD

SEQ ID NO: 139237 - protein, 311 aa, Glycine max
  Coding DNA Sequence Number=SeqID_47552
  Gene Ontology: Mol. function=pantothenate kinase activity; Cellular component=cytoplasm; Biological process=coenzyme A biosynthetic process
  Homolog annotation: Hit_ID=Q8L5Y9; Match level="QueryCoverage=95%, HitCoverage=32%, E-value=1e-115, Identity=74%"; Hit description =Pantothenate kinase 2
  Pfam annotation: Domain name=DUF89; Domain location=11-311; Score= -134.9; E_value=0.081; Accession=PF01937.10; Description=Protein of unknown function DUF89
MEEPSAYGKLGLANLLEMREECLREFQFADAYRSIKQSANCPKAIYLAQKKLAAFVLAMGSGENEASLAVLPDLLVELDSMDEESRLLTLIEGVLAANIFDWGSRACVDLYHKGTIIEIYRMSRNKMRRPWRVDDFDEFKERMKMPCHKRALLFVDNSGADIVLGMLPLARELLRRGTEVVLVANSLPALNDVTAMELPDIVAEAAKHCDILRRAAEAGGLLVDAMINTSDSSKKNSSSVPLMVVENGCGSPCIDLRQVSSELAAAAKDADLIILEGMGRALHTNLNALFKQDALKVISSGLWLIAIIVVR

SEQ ID NO: 139238 - protein, 502 aa, Glycine max
  Coding DNA Sequence Number=SeqID_47553
  Gene Ontology: Mol. function=1-phosphatidylinositol-4-phosphate 5 -kinase activity; Cellular component=plasma membrane; Biological process=phosphatidylinositol metabolic process
  Homolog annotation: Hit_ID=A5BUZ9; Match level="QueryCoverage=69%, HitCoverage=59%, E-value=1e-158, Identity=75%"; Hit description =Putative uncharacterized protein
  Pfam annotation: Domain name=MORN; Domain location=204-226; Score =31.0; E_value=4.4e-06; Accession=PF02493.11; Description=MORN repeat
  Pfam annotation: Domain name=MORN; Domain location=227-249; Score =35.0; E_value=2.7e-07; Accession=PF02493.11; Description=MORN repeat
  Pfam annotation: Domain name=MORN; Domain location=250-272; Score =24.5; E_value=0.00039; Accession=PF02493.11; Description=MORN repeat
  Pfam annotation: Domain name=MORN; Domain location=273-295; Score =26.0; E_value=0.00014; Accession=PF02493.11; Description=MORN repeat
  Pfam annotation: Domain name=MORN; Domain location=296-318; Score =35.3; E_value=2.3e-07; Accession=PF02493.11; Description=MORN repeat
  Pfam annotation: Domain name=MORN; Domain location=319-341; Score =26.0; E_value=0.00014; Accession=PF02493.11; Description=MORN repeat
  Pfam annotation: Domain name=MORN; Domain location=342-364; Score =40.4; E_value=6.5e-09; Accession=PF02493.11; Description=MORN repeat
  Pfam annotation: Domain name=MORN; Domain location=365-386; Score =25.8; E_value=0.00016; Accession=PF02493.11; Description=MORN repeat
  Pfam module annotation: Pfam domain module=MORN::MORN::MORN::MORN::MOR N::MORN::MORN::MORN; Domain location=204-226::227-249::250-272::273 -295::296-318::319-341::342-364::365-386
MQNPAMTMTSKKTKTTIMTSALHEGDDNGDVGSVSSDNGRDTSDGCDDSGVVMIAMSMVSMVMVVVVITTLMVVVAKMLLLVVAMTGGIGGGSDDGNDGGGGDSSNVSGDGDIGDSDNDSNDNDDHDSSNVGGIDDNDIDNGGSGVGVVDNLDGALSCAERTKSLDAISEIDCLSIFTIGEAAHSSEVAGFRVGELSLPNGESYSGSFLGNIPEGQGKYVWSDGCVYEGEWRRGMRNGYGKIQWPSGVMYEGEFSGGYIHGTGAYIGPDSLTYKGRWRLNLKHGLGYQVYPNGDIFEGSWIQGAPEGPGKYTWANGNVYLGNMKGGRMSGKGTLTWISGDSFEGSWLNGMMHGLGVYTWSDGGCYVGTWTRGLKDGKGTFYPRGSCLPSAQEIYLNALRKRGLLPDLRKQKQVHIHHAASVDMGDVKVGESQRSNRVSSDKLAKGNLLNLEQSRSKNISLERRWSLEVSIEKLIGHDSKLGSTDSVAENGDKVPILEREYMQ

SEQ ID NO: 139239 - protein, 125 aa, Glycine max
  Coding DNA Sequence Number=SeqID_47554
  Homolog annotation: Hit_ID=A5B5G3; Match level="QueryCoverage=40%, HitCoverage=3%, E-value=8e-10, Identity=58%"; Hit description =Putative uncharacterized protein
  Pfam annotation: Domain name=DUF1723; Domain location=94-125; Score =13.0; E_value=0.015; Accession=PF08330.1; Description=Protein of unknown function (DUF1723)
MVDLPQPLLVRIDTGRHRVQGAGAAQGTVARNVFDMTSSSSSSSSFDVYGDADRKLRMRQAIPTYQGIEQSPIEIIPLLQQSGLYTAIKLCRIKINGGIVNAFVERWRPQTHTFHLTCGNATITL

SEQ ID NO: 139240 - protein, 41 aa, Glycine max
  Coding DNA Sequence Number=SeqID_47555
MSIPWWSLEPTYSRYLYPCSTHKTCHQDPPPRRLVTEGENQ

SEQ ID NO: 139241 - protein, 101 aa, Glycine max
  Coding DNA Sequence Number=SeqID_47556
  Gene Ontology: Mol. function=growth factor activity; Cellular component=extracellular region; Biological process=cell proliferation
  Homolog annotation: Hit_ID=Q7PCB2; Match level="QueryCoverage=70%, HitCoverage=80%, E-value=4e-28, Identity=84%"; Hit description =Putative phytosulfokine peptide precursor
  Pfam annotation: Domain name=PSK; Domain location=35-101; Score=35.7; E_value=1.7e-07; Accession=PF06404.3; Description=Phytosulfokine precursor protein (PSK)
MKRGYYMTKGPMHEGASNLWTIPRDSNTPLASSRLLEPLKGKGPRQGEKEVEVNENAIPQSSDMEELIGSEECYMKDEECTSRRMMVEAHLDYIYTQHHKH

SEQ ID NO: 139242 - protein, 180 aa, Glycine max
  Coding DNA Sequence Number=SeqID_47557
MEIGMLLILGEWVLMNNPIKRDKDVGSNTKRFSLRERRKNSMGQMGENLPPKGRGVKEAYSRLIKEEFLEDLDNTFKSLWKSAIHSSVLAFAWRLLLNRVQTKFAQSMCVVQTCDPLNHLQQHYIEGLSKEANDAWMVTWFAVVWFLWIQRNAIIFNNEQKDEGKVWETYQNQSVAMAGS

SEQ ID NO: 139243 - protein, 420 aa, Glycine max
  Coding DNA Sequence Number=SeqID_47558
  Gene Ontology: Mol. function=heparan-alpha-glucosaminide N -acetyltransferase activity; Cellular component=integral to membrane; Biological process=glycosaminoglycan metabolic process
  Homolog annotation: Hit_ID=A5AF11; Match level="QueryCoverage=100%, HitCoverage=86%, E-value=0.0, Identity=78%"; Hit description =Putative uncharacterized protein
LMVLVDDAGGAYPRIDHSPWNGCTLADFVMPFFLFIVGVAIALALKRIPKVKYAVKKIILRTLKLLFWGILLQGGYSHAPDDLSYGVDMRFIRWCGILQRIALVYCVVALIETYTTKLRPSTLKPGHLSIFTAYRWQWLGGFVAFVIYMVTIFSLYVPDWSFVDYNSDKPKRYTVECGMRGHLGPACNAVGYVDRQVWGVNHLYSQPVWTRLKACTLSSPAEGPLRKNAPAWCRAPFEPEGFLSSVLAILSGTIGIHYGHVLIHFKGHFERLKQWLSMGFVLLTLGLILHFTDAIPINKQLYSFSYVCFTAGAAGIVFSVFYLLIDVWGLRTPFLFLEWIGMNAMLVFVMAAQGIFAAFVNGWYYKDPDNSLVYWIQNHVFTNVWHSERLGTLLYVIFAEITFWGVVAGILHKLGIYWKL

SEQ ID NO: 139244 - protein, 263 aa, Glycine max
  Coding DNA Sequence Number=SeqID_47559
  Gene Ontology: Mol. function=transporter activity; Cellular component= membrane; Biological process=transport
  Homolog annotation: Hit_ID=A7PT46; Match level="QueryCoverage=83%, HitCoverage=40%, E-value=1e-74, Identity=64%"; Hit description =Chromosome chr8 scaffold_29, whole genome shotgun sequence
  Pfam annotation: Domain name=Nramp; Domain location=41-263; Score= -152.7; E_value=3.4e-07; Accession=PF01566.9; Description=Natural resistance-associated macrophage protein
MEAETLNANHPPGFLHRSLPAVVPILLISIGYVDPGKWVAIAEGGARFGFDLMAFMLIFNFAAIFCQYISAKIGVITGKDLAQICSDEYDNWTCMLLGVQAELSVIMLDLNMILGMAHGLNILFGWDLFTCVFLIATGAVFHLLLFALLDIEKVKILGLFVSGFVFLSFVLGTLINQPDIPLSINGILTKLSGESAFVLMSLLGATLVPHNFYLHSSIVQILHAWESLLIGGYKSGTVLKLGVMQKLEGKTNILLLDIFVGEI

SEQ ID NO: 139245 - protein, 144 aa, Glycine max
  Coding DNA Sequence Number=SeqID_47560
MGEIVLLQSLLPEEPTSWKNSGRRLSEQLSEEDGGLPEELPECVPKGRVSSLFRRKILPEDHLLLTEEPSSGSAFFLEKMNSKMIKKISGRTLNYQRKLFCKNNCEIPEQLIPKVDLSTSGRSGSGRDFRNNFFQNFSVVLPEC

SEQ ID NO: 139246 - protein, 1993 aa, Glycine max
  Coding DNA Sequence Number=SeqID_47561
  Gene Ontology: Mol. function=4 iron, 4 sulfur cluster binding; Cellular component=nucleus; Biological process=regulation of transcription, DNA-dependent
  Homolog annotation: Hit_ID=A4PF88; Match level="QueryCoverage=80%, HitCoverage=87%, E-value=0.0, Identity=39%"; Hit description =Repressor of silencing 1
  Pfam annotation: Domain name=HhH-GPD; Domain location=1411-1552; Score=46.7; E_value=8.4e-11; Accession=PF00730.16; Description=HhH -GPD superfamily base excision DNA repair protein
MEVGEMDRKEPQVEVPWSPGTPIKAVPMKPMPICSPGERNQMGHHANGAVACDEFSHGQDKIGGLGDGSNVATDGGKTCEPTDSDAVSNYSKLGFCEQLFAVEAESRNSSVTQGNNDGLKNPFVPSFILDNVQDPQETYIACCSMKTSQDTLFTLDNANKEGIKIASMQVNMEEKDPGGEERNAPANKLDNNVPPNSKELCDPAMEFAAVSSPLKENHNPDKGSSHDTDLNKTPQQKPRRRKHRPKVIKEGKPKRTRKPATPKPVQPKENTPVKRKYVRKNTVNKTSTPPTEEARELSKEMSCKRSLNFDIGTTDESSAAIDNTTALLGKENGILVQETNVGSAFDLNTSMKQASNSYMSLPEDKQALNTSPSRRKSSGTKPEENTPPKRKYVRRKGVNKTSAPPIEVPGNLTKETMSASAQTSCTESIFDERARDQSYTVKENPTGHPGSEIGVLMKEMNVGLAYDLNTSRKQALNDDATLPKDTQAPSSSSKINLPGTKRKENLTGKRKNAGKKGSNPSPIPPTEITELTEARMLESNMSWRRSLNLDMGNVGRENLDLHTGKENLVLEERIVGPTYKDTWLKEAVNICMSLPEETRRPSTSISKCTSAGSKLNANSVEKKNKKGRATARGGNISNSQSSSIRSQMVGSKRKHSGTFNRADDSSMNLIGVQYNGLPSYQTSICLQFPKIQKKRTETGNATKEVQQTCPQEDALGHPYASSSSCWTYGSGYNTARVPATSGSTEKLKIDNTQTFNEFVLSLKRLAERSQTSTCDHGSLTRIRNCDTEPNYTAKQVGVSGRETFGDAIGALVAETCTPPTKKKRNRKKSVPSSSAHSTTNEMLQNHNFTLENYPLPMGKPSDIVPEVLWNTMNNIDALTLQFRQLNLNTEVRDLAFHEQNALVPYKQQNSLIHGDGVIVPFHIKKQHLRPKVDLDDETDRVWKLLLLDINSHGIDGTDEDKAKWWEEERNVFRGRADSFIARMHLVQGDRRFSRWKGSVVDSVVGVFLTQNVTDHLSSSAFMSLAARFPKISSSMCKTHHAEDTRLVVNKPQVHIVEPEESTEWDVKLLNQSVYDQPSPTIDIVEHSREKEAFNSNESCGTTSSVISLTDESNSRLSELPQKNIKEHCSPMRSGLLSASIEEGEEKSCYDGDRKELNDIVSSQGSVISSQISGDFSNDQNPEKIGSCSDSNSEVEVLSSTAKYNHFGSNTSFSKLLEMVSSTKFYADNSQKSESIENLRDAYDQHIHRQHNNTIESLKKSSATQGSAEASIILSDEYTLKLAPNLGMLDVNCFDPFKTEASTSDFLKKKDENSMNRSSLQTTEPGGQVATTHSQSIVSQVHPQEQSNHQQQSFFNISGQTQDLMQKGRGSDLGEQKNAMRNGTNEISSAPIKFKSKEQEKEKKDDFDWDSLRIEAQAKAGKREKTDNTMDSLDWDAVRCADVSEIAETIKERGMNNRLADRIKNFLNRLVEEHGSIDLEWLRDVPPDKAKEYLLSIRGLGLKSVECVRLLTLHHLAFPVDTNVGRIAVRLGWVPLQPLPESLQLHLLELYPVLESIQKYLWPRLCKLDQETLYELHYQMITFGKVFCTKSKPNCNACPMRGECRHFASAFASARLALPGPEQKSIVSTTGNSVIDQNPSEIISQLHLPPPESTAQADDIQLTEVSRQLESKSEINICQPIIEEPTTPEPECLQVSQTDIEDAFYEDLCEIPTINLNIEEFTMNLQNYMQEKMELQEAEMSKALVALNPEAASIPMPKLKNVSRLRTEHCVYELPDTHPLLQGWDTREPDDPGKYLLAIWTPGETANSIQPPESKCSSQEECGQLCNENECFSCNSFREANSQIVRGTLLIPCRTATRGSFPLNGTYFQVNEVFADHDSSLNPISVPRSWIWNLNRRTVYFGTSVTTIFKGLTTQEIQQCFWRGYVCVRGFDREARAPRPLMARLHFPASKLAKTKERTKKESSSTAKSRGSKPNPEQPELIANSSNLLQTGRD

SEQ ID NO: 139247 - protein, 132 aa, Glycine max
  Coding DNA Sequence Number=SeqID_47562
MECLLGVLETLEGNERCRFHGTIRLTATSLVHPEQPARTLQQPLEWILRTPTPYRLVEPVQVIEVSSSEEDLEEDPEELALEPAMDAPDLPEDDEDPLPDVDSLEDIMSASEADFTEESGPGGTANSDDSSS

SEQ ID NO: 139248 - protein, 38 aa, Glycine max
  Coding DNA Sequence Number=SeqID_47563
MGTKHAFTKRLHQVQVRSSHGPNRIAEVCSVLQKRLKG

SEQ ID NO: 139249 - protein, 50 aa, Glycine max
  Coding DNA Sequence Number=SeqID_47564
GIGKDDWCRPLKNLSQEARVNHLKSYWTKKHSELSESPKREQPPKLRTFL

SEQ ID NO: 139250 - protein, 165 aa, Glycine max
  Coding DNA Sequence Number=SeqID_47565
MVLKEELAACSRSKRSLDQHLEATEQSMLAIIGQYKEELNQSLTHEQKLVEDFADFAQAYAEKEARGRVIDVLHQEATMWMDRELTITKKAQRHPCNTRSRSKMDNEEGVQEQMKADLSALKDQMASITEVMLKLQKTIEDNATAAASNTTREAESVLQPVVNLG

SEQ ID NO: 139251 - protein, 96 aa, Glycine max
  Coding DNA Sequence Number=SeqID_47566
TRWVLIPSPCVKITLEPFTLKVRRPHISGFSDIFPQISVGGDSAHFPFLEDVPVSPASPSRRRVGCDTVSYPIFPGTIVWWHATPSLDRFKELNHR

SEQ ID NO: 139252 - protein, 39 aa, Glycine max
  Coding DNA Sequence Number=SeqID_47567
ILLTTAYGKNKAIKFKGANQKGNGTMKIGCPGFQKWLEE

SEQ ID NO: 139253 - protein, 188 aa, Glycine max
  Coding DNA Sequence Number=SeqID_47568
MEGRKGGSPFLMWRETPLRKDQKLRGIRNGIIGGYHEWLKVHIRGLDWLAKLKVVSEESFEAPEEDEEVQALKSELGKAKLAKEKFKLVATHIRKECAGLREENATTARALEQETRGLARKECGRNKFRGALWGSNSELKLRREERDQSRAHSMVLKEELVACSRSKRSLSQRLCETETNMLAIIAKY

SEQ ID NO: 139254 - protein, 151 aa, Glycine max
  Coding DNA Sequence Number=SeqID_47569
MYVTLQGIRKRAQSIQKHNDCPHDSLEEQVTQGSFVPHGRQDILNTAIGRPEHGGRVRAAGLGVTITQYYGRASRTCSSSSTSISQQQLDEVVARLREDMTGQIREELRTQIKEELRTQLEEENKRSLEIMTNALKEAIKKEFLRMVQQGL

SEQ ID NO: 139255 - protein, 99 aa, Glycine max
  Coding DNA Sequence Number=SeqID_47570
VTGCTICGEAHEIDQCILTEENTQEIHYMGNQQRQGPIQQGPNIFQRTTKLEETLTQFMQVTISNHKSTESALKNLEVQVEQLAKQIADKSSNSFVANT

SEQ ID NO: 139256 - protein, 81 aa, Glycine max
  Coding DNA Sequence Number=SeqID_47571
MSRNFPDCLMMGIKYLEVVKQRVHLLGDCYTEKKKGYISCGSVQVEGTSTWLFKENKGGYIPCGSLAYKGFYKVERNLKNR

SEQ ID NO: 139257 - protein, 73 aa, Glycine max
  Coding DNA Sequence Number=SeqID_47572
MAKSKGKDPLEGLAGPMTTARAGNGNEALQQVLSILFEYKPKFQGEKSKVGPIGNLGISLLGDQMVADLMAVG

SEQ ID NO: 139258 - protein, 248 aa, Glycine max
  Coding DNA Sequence Number=SeqID_47573
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLELETRKLALTIRNNIIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139259 - protein, 54 aa, Glycine max
  Coding DNA Sequence Number=SeqID_47574
MVGLYVICGCGELSCTIARPPPSTTCDGVVPGGMSRGSRDLGDVRWGAIAQNQA

SEQ ID NO: 139260 - protein, 214 aa, Glycine max
  Coding DNA Sequence Number=SeqID_47575
  Gene Ontology: Mol. function=phosphoprotein phosphatase activity
  Homolog annotation: Hit_ID=A7UQU7; Match level="QueryCoverage=70%, HitCoverage=28%, E-value=8e-19, Identity=38%"; Hit description=IMP dehydrogenase/GMP reductase, putative
  Pfam annotation: Domain name=DUF1723; Domain location=148-197; Score =54.9; E_value=2.7e-13; Accession=PF08330.1; Description=Protein of unknown function (DUF1723)
MARTRGLGRAIGRLRRRPTASARRLRVHQMTTEGRDMAEDVADMTDDVPELAAEAPEMRADAHGADSGEGSDGNDAAEGFPSGPRDPSVLTSFAEHVAHAVWSGQELPDLKLVSHGRKLTLIGRPVPEIEGLVAATGLSPLIDFSIITGDPGLISTFVERWHGDTSTFHLPVGELTITLDDVSSILHLPIIGALHSFHALSTEEARFLLTELLE

SEQ ID NO: 139261 - protein, 115 aa, Glycine max
  Coding DNA Sequence Number=SeqID_47576
MLEVVSNPWRFTVGNWLCDSDLVSPTGIERVLTEKDLLADSYSDLEAFILDEKEFLLLKVISTFPELSCLICSMVGAGRGIDGFNRTLDAQVFMTLYWILYIKAAGIDPSFMSRP

SEQ ID NO: 139262 - protein, 51 aa, Glycine max
  Coding DNA Sequence Number=SeqID_47577
MSISPCGSISWDRAHKAPSGPEGALQGPGVSSFGYGPLSFLQGARPPQQKD

SEQ ID NO: 139263 - protein, 65 aa, Glycine max
  Coding DNA Sequence Number=SeqID_47578
MELLPLRVGLREEERTSVARDLDELVQLFIRVEQQLKRKSSSKSYGFHSYKEGPSPRNFRGCQDL

SEQ ID NO: 139264 - protein, 186 aa, Glycine max
  Coding DNA Sequence Number=SeqID_47579
MAYSELWPSLLENHLVVAIPGKVLQPPYPKWYDPGAKCVYHSGVLGHNIDSCIPRKLGPTPHPYTPGRRPSQCHLHIKVIRPFHGRASSERVATKVDSLSAKVTNITGLSGVTRSGRVFASPHPTELPSKGKAPMVPESIDIATPSKEVDPPVVRGVEKKEGLQGKTVTLEEAHEFLRLIQQSEFK

SEQ ID NO: 139265 - protein, 77 aa, Glycine max
  Coding DNA Sequence Number=SeqID_47580
MGEKEEKKEESQVLYASKVEAIQLAWASWAATTSLFSPINRGKRAELKCSALLVFRILSKLERKIVSVEKIQVEVLP

SEQ ID NO: 139266 - protein, 153 aa, Glycine max
  Coding DNA Sequence Number=SeqID_47581
MKLASTQTSDLNLDRAKLVYGPLMKMNMNLGSLISGQISLIAQSNFSRLGFPALITALCKARGVISDSLTFESLSPAINLAYIKKNCWNLDEPSVTFPGTQKFRARRSKAPSTSAALAPPTLAPSTFSLPSPPSALVLPGPFAQSLESSLSML

SEQ ID NO: 139267 - protein, 21 aa, Glycine max
  Coding DNA Sequence Number=SeqID_47582
MTPLVKKIQGLQAPHGATSCE

SEQ ID NO: 139268 - protein, 62 aa, Glycine max
  Coding DNA Sequence Number=SeqID_47583
MSLHSSSSVIGEGSTRKDPLYKILDELRSLKFWKEKQERKEKGINETLGLIRILVMDLKRTN

SEQ ID NO: 139269 - protein, 147 aa, Glycine max
  Coding DNA Sequence Number=SeqID_47584
MTRGNPGDLQPFDPEIDRTFHRLVRHSVHPGHFVHFKHFEHSVEGDSEYFDFEHSTTNFHTENMAQPPPCERTLREMAAPDFTYESLCIQYPDEGVPSEDPYKHLKEFHIVCSTMKPPDVQEDHIFSKAFPHSLEGVAKDWSYYLAP

SEQ ID NO: 139270 - protein, 155 aa, Glycine max
  Coding DNA Sequence Number=SeqID_47585
  Homolog annotation: Hit_ID=Q6WAY4; Match level="QueryCoverage=87%, HitCoverage=24%, E-value=7e-12, Identity=34%"; Hit description =Putative uncharacterized protein
MGTNQNGKRFYQIKVKSLDVTSLKELGRLMGPLQRQAFRKVYGEILDLTAVEVFTEAVVSLAQYYDQPLRFFTFGDFQMVPTIEEFEERLGCPLGGRKSYLFSGFLPSLSKIAAVVGDSAKELDRMKQTRNDVVGLPRKYLEGKAKDMASQEKWG

SEQ ID NO: 139271 - protein, 98 aa, Glycine max
  Coding DNA Sequence Number=SeqID_47586
  Homolog annotation: Hit_ID=Q949K7; Match level="QueryCoverage=39%, HitCoverage=44%, E-value=5e-07, Identity=61%"; Hit description =Putative gag polyprotein
MPNTLEGPQFRPQPQPLHFAVGRAPPAMAEKGKLDHIEERLKDIEGDEDCAFANLEELFLVSDFDKYKGTTCSKNHLKMYCHKMGAYAKDEKLLIHFS

SEQ ID NO: 139272 - protein, 139 aa, Glycine max
  Coding DNA Sequence Number=SeqID_47587
  Homolog annotation: Hit_ID=A0ST23; Match level="QueryCoverage=28%, HitCoverage=81%, E-value=9e-14, Identity=90%"; Hit description =Putative reverse transcriptase
MASLVGYHEWLKVHVRGLEWLAKLKVFSKESFDQAYRYRRPRGGARYQLLFPLVRVNFELGVIMLTHINCVALTARFPFGKPVVPPALMNRPTHKERRFAYWALANSILAYYGGTDERVSEVLHVAGDNKAAPVRQQNM

SEQ ID NO: 139273 - protein, 139 aa, Glycine max
  Coding DNA Sequence Number=SeqID_47588
MLRQPTLADIRKSVAGRKSRGQGSRLGQEVEGGPPCHISRSFISAGLGHEGQVVAICEDDFPSGSDDESLKGTNTWDLTIDFEQETNQTEDEEDEDVGLPPELEKIVTHEDQEMGPQQEETELVDLGIGSGKKEVKIGT

SEQ ID NO: 139274 - protein, 123 aa, Glycine max
  Coding DNA Sequence Number=SeqID_47589
MNREKHVSYNSHNSCKSLVEELHDYYERRHRSHLRPHSRRRENERKPREANINLPYFHGKDNVEAYLDWEIRVEQKLKRKSTLKSYSSHSYPKKDQGLGILRAVPSKPKEDKGKIIEKQPPKA

SEQ ID NO: 139275 - protein, 200 aa, Glycine max
  Coding DNA Sequence Number=SeqID_47590
MAKPSKKRKGSLSRSQRHSETQETPIPSSIPSASLFSSEEQRRQCTNLFSSHSIIDPKFIDMDFFSNESFECIQAFENSNLIPFMSLKLPVYSDLVKAFYSNLEIQEGTLISEVYGIKMVIDQSLFYDLTQLSSEGVPFEGTLIDDWKYEFSVHDARRLVCTSQADMTGRLLAGSLAFESRILHYLIVRILLPRSSNHAQ

SEQ ID NO: 139276 - protein, 137 aa, Glycine max
  Coding DNA Sequence Number=SeqID_47591
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MGQNTPNDYDDGWLKFSQSPGDPLVLERPPPRWSSNSPYSESYYNSLAVVLQRRDWENPGVTQLNRLAAHPPFASWRNSEEARTDRPSQQLRSLNGEWDAPCSGALSAAGVVTRSVTATLASADVRRCFCRYAPPRQ

SEQ ID NO: 139277 - protein, 138 aa, Glycine max
  Coding DNA Sequence Number=SeqID_47592
METISKRFEKLDICGKVTLKNKLREISYPDQNSMCPPPENINTKVKCSASSSDQLIPRRTIPMLDQFHPFIHDFIDNIVDVKADGMGEDSWSLVHNHLLKELDKWSDDYIKLFGGTDRFEELRMSLLVDGLSMVCYYG

SEQ ID NO: 139278 - protein, 97 aa, Glycine max
  Coding DNA Sequence Number=SeqID_47593
  Subcellular localization annotation: CTP_CleavageSite=52; ConfidenceScore=5.38e-01
MVKVGTSYVPINVSFSPKVGPGLSRYQPVPPVQLLKCVSVTIRNKHTAGSISAGSVKPGCHAERNHHTLIALRSGCPSHSGNHSAAQLINESANARG

SEQ ID NO: 139279 - protein, 116 aa, Glycine max
  Coding DNA Sequence Number=SeqID_47594
MPLLRRLFQAIKRLTIAPDRHGRYRFGPQWNLIDQFLATLSASFQWHNSNPSGCFMYISSSNSQECSFHIHLVNPSDLVDAASANNSLPMWISSNQKLFIRKNQYMQTWITQSGSL

SEQ ID NO: 139280 - protein, 232 aa, Glycine max
  Coding DNA Sequence Number=SeqID_47595
  Homolog annotation: Hit_ID=Q6WAY6; Match level="QueryCoverage=44%, HitCoverage=18%, E-value=1e-14, Identity=38%"; Hit description =Putative uncharacterized protein
MGWLEYQGNVWKQKQESWQAAIVTFLAFHDRKESPVVAILADLYDTFDRRCEKNKVRHACTLEGHRSCTEKKEASWDQLLARKEGVSVNWFPQWKEGRTGFLISCGGFPNVPLMGTRGCINYNPILAIRQLGYPMRGAPLEEDLTPIIARGFNSTNAKALQKVCQAWEMVQKKDKELRGSSNGPICGYHRWLKAYTQGLDWLPNLRTTKGVEVEAPEEDEEVQALRAELENA

SEQ ID NO: 139281 - protein, 65 aa, Glycine max
  Coding DNA Sequence Number=SeqID_47596
  Subcellular localization annotation: CTP_CleavageSite=29; ConfidenceScore=5.18e-01
MWRKSKRVVFAQSVSFCNFFKRRFLQKVAAFGGSNLARLGELSGRHLPYFAINRGGSEEEKGLAP

SEQ ID NO: 139282 - protein, 78 aa, Glycine max
  Coding DNA Sequence Number=SeqID_47597
TWRSHTLLGGSHLTHSVATFFASSASIENKLHSSFPICIVQFPGSIDKNQAKDCAKDNQWGKTSPNYYDEDGPNSHQR

SEQ ID NO: 139283 - protein, 116 aa, Glycine max
  Coding DNA Sequence Number=SeqID_47598
  Subcellular localization annotation: CTP_CleavageSite=27; ConfidenceScore=5.34e-01
MVLSAVLPVQLLTGWLSASIRTQAYRRTSAGKCSGARPFAIQAAQLLMKATRGDRCGPFAITPLALKGGVSTAITSWVTVPGYDSLSANCELHARSCGERKVVLHGADDVNLTMET

SEQ ID NO: 139284 - protein, 100 aa, Glycine max
  Coding DNA Sequence Number=SeqID_47599
  Subcellular localization annotation: CTP_CleavageSite=49; ConfidenceScore=5.19e-01
MGVAYGGSNPARLENPSRGAFVTLPRRFREQIREGFPSFFTVLRSFFVLQRVYPSNLPNNWYQSQVQVGDRLRRVCKYRRWPEWLAPQHAPQVERGGQNG

SEQ ID NO: 139285 - protein, 162 aa, Glycine max
  Coding DNA Sequence Number=SeqID_47600
MTGRLLVGSLTFDCRIMHYIIVRILMPRSSNLAQASEEDLILMWAFLTGHPIDWAHLVRYRMHKALRSVKRSFAIGVGAVTSFGYHECTPSPSPQRDDSSSLMNEVLSELRGLRTYAGERFDSLDGRIDAIDAFFEGMDTRINQLEEDVSYLRRRFDLPPPS

SEQ ID NO: 139286 - protein, 52 aa, Glycine max
  Coding DNA Sequence Number=SeqID_47601
MASSGNGTEQEAAPLEEEVPQHPPIFVKPCLPECQVGIWLVITHPEVYSGDS

SEQ ID NO: 139287 - protein, 49 aa, Glycine max
  Coding DNA Sequence Number=SeqID_47602
MENWRTTLGTLGNGFMGLRKKWRMETWRTMLGRKFAGLHTRWCKAHEQR

SEQ ID NO: 139288 - protein, 78 aa, Glycine max
  Coding DNA Sequence Number=SeqID_47603
SSEVWGCNPLKARVCNPLKVVMLVRMIHTCLFAAARVKSCPGMHSSCVIASLSSCACTLGEIKPLKAGMEPLNKDRAL

SEQ ID NO: 139289 - protein, 30 aa, Glycine max
  Coding DNA Sequence Number=SeqID_47604
KHWLKVHDKLGFWLKACRTAGHDICQGLAS

SEQ ID NO: 139290 - protein, 66 aa, Glycine max
  Coding DNA Sequence Number=SeqID_47605
MENGHTVLRNNFAGLQSKLGDTRTALGINSWGSEKSGEWRIGEQRYAITSWGSRLEGGGHMNSARQ

SEQ ID NO: 139291 - protein, 148 aa, Glycine max
  Coding DNA Sequence Number=SeqID_47606
MASSATLYPLNNRWLLDDIDSLYTLSIFMIAQPGTSTVDKQLDSTAFDFSDQMHNQVNHDVKESGGKIHLHWHSIIAASFSTDSSNLTGSMTLLHIAWKKKTGELSLTGFVAKESPYSPTNIGIRARDNRETLTLQLNLLQLHKALNI

SEQ ID NO: 139292 - protein, 125 aa, Glycine max
  Coding DNA Sequence Number=SeqID_47607
MGDQEETQEQMKADMSTLKEQMASMMEAMLGMRQLMEKNVATAAAVSSAAEADPTLLATARHPPSNTVGRGRNMLGHDGNPHLGYNRAACPYGLPPNYSPPVLQDDAGHFASPVLEGEPPQQPDE

SEQ ID NO: 139293 - protein, 101 aa, Glycine max
  Coding DNA Sequence Number=SeqID_47608
MTKDADNHKVRPRATGPSGHDSRIETFSRSRPEDADISGKGADDYIGLYNHKVSPHATGPLGHDSEIETFSRSRPKDADISGKGTDDHIGLCVSTGSLASS

SEQ ID NO: 139294 - protein, 209 aa, Glycine max
  Coding DNA Sequence Number=SeqID_47609
  Gene Ontology: Mol. function=hydrolase activity, hydrolyzing O -glycosyl compounds; Cellular component=outer membrane; Biological process=peptidoglycan turnover
  Homolog annotation: Hit_ID=A6TD94; Match level="QueryCoverage=100%, HitCoverage=57%, E-value=1e-118, Identity=98%"; Hit description =Membrane-bound lytic murein transglycosylase A
  Pfam annotation: Domain name=3D; Domain location=134-209; Score =110.1; E_value=6.9e-30; Accession=PF06725.2; Description=3D domain
  Pfam annotation: Domain name=MltA; Domain location=1-115; Score =189.8; E_value=6.6e-54; Accession=PF03562.8; Description=MltA family
  Pfam module annotation: Pfam domain module=3D::MltA; Domain location =134-209::1-115
MPPKNGKLPSRASIYAGALSDNYVLAYSNSLMDNFIMDVQGSGYIDFGDGSPLNFFSYAGKNGWPYRSIGKVLIDRGEVKREDMSMQAIREWGEKHSEAEVRELLEQNPSFVFFKPQSYAPVKGASAVPLIGRASVASDRSIIPPGTTLLAEVPLLDNNGKFNGQYELRLMVALDVGGAIKGQHFDIYQGIGPDAGHRAGWYNHYGRVW

SEQ ID NO: 139295 - protein, 47 aa, Glycine max
  Coding DNA Sequence Number=SeqID_47610
MGLPATTYHQKRITLDEASLLSSESETQHDHRWTSTSYVSHRPGYRA

SEQ ID NO: 139296 - protein, 108 aa, Glycine max
  Coding DNA Sequence Number=SeqID_47611
GLHVLANRGLHALTFRGPHVLALRGLHALTLGGHALTFIGLHVLAIIGLHSLAFERRHVLNFRGLHALAFRGLRVLTFSGLHIHTLREFKVLCPYMLNRDLHSRLRGQ

SEQ ID NO: 139297 - protein, 56 aa, Glycine max
  Coding DNA Sequence Number=SeqID_47612
MGGGGGVGCLGKLPGNHITNETSKRVGLRPQKETTPENLAFHGFKQKTQMKHEAET

SEQ ID NO: 139298 - protein, 92 aa, Glycine max
  Coding DNA Sequence Number=SeqID_47613
  Subcellular localization annotation: CTP_CleavageSite=31; ConfidenceScore=5.30e-01
MSSSNVNTTPELGIFFLTGFLRFFRRFPQIKVGGDSAHLSSFGKRTREPRPRSPAKGHVATVDDSTRECFSPTGLSKKKALYPGSWEFKEWR

SEQ ID NO: 139299 - protein, 259 aa, Glycine max
  Coding DNA Sequence Number=SeqID_47614
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=37%, HitCoverage=10%, E-value=8e-09, Identity=35%"; Hit description =Gag/pol polyprotein, 3'-partial, putative
  Pfam annotation: Domain name=G-patch; Domain location=43-82; Score =25.6; E_value=0.00015; Accession=PF01585.14; Description=G-patch domain
MPYVEAAEESLEMTFQSFEVVSIASVDSFFGQPCLSDAAIMMARVMLGNGYEPGMGLGKDNGGITSLISAKGNRGKFGLGYKPTQADIKKGITGRKSRGQGSQLGQEVKRGPPCHISGSFISAGLGHEGQVVAICEDDSPCGSELVRPCPPDLSSSVPTSLPILIHLHVYFFTFNARSDDESLEGTNTWDPTIDFEQETNQTEDEENKDVGLPPELDKIVAHEDQEMWPHKKRDRTSELRNRQWEKGSKDRHEYDHTHS

SEQ ID NO: 139300 - protein, 98 aa, Glycine max
  Coding DNA Sequence Number=SeqID_47615
  Subcellular localization annotation: CTP_CleavageSite=42; ConfidenceScore=5.39e-01
MKSQNFDRLASQSVQNPKNVSFIALRSGKQCQGPQPATSSSSANEPAQPHFTPEKDDDTNLKSPLQSTDVEIHLANRSVAYPVGFIEDVLVRVGELPC

SEQ ID NO: 139301 - protein, 94 aa, Glycine max
  Coding DNA Sequence Number=SeqID_47616
MAKFDPEIVLEFYANAWLIEEGVRDMRSWVRGQWIPFDADALSQFLGDPLVLEEGQQCEFDQRRNRADGFDKEAITQLLCIPGQDFARTDARRL

SEQ ID NO: 139302 - protein, 337 aa, Glycine max
  Coding DNA Sequence Number=SeqID_47617
MASRKCKSIGSRPTTQYDTRRFHSLDARNRYTDNVLGRNILPERKVELYHTEFDDFKIELESRNLHKRLINLVDGSTNLAFVKEFYANLYNSNGPSPKQARGETLPIHSRYCRLPSNPREIETALCIPGRGFILNAEGLLGRILRKDLMTLAQSNSSRLGFPTLITTLCRARGVVSDSLTFECLRPVINFAYIRKNCWNPDDLKISIRGPRRARVRLAELPSTSAAPTLASTSAAPSVPVVAPPGSIPFIEKFLERVAWPGAQPSLHREDEGETQVRQEAAATPERSRDVTSDPPMLVDPSTPVLTLNTSPPATPVLHLTDEEGDQTQDTQDQSQEF

SEQ ID NO: 139303 - protein, 266 aa, Glycine max
  Coding DNA Sequence Number=SeqID_47618
MMWMHRFAFTLNGSQDLPRLLAKAKAMADMYSSPEEAVNTKTKHALRHPYQTRSKTRVMGDIEEVQEQMKADTEALKDNDGSHVKHKENDGKQCSRSFRRQHYRLGGSYPSLCQKPSEPTCPKHGGTRRRGVRQYDGPHMGYNRNAYPYGLPPNYTPPTMHMPNENINHVVPVTFEGQQPQPLGGAHEEPRERAQGDFDLYPTFTGGLPPAVEGREKLDLIEERLRAIEGFGDYLLADMTKLCLVLGVVIPPKFKGLGTASGTPPW

SEQ ID NO: 139304 - protein, 205 aa, Glycine max
  Coding DNA Sequence Number=SeqID_47619
  Gene Ontology: Mol. function=inorganic phosphate transmembrane transporter activity; Cellular component=periplasmic space; Biological process=phosphate transport
  Homolog annotation: Hit_ID=A1FSJ6; Match level="QueryCoverage=52%, HitCoverage=30%, E-value=8e-41, Identity=77%"; Hit description =Phosphate ABC transporter, periplasmic phosphate-binding protein precursor
MKNAAGKFVQPSDASFAAAAASADWANAKDFYLVMTNAPGAESWPITATNFILVQKTPKNAANGKATQEFFRWVYKNGDAQARQLDYVPLPDSLVRQIETYWTQNLKLCRAEPMLGWVLERADQRSAATEDREQSSMARLYPAPRPSYRCADPGSQGSCQGPANPVKPLSERDPGHLCHGRNTAVTKTSFHSRIRRRRRLYPAME

SEQ ID NO: 139305 - protein, 41 aa, Glycine max
  Coding DNA Sequence Number=SeqID_47620
MNDSGILMLCMENVIMRLRCPKKPHFLVSHALEESARIMHE

SEQ ID NO: 139306 - protein, 39 aa, Glycine max
  Coding DNA Sequence Number=SeqID_47621
MSQAHRHQLGRPIQLGHWAWSVIYSIWFASRRPTTVGSN

SEQ ID NO: 139307 - protein, 260 aa, Glycine max
  Coding DNA Sequence Number=SeqID_47622
MRSWVRGQWILFDADAISQFLGYPLVLEEGQECEYGQRRNRSNGFDEEAIAHLLCIPGQDFARTAAGRRVRIMRTNMTTLTQIWMTLLLSNIQPSDHNSELPLPKCQLVYAILTRMSIHVAQLIADAIYLFAGMAPTRHPLDPNKSNRALGFLALITRLCQLFGVPVAPSKAANHRAHVQTHDCLYQLSLSLHSQSFTSFPCPTPDQFRAEVAWPEDWPEARAREAPAEAPAEAPDEADEAREDLEMADLLDFLGGSGAT

SEQ ID NO: 139308 - protein, 93 aa, Glycine max
  Coding DNA Sequence Number=SeqID_47623
MNVGQTAVIKAGVVVAGPRGRQYCAVYPGADFPLADALGGAQGDLITLQAQGTVDAALQAAERLTPPVATARRFGTDRDVRGPSAITRNWLAR

SEQ ID NO: 139309 - protein, 62 aa, Glycine max
  Coding DNA Sequence Number=SeqID_47624
MSDTPCPGHPAENLGIAKTRIEAQILHGSTMSDTMSRTVHAQKIHDVGYMTTSGPAEVILDI

SEQ ID NO: 139310 - protein, 144 aa, Glycine max
  Coding DNA Sequence Number=SeqID_47625
  Homolog annotation: Hit_ID=A5C7Z4; Match level="QueryCoverage=80%, HitCoverage=41%, E-value=6e-10, Identity=30%"; Hit description =Putative uncharacterized protein
HLTETCMRVGNSDIYGFLEPQSIQSGHWQMVVILPKEHLVVWFCSLHNRSDNYLKGIINSAIKGLDDAPQPKSKASVRWIIIKCNRQKGSTECGYYVMHWMSTIILGTFRNNWEAYFNDPRPLEPERLKALRIQWAQFFLRVRD

SEQ ID NO: 139311 - protein, 142 aa, Glycine max
  Coding DNA Sequence Number=SeqID_47626
AGTGERTREPPGGNAGIFIVLSGFATTDLSVRFRDACQGGGAYGKTALPAALSSLLMVSSGQFALYESYSHIHWPSLFFYNAFTGHPGVISQHSNRRCSTSPFAPAGVIAKRPAPIPLPINAVAQPEWRMGSGAVAAALTAV

SEQ ID NO: 139312 - protein, 254 aa, Glycine max
  Coding DNA Sequence Number=SeqID_47627
  Gene Ontology: Mol. function=DNA binding; Biological process=DNA recombination
  Homolog annotation: Hit_ID=A7CER0; Match level="QueryCoverage=100%, HitCoverage=62%, E-value=3e-94, Identity=66%"; Hit description=Phage integrase family protein
  Pfam annotation: Domain name=Phage_integrase; Domain location=54-236; Score=66.8; E_value=7.3e-17; Accession=PF00589.13; Description=Phage integrase family
ITAPEVLQVIKRPQNQSKLETAHRALQAVGQVMRYAVQNGKAERDVTADLRGALPSPEVKHMASFIEPQQVAELLRAIDGFQGTFTVECALRLAPLVFTRPSELRRAKWADIDLEAGVWGYRVTKTKIDHIVPLSNQAVQILKQLHPVSGHGEFVFMGGHDPKKPMSEAAINAALKRMGYDTKTQITGHGFRAMARTLLHERLNIDPVIIEHQLAHKVPDALGQAYNRTKFLEQRKAMMQAWADYLDELKAGAK

SEQ ID NO: 139313 - protein, 84 aa, Glycine max
  Coding DNA Sequence Number=SeqID_47628
MATIALSSRYGSKLAYDTGIWGESYRLFAAKFISWLTGFVVDLGMAFVDNWVVGKEECQSQHGFLPLSHPLHLPQFSHSSKQDD

SEQ ID NO: 139314 - protein, 100 aa, Glycine max
  Coding DNA Sequence Number=SeqID_47629
MAGKKKEPINILQYANDTVFVGEAAWENVAVLKAMLRGFELASGLKINYAKSQFGIIGGRVNWLLTSSSYGLGSLNLNMVVGKSFSRAEIKGDAHTGGGT

SEQ ID NO: 139315 - protein, 105 aa, Glycine max
  Coding DNA Sequence Number=SeqID_47630
MRGPLKESTSSFLVKSFGLHVLALRGLHDLTIRGLHALTSRGLHVLALRGLHALTLGTSYPHHQRTTCPRLERTTRPHHQRAARPHLQRTTCSRLERATRPHLGY

SEQ ID NO: 139316 - protein, 237 aa, Glycine max
  Coding DNA Sequence Number=SeqID_47631
  Gene Ontology: Mol. function=motor activity; Cellular component=cell projection
  Homolog annotation: Hit_ID=UPI00016621D1; Match level="QueryCoverage =98%, HitCoverage=40%, E-value=5e-20, Identity=33%"; Hit description =UPI00016621D1 related cluster
LTVRGLQVLALRGLHALAFRGLHALAIRRLHVLAFVRLHALTIKGPHALAIVGLHALTFRGLHVLAFIRLNALAFRGLHVLPFRELRVLTFKGLHVLGFRGLHVLGFRVLHAFTFRGLHVLAFRGLHVFAFRWLHALTFRGIHTLTFRGLHVLIGLHALTFRGLHVLPFKGLHALTFKGLQIAVFRGRHVLNFKGRHVLTFRGLCTFTFRGLQVVTFRGLHVLVFRGLLVLTFKGIL

SEQ ID NO: 139317 - protein, 41 aa, Glycine max
  Coding DNA Sequence Number=SeqID_47632
MEIKEAQEVVHEMKICEGILVLKQMQLENSELFWKLDLFCD

SEQ ID NO: 139318 - protein, 252 aa, Glycine max
  Coding DNA Sequence Number=SeqID_47633
LPVGTPMDPFSGSRSLYTPSEIEVRSGRAFGHRIGRGRHLGELPILYAICGGRREVVRNRFLVFRGGKNFLRGLFLWATLPVRYDSNGGPGKDNGGITSLISAKGNRGKFGLGYKPTQADIRKSIAGRKRGGQGSRLRQEDEGSPPCHISRSFISTGLGDEGQVVAICEDDAPSGSDLVRLCPPDFQLGNWRVEERPGIYATSIISEDESLEGTNTWDPPIDFEQETNQTKDEENEDVGLSSELERIVAQED

SEQ ID NO: 139319 - protein, 103 aa, Glycine max
  Coding DNA Sequence Number=SeqID_47634
MPLWGRIASVYTTEFDEFLDELDRRHWREELTDFQDGNIDVAIVKEFYANLYDPKDKSPKQVRVRGHLIKFDEDTLNTFLKIVVVVEEGETLCAYSRFTLPEA

SEQ ID NO: 139320 - protein, 154 aa, Glycine max
  Coding DNA Sequence Number=SeqID_47635
MALSEPSRIEIPLKLKLAKKEGGFGKLLVSESNCALRERPNRGQATQQSEEDQQQLATDAPPPPLQEVPSLESISDHLQRRLIIEARCSLTRPSTGTTCTNRARTLVLSLGLPPSNSGPQWPGLGIRLILRKGQDPQEPLEMTEMLRRMTTWPT

SEQ ID NO: 139321 - protein, 102 aa, Glycine max
  Coding DNA Sequence Number=SeqID_47636
MAYTHIPDSTSDSPQISASPYQLGLAPYASEPYNAQWNAPGLLRDKHTLRSSRILGETEVDEPWLGLWLPLNYQVDMGSSLAYDNGIWVVFVIGSAVDRLCG

SEQ ID NO: 139322 - protein, 136 aa, Glycine max
  Coding DNA Sequence Number=SeqID_47637
KKLVVGPWVGSIGPPPVCTGRLVPSAGDALLSLTGRVVPPHGITPQDSDPIVLAFGIGVMINRDSRGHSYFIVRGPDIVMIDRLRALSDSMGGVHGRLVGGAICLVNSVNERDLSLLNSYVEVTLHGQLLRGTMAA

SEQ ID NO: 139323 - protein, 219 aa, Glycine max
  Coding DNA Sequence Number=SeqID_47638
  Homolog annotation: Hit_ID=Q6WAY4; Match level="QueryCoverage=90%, HitCoverage=35%, E-value=5e-23, Identity=35%"; Hit description =Putative uncharacterized protein
MGTNQNGKRFYQVKVKSLDVTSLKELGRLMGPLQRQAFRKVYGKILDLTAAEVFMEAVVSLAQYYDQPLRCFTFGDFQMVPTIEEFEEILGCPLGGRKPYLFSGFLPSLSRIAAVVRDSSKELDRMKQTRNGVVGLPWKYLEGKARDMTSQEKWGPFTDILALLIFGVVLFPNVDGLVDLAAIDAFLAYHHSKESPVVAILADLFDTFDRRCEKNSARN

SEQ ID NO: 139324 - protein, 248 aa, Glycine max
  Coding DNA Sequence Number=SeqID_47639
  Homolog annotation: Hit_ID=A5BT79; Match level="QueryCoverage=88%, HitCoverage=25%, E-value=3e-24, Identity=35%"; Hit description =Putative uncharacterized protein
MAVEVDNQGNNILHFAAHLPVEFQELSSLRASIQMQRELQWFQFVDWYVPRELRRMRNNMGKRPIDVFYEEHKTLSEEIKDAGKGIAESGMLVAALVATVAFAAALSNVPGDKTNAWFVVFILANAVALFTSSASILSFLSNFTSSRFAQSEFVISQHPSLTFGRALLFISVFAMVVAFTAASFLILDHKSKWVAYLVASMTVFPIFVFLLFQISSLDDHLWSRYYRFPELDYSIAAVQVHQSLGRSI

SEQ ID NO: 139325 - protein, 97 aa, Glycine max
  Coding DNA Sequence Number=SeqID_47640
SRPGEVQPGPWGLQLWLRASVSPTGCPFPPTRSHHHDIGIAPARHPVDPEKSNRVLGFPALITSLCQFYRVPVTPNKVIRPRINWAFIKKYCAPRQA

SEQ ID NO: 139326 - protein, 326 aa, Glycine max
  Coding DNA Sequence Number=SeqID_47641
  Homolog annotation: Hit_ID=Q6WAY6; Match level="QueryCoverage=66%, HitCoverage=38%, E-value=1e-20, Identity=29%"; Hit description =Putative uncharacterized protein
MANQEEWVPFMDVLALLIFGVVLFPNMDSLVDLAAIDAFLAYHHSKESPVSSARIICCLPALCVWLVSHLFQQDIRHPCPLRSHRSCVEKRRVDWDQHLAGIGGRAVNWFPRWKEGKEGVLFSCGGYPNIPLIGTRGCINDNPALTIRQLGYPMRGAPTEESMSPFLVRDFGTQNFNVIQRVHKAWERPLRKDKELRGIRNGIIGGYYEWLKVRTRGLDWLAELKIINKENFEAPKEDEEVRALKTELGKARLAKEKFKLAATYVRKECAGLREESAATAKALEKETKRARREEHGRDKFRGALWGSNSELKLRREERDRSRAHNM

SEQ ID NO: 139327 - protein, 117 aa, Glycine max
  Coding DNA Sequence Number=SeqID_47642
AVLKISNSADRELEPNAMDFLLMNIATSFLLETGRDIFDIARLERGEFLRRWTCQARASYQLGTVFRDPPEFITSLLFQIYSGKEGGQAKYSQRPLLLIGTQFQDSLADESMYRSSP

SEQ ID NO: 139328 - protein, 150 aa, Glycine max
  Coding DNA Sequence Number=SeqID_47643
MSSNCDFPPWRCSRRQRRRAHGLEIYPKAHENPRAFPWISGPIYLESFIQCPCGVGLHQDAHAKVEYVKRLYDQAKVQIAKKNESYAKQANKKRKEVVLEPGDDPGHLRANVFQEGGNDENPENGQIQTKGPSGEGRRPKWRRTKPPSGE

SEQ ID NO: 139329 - protein, 96 aa, Glycine max
  Coding DNA Sequence Number=SeqID_47644
EEIYVEQHEGFQIKGEEQEVYKLKKMMTKVMNKKLKRIKEHPSQENLEQVKEFKNQEEFKTQDESLQTRIKIQYLRDSRSQDSRSRFKNEEKTQSR

SEQ ID NO: 139330 - protein, 70 aa, Glycine max
  Coding DNA Sequence Number=SeqID_47645
MVKVMKEKRYSSQITYLLVPLRKEWYIDALRCSKDIMTWRASKFTHISPQKSGHVTYGDNNKGRILGVGK

SEQ ID NO: 139331 - protein, 84 aa, Glycine max
  Coding DNA Sequence Number=SeqID_47646
QTQVDVPSTCTTKDVPSNVLRQRSQAVKPLILCEWGYKRILRREKRMKRMNSTSFQGLENQKTSESFWYKEEGEVQRDLRLAKD

SEQ ID NO: 139332 - protein, 114 aa, Glycine max
  Coding DNA Sequence Number=SeqID_47647
MVYNNGINLKILMSHNNSFQNCPMYGVACQCYDSTSDSPQISASPYQLDFTLYASGSYNAQWNAPGLLHDKHTLRSSRILRKMEVEEPWLGLFAAKFLFVGVFLVCAKGGLRHG

SEQ ID NO: 139333 - protein, 109 aa, Glycine max
  Coding DNA Sequence Number=SeqID_47648
MVVILPKEHLVVWFCSLHNRPDNYLKGIINSAIKGLDDAPQPKSKAPARQKGTTKCGYYVMHWMSTIILGTFRNNWEAYFNDPRPLEPERLKPLRIQWAQFYLRVRDQA

SEQ ID NO: 139334 - protein, 142 aa, Glycine max
  Coding DNA Sequence Number=SeqID_47649
MVKVGTSYVPINVSFSPKVGPGLPGINRGHLALFYTSCEADPLSMAIWFLSAVPPVQLLKLVIASNSAHKHQPDISAASVSRGPADAAIGARASSLLMNRQLAKGRRSLRNWEKKLHRGGGRSRIVDPPGTGISSLVLPGWH

SEQ ID NO: 139335 - protein, 115 aa, Glycine max
  Coding DNA Sequence Number=SeqID_47650
MKDKRDKEERLEKQKNKKDSKALSSKAKGKEKEEKDSAKKIVKKENHFATKGVEGRSPKFQEPLDLRSNPFQGGRDDAILPPKGIDRRLQEDWVKDVGKGPRVLMSHRVDFGPIG

SEQ ID NO: 139336 - protein, 96 aa, Glycine max
  Coding DNA Sequence Number=SeqID_47651
MFSLLALNGLSLPLVDESGAGNHKGNPACHLTSRVRTTKGAEDDVSLRSVNRQSFAPGCRKVRVTIKDDKRCQQDDVSLLCASMVLFAHWLTSMVQ

SEQ ID NO: 139337 - protein, 138 aa, Glycine max
  Coding DNA Sequence Number=SeqID_47652
MDSFGGSRPLNAPPKTKIRGGGALSHCFEGGRCSGKLPLFYAICGGHRRVLGNDFPVLRGGYIYVLNVKNTIFHSTLLQNATQTLKPHFSSPKTIGGRRELPLLAVEPPHQEEHFNRSRILLKDSVEKIPQSSISKLL

SEQ ID NO: 139338 - protein, 394 aa, Glycine max
  Coding DNA Sequence Number=SeqID_47653
  Homolog annotation: Hit_ID=Q6WAY6; Match level="QueryCoverage=87%, HitCoverage=66%, E-value=5e-16, Identity=24%"; Hit description =Putative uncharacterized protein
MVHDILVHEQYPLGGRKPYLFLGFYPSVARVAKAKALENQGEWASFIDILTLLIFRVVLFPNLEGLVDLAAIDAFLAFHHGKESPVIAILADMYDTLVCPLQGHCSCAEKGKANWDQLLASMEGAISNVPLMGTRGCSNYNPVLAIGQLSYPMRGAPSEESIAPFIARGFSDPNTRVLQGVCKAWDAVQRKDKELRGSSNGIIGDYRKWLRVYTRGLDWLPKLRATREEEAEAPEESEEVQALKVELERAWAVKEKFKSTAIKVRREYDELRDINMTTIEALERETKRVRKEEHDRNKFQGALWGSNSMILKDELKACLRSKRNLSQQLSETEGNMWAIIDEYKEKLNLAATHEQRLEDEYTKISVKRKARERAKAMVDVYSAPEEIHGLLNYC

SEQ ID NO: 139339 - protein, 468 aa, Glycine max
  Coding DNA Sequence Number=SeqID_47654
  Gene Ontology: Mol. function=motor activity; Cellular component=cell projection
  Homolog annotation: Hit_ID=UPI00006A2D9E; Match level="QueryCoverage =41%, HitCoverage=87%, E-value=7e-09, Identity=11%"; Hit description =UPI00006A2D9E related cluster
MDTSEPYTTAMKDTMHKPQENLGVDQKFSPNRFPTTSPLDESISCFLIRVDPWVLVPIALRGLHVLALRGLHVLTFRGLHVLDFRGLHVLALKGLDVLALRRLHVLALRGLHILAFRGLHVLDFRGLHVITLRGLHALAFRGLHVLGFRGLHVLAFRGLHALTVSGLHILAFRGLHVLTVKGLHTPAFRGLHVLAFRRLHVLAFRGLVALVVLDFIGLHILAFRGLHVLALRGLHVLAFRGLYVLTFRGLHVFAFRELKFLGHPLDLGGGPTMRAQPEKEAIAQLLCIPGVIYCLQGSCPQDTQWTRRSPIGLWGFQLSLRDFISSTECPSPPARSSGPLLTGPSSRSIVPPGRHRARHHSSLRTASSGRQTHRHHLQSPPQLIHKGWSVVCDTWPTSKWPTTGAGGNLELATKKLPAKQSRKPLKRVLVWPHKPTQALTNINSKAWNISSVSRPSRDGHSSYRDKGN

SEQ ID NO: 139340 - protein, 41 aa, Glycine max
  Coding DNA Sequence Number=SeqID_47655
PSPCICKEALSGFEPMTNKSPRHNFTAAPGLALTDTDRKKC

SEQ ID NO: 139341 - protein, 83 aa, Glycine max
  Coding DNA Sequence Number=SeqID_47656
MAPRKHSSKRSRKDAVAEGTSAAPEFDSHRFRSAEHQQHFEAIKGWSFHRERRVQLRDDEYTDFQKEIASSALDVAGHAHGQV

SEQ ID NO: 139342 - protein, 24 aa, Glycine max
  Coding DNA Sequence Number=SeqID_47657
MEDSHIPSHKADGYCDADWAGSAD

SEQ ID NO: 139343 - protein, 162 aa, Glycine max
  Coding DNA Sequence Number=SeqID_47658
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
  Subcellular localization annotation: CTP_CleavageSite=56; ConfidenceScore=5.08e-01
MTMITPSSKLTLTKGNKSCWDGSRCNGWDWSLGNSWSGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 139344 - protein, 68 aa, Glycine max
  Coding DNA Sequence Number=SeqID_47659
MPSKIILMMPKNQESYKFQESRSRFKIQDSRIIKIKIQDSNKESKLKIQESREDLIKISIKRIFQNIE

SEQ ID NO: 139345 - protein, 96 aa, Glycine max
  Coding DNA Sequence Number=SeqID_47660
MAPKKLSTKRSRRDAAAEGSSATPEFDSHRFRSAEHQQCFQAIKGWLFHRERRIQLREDEYTDFQEEIARRRWTSLVTPMAKFDPERRECETCVHG

SEQ ID NO: 139346 - protein, 148 aa, Glycine max
  Coding DNA Sequence Number=SeqID_47661
DSCQSFGVPVAPTKVIRPPITRAFIEKYCTQRQAQGAPPPPHQAGPAGSFDMEQYLQHVVCQEAANHRAHVRTNETLYQLSLSMQSQGFASFSCPTPDQFRAEVAWPGDWPEAQAGEAPPEAPDDGEEAHEDEEMADLLDFLGGSGAT

SEQ ID NO: 139347 - protein, 103 aa, Glycine max
  Coding DNA Sequence Number=SeqID_47662
  Pfam annotation: Domain name=G-patch; Domain location=1-42; Score =27.6; E_value=4.6e-05; Accession=PF01585.14; Description=G-patch domain
MATRVMLKHGYEPGMGLGKDNHGDADVVDIRGNPYKYGLGYEPEKPGRRNAPSRLRADRAWPGRGGGNRRGGSTRSAKFRATVPSQFPSGELAHDEPVGSLYH

SEQ ID NO: 139348 - protein, 164 aa, Glycine max
  Coding DNA Sequence Number=SeqID_47663
MLTAKCVVDLGNENLEMSVEDQKVILNLFEAIKHPNDNKTCFKVEEIEQEADLVGRHLKSMFLEEDEVKPILNPTTPSIVLPGPRRVKARTTPDAPPASPPVIPPPTTSSIAGKPFSSSSQQEHLVQMMQSLHHGHRLVIQNLQQLTLHLSMEPPLMTPEAFLQ

SEQ ID NO: 139349 - protein, 349 aa, Glycine max
  Coding DNA Sequence Number=SeqID_47664
  Homolog annotation: Hit_ID=A5AZG1; Match level="QueryCoverage=24%, HitCoverage=27%, E-value=7e-07, Identity=36%"; Hit description =Putative uncharacterized protein
  Pfam annotation: Domain name=zf-CCHC; Domain location=132-149; Score =19.0; E_value=0.002; Accession=PF00098.14; Description=Zinc knuckle
MKREKHVSYSSHNSCKSLSEELRDYYEGRHMSHLRPHSHRRENERKPQEVNIKLPYFHGKDNEEAYLDWEIRVEQKLKRKSTLKSYGYHSYPKKDQGLGILGAAPSKPNDDKGKTIEKQPPKASMQEKTSSIKCFKCLGRGHITSQCSTKKTMIMRIQDIYSSQDEATASPSSSESEEAKGEESSEEIYPQEEGKPLMVKEECKEVSVSSKRLAKKERHFEIKTNIKEISLLRQPPHFLLCKKTLVSIATSLRLEFIPQVKELLDEGLVRKSLNPCALLVPKIGIIRHQIPKIGGMMNALGGATLICKITRAPNIFMICVLSYPNFVRGPLLDDMRLLFGPCEVLGTHH

SEQ ID NO: 139350 - protein, 371 aa, Glycine max
  Coding DNA Sequence Number=SeqID_47665
  Gene Ontology: Mol. function=transporter activity; Cellular component= integral to membrane; Biological process=transport
  Homolog annotation: Hit_ID=Q470V9; Match level="QueryCoverage=96%, HitCoverage=89%, E-value=7e-59, Identity=36%"; Hit description=Major facilitator superfamily MFS_1
  Pfam annotation: Domain name=MFS_1; Domain location=1-326; Score =86.2; E_value=1e-22; Accession=PF07690.7; Description=Major Facilitator Superfamily
  Pfam annotation: Domain name=Sugar_tr; Domain location=1-368; Score= -168.3; E_value=0.021; Accession=PF00083.15; Description=Sugar (and other) transporter
  Pfam module annotation: Pfam domain module=MFS_1::Sugar_tr; Domain location=1-326::1-368
MANNYILQPVLPAIATSLQLPLFYTGFIAASMQIGYMLGILFLVPLGDSVNRKKLIVCQFFLLSLALLTASLTRQPLLLFSAGIVTGAMATSAVQLNALGFHITPKGATVGLITMGISAGILLARLVGGSLADALGWRGMLAIFATVMASMALLAIRCLPDVKPARDTGYLSVMVRLPGLLRNVRLIESAVTGGAWFFVFSLLWVTIMLHLQRPPLHLPAGTAGLFGLAGIVGLVLANYAGKLADRFGCRSVIFSGMVLVVAGITVLFLFPASLPGLTLGIILFDLGCFAAQVANQTRVLGLHPDKRSSLYALYMFFYYAMGAAGSVTGPWVYERWDWQGICLVSVVMVIIAMMTTAIGHFNENSVAHVSN

SEQ ID NO: 139351 - protein, 102 aa, Glycine max
  Coding DNA Sequence Number=SeqID_47666
MVGYTPSSFADLVFAGEMIEVGLKRGKSDHHALINAKTGANKEAITPARFPQHPFFRGYDLNATCAYHGGVLGHSIEHCMTLKHKVQGLINVGLLKFEENRL

SEQ ID NO: 139352 - protein, 172 aa, Glycine max
  Coding DNA Sequence Number=SeqID_47667
  Homolog annotation: Hit_ID=UPI00016621D1; Match level="QueryCoverage =94%, HitCoverage=40%, E-value=6e-10, Identity=31%"; Hit description =UPI00016621D1 related cluster
MLSHKGGPLGTSTLTFRGLHALTFRGLHALALVGLHALAFRGQHVLASRGLPVLAFRGLHVLTFRELHALTFRGLHALAFVGLHALTFRGLHVLASRGLPVLAIRGLHVLTFRGLHALAFVGIHSLTFRGLHTLIFRGLYVLPLRGLHVLAFGGLHGLAFRGLYVLAIRRLH

SEQ ID NO: 139353 - protein, 30 aa, Glycine max
  Coding DNA Sequence Number=SeqID_47668
MATMIKAMMSVKRIMEANAVIVAAISVVAK

SEQ ID NO: 139354 - protein, 251 aa, Glycine max
  Coding DNA Sequence Number=SeqID_47669
  Gene Ontology: Mol. function=helicase activity; Biological process =viral genome replication
  Homolog annotation: Hit_ID=Q9LTU4; Match level="QueryCoverage=91%, HitCoverage=16%, E-value=3e-63, Identity=49%"; Hit description =Helicase-like protein
MAIDQIFFIRIIQISMLQREKRLQSRNNEAQTILHSRRLFHQWIVDDYCMIESQKLNYVRQHQQQLRVDKYMNLNACNNAPETLGNQKGKRVILPSSFVGSQRYMEQLYFDGKAICGHIGFPNLFLTLTCNPTWSEIQRKVRKSNLTLHDCLDVVSQIFKMKLNQLMNDLKRGHVFGAILGFVYTIEWQKRGLSHAHILIFLHLANKYPNPEDIDKIISAEIPNKGTDPELYEIVYNHMIHGPCGLPNRSA

SEQ ID NO: 139355 - protein, 141 aa, Glycine max
  Coding DNA Sequence Number=SeqID_47670
  Subcellular localization annotation: CTP_CleavageSite=56; ConfidenceScore=5.06e-01
MNYAPFIIQEQQAGWINAHRRILRPLSFRNSKLVVNAHRQILRRLSFRFRKSSDKRAETDSAPFVIWGQFCWQGGSLAEWCFARTKLVSYLYFPFISNKRQVKRGNCQTLISSGDHLLLGCDPHFTTLRYLAPIVRHFVKF

SEQ ID NO: 139356 - protein, 111 aa, Glycine max
  Coding DNA Sequence Number=SeqID_47671
MDHVDDEVHEQPEEAVADDVPTDAEGFPSGPHDTSVLQDYVYHVAPKVWNREEACLAIAERLERLLNLRIVIEGTKAYTVTTEECLRIARGVTMQRDMYIRSRQRWRMEDA

SEQ ID NO: 139357 - protein, 241 aa, Glycine max
  Coding DNA Sequence Number=SeqID_47672
MNVLTAHDQGWEQELSPYNQYEEERTPNLESVSEEFMVYHASSKANQNSKKNHEIHFGKSYSIENFQGGPELQPYYQNEAERGSNLDKLLMQFKETTKSTQRALQSVEIQVGELAEEVTQFMSRREKYFEEVEAQKESLVKEHESREKDKEQAQQQWEKYSTVENHQESILQINNHPHQQIDKKRRKGEHEETLSAILSLIINTSLEMIWNVLPDYMKFMEFLAKKRNCKEDVFYVTFMPP

SEQ ID NO: 139358 - protein, 207 aa, Glycine max
  Coding DNA Sequence Number=SeqID_47673
MAKSSYTRENFEAPEEDEEVQALKTELGKARLAKEKFKLVATDIRKECVELREENAATARALERETKRTRKEEHGRDKFQGALWGSNNELKLRREERDQSRVHGMVLKEELAACSRSKRSLVRHLEATEQSMLAIIGQYKEELNQSLTHEQKLVEDFAQAYAEKEARGRVIDALHQEVTMWMDRFALTLNGSQDLPRLLAKAKAIAE

SEQ ID NO: 139359 - protein, 52 aa, Glycine max
  Coding DNA Sequence Number=SeqID_47674
MKNKMQNSKRDVYLGAFLNGALKGLDDTPQPKSKASARRIVVKYFNNARPLE

SEQ ID NO: 139360 - protein, 101 aa, Glycine max
  Coding DNA Sequence Number=SeqID_47675
MLKNGRESSRNYSRKRYGNAKCLTVPFAGERGRGSRVRFPKEERCAESPPTFICGKRRENQRKPFKIKILSSGVVFKLEEGRQKQGFCSYVPSFGEEIRPT

SEQ ID NO: 139361 - protein, 215 aa, Glycine max
  Coding DNA Sequence Number=SeqID_47676
MVVRAFDGTRREVRGEIDLPVQIGPHTYQLSVGTPVDPFSGSRSLYAPPEIEVRSGRAFGYRIGRGRHLGELPILYAICGGRGGVIRNHLPVFRGGKHFLRGFLLWATLPVRFGSNVGEWLRARNGFRSDLVRPCPPDFRLGNWRVGERPDIYATSIISNDESLEGTNTWDPPIDFEQETNQTKDEENEDMGLPPELERMVAHEDQEIGPHQEET

SEQ ID NO: 139362 - protein, 247 aa, Glycine max
  Coding DNA Sequence Number=SeqID_47677
  Gene Ontology: Mol. function=ribonuclease activity; Cellular component=ribosome; Biological process=RNA metabolic process
  Homolog annotation: Hit_ID=P30851; Match level="QueryCoverage=99%, HitCoverage=30%, E-value=1e-115, Identity=80%"; Hit description =Ribonuclease R
  Pfam annotation: Domain name=RNB; Domain location=73-247; Score =135.1; E_value=2e-37; Accession=PF00773.10; Description=RNB-like protein
MGSVVVVEITQRATRRTKAIGKVTELLGDDMGTSLAVDMAVRTHEIPHTWPEEVEKQIAKLKEEVPEEAKLGRVDLRKLPLVTIDGEDARDFDDAVFCEKKRGGGWRLWVAIADVSYYVRPGTPLDDEAHQRGTSVYFPSQVIPMLPEILSNGLCSLNPQVDRLCMVCEMTISSSGKLTGFKHYEAVMNSHARLTYNKVWNILQGDADLCEQYAAQVPHLHELHNMYQVLETAREQRGGISFETDEP

SEQ ID NO: 139363 - protein, 85 aa, Glycine max
  Coding DNA Sequence Number=SeqID_47678
AKEEKFQAADDSLSEVDPLSEMNPLSKASNSLSRWETLELLAKPICRLSDPSAECTTLAAEREEESRRRMSWQRTELQEEAILRA

SEQ ID NO: 139364 - protein, 69 aa, Glycine max
  Coding DNA Sequence Number=SeqID_47679
MTVKTSDTCSSRRRSQLVCCATVGKGDRCGPLRYYASWRKGHSASKAIKLGNAQGFPSHDVVKRRPSEL

SEQ ID NO: 139365 - protein, 265 aa, Glycine max
  Coding DNA Sequence Number=SeqID_47680
  Gene Ontology: Mol. function=motor activity; Cellular component=cell projection
  Homolog annotation: Hit_ID=UPI00016621D1; Match level="QueryCoverage =98%, HitCoverage=40%, E-value=3e-19, Identity=33%"; Hit description =UPI00016621D1 related cluster
HALTFRGLHVLTFKGQHVLAIRGLHVLTIRGLHVLTIRGLHVLIFRGLLVLAFRGLHVLTFRGLHFLAIRALHALTFRGLHVLTFRGLLALTFRGLHVLAIKGLHALTFRGLHVLAFRGLHALAIRRLHALTFRGLHVLAIKWLHALTFRGLHVLTYRGLHVLAIRGLHVLIFRGLRVLAIRGLHALTFRGLHVLAFRGLHVLAFIGLHILTFRGLNILIFRGLHVLIFRGLHVLTFRGLHALTFRGLNVLAIRGLHTLTFRELH

SEQ ID NO: 139366 - protein, 143 aa, Glycine max
  Coding DNA Sequence Number=SeqID_47681
  Subcellular localization annotation: CTP_CleavageSite=66; ConfidenceScore=5.29e-01
MAPPLTYSPLSSAASPWWKITIKGPHGSSKIQPPYKPHKQASITILNVFGSRRSNDVTRSIFCPKFCKMVTSMLQLDSMNLFVKARAWFNPITQGMAILIANLRQHFIGMKDSRIRMLCMENRKMQGSCMKTKGMQFVEQRVC

SEQ ID NO: 139367 - protein, 122 aa, Glycine max
  Coding DNA Sequence Number=SeqID_47682
MYTYIHTPSTSKDYTSLTLEGFTSSPSEGHTPSTSEGYTPSPSEDYTSSTSEGHTSSTSEGTMPSPSKDRTFSPSEGGTPSTSKSGMPSTSEGYTSSTSEGYTPSPLEGYASSLLVGSTSAP

SEQ ID NO: 139368 - protein, 80 aa, Glycine max
  Coding DNA Sequence Number=SeqID_47683
LQVVPSVVRLMKQANVFPLKKTLKKLIIWEINSDKGILKEDFQASNRVLIISKDSGGINEALGLNLELGLDLKRADYFIL

SEQ ID NO: 139369 - protein, 50 aa, Glycine max
  Coding DNA Sequence Number=SeqID_47684
MLKETNRWCWQLGHTNLELEGGLVPSLEEFESRSKGPTTLRAIGLRSTPN

SEQ ID NO: 139370 - protein, 267 aa, Glycine max
  Coding DNA Sequence Number=SeqID_47685
  Gene Ontology: Mol. function=binding; Cellular component =intracellular; Biological process=RNA processing
  Homolog annotation: Hit_ID=A2RAA5; Match level="QueryCoverage=95%, HitCoverage=37%, E-value=1e-139, Identity=60%"; Hit description =Function: the human XAB2 protein is involved in transcription -coupled DNA repair
MELRSENFDKAVEVMAKATQAPKKSTVDYFDENLSPQQRVHKSWKLWSFYVDLVESVASLEETKKVYERIFELRIATPQTVVNYANLLEEHKYFEDSFKVYERGLDLFSYPVAFELWNLYLTKAVDRKIGIERLRDLFEQALDGCPPKFAKPLYLMYGNLEEERGLARHAMRIYERATRAVSDEDRFEMFEFYITKSASNFGLPSTRPIYERAIAALPDQEAKEMCLKFAEMERRLGEIDRARAIYGHAIEFLQPGGSTSSRAAATA

SEQ ID NO: 139371 - protein, 241 aa, Glycine max
  Coding DNA Sequence Number=SeqID_47686
  Gene Ontology: Mol. function=transferase activity, transferring phosphorus-containing groups; Cellular component=integral to membrane; Biological process=two-component signal transduction system (phosphorelay)
  Homolog annotation: Hit_ID=A7MRJ5; Match level="QueryCoverage=93%, HitCoverage=57%, E-value=4e-81, Identity=66%"; Hit description =Sensor protein
  Pfam annotation: Domain name=HATPase_c; Domain location=121-232; Score=116.4; E_value=8.7e-32; Accession=PF02518.17; Description =Histidine kinase-, DNA gyrase B-, and HSP90-like ATPase
  Pfam annotation: Domain name=HisKA; Domain location=13-76; Score =43.2; E_value=9.2e-10; Accession=PF00512.16; Description=His Kinase A (phosphoacceptor) domain
  Pfam module annotation: Pfam domain module=HATPase_c::HisKA; Domain location=121-232::13-76
MLSGPLARYEKELRASHVAMAHELRSPLTAAIGRLQGMMDGVFDATPEQLGMVMKQLQHLNRLTDELHLLSLADAGNLVLEDRPFRLDELIQERADWITPQADAHNFTITLRNPRPCPFRGDAFRMGQVFTILMENSLRYGREGGHLEVVLHYAQGQYTLEFADDGPGVSKHFLPDMFKRFSREEQSRARHSGGSGLGLSIAQAICQAHGGSISASLPETGGLLVRIQLPWRACDEENSRS

SEQ ID NO: 139372 - protein, 59 aa, Glycine max
  Coding DNA Sequence Number=SeqID_47687
MASRKLASKRSRKDKVAEGTSSAPEYDSHSFRSAVHQQRFEAIKGWSFLWERRVQLRTT

SEQ ID NO: 139373 - protein, 162 aa, Glycine max
  Coding DNA Sequence Number=SeqID_47688
MRASGNRLPRGCNRLPGLELKAAGCRGLWNGSLVIDYQIMMAAQLIHDRVEMECLGGAWETLEGNTRCRFRGTIRFTATLLVHPDEPARTLQRTVEWILPTPTPYRLVESVQVIEVTSSEEDPEEDPEELPSEPAVDDLDFLEGDEDPLPEVDSPRGSHVGI

SEQ ID NO: 139374 - protein, 104 aa, Glycine max
  Coding DNA Sequence Number=SeqID_47689
MSFDQDYHSLLFLQDYQVCRPTETIKVIYLFFEDFNVFRPRLSQSSLPPSLSSPWLTQATRKLRVEVTSSPGRARLLLEEANNSSRRAELAWVSWYATSTPHSL

SEQ ID NO: 139375 - protein, 179 aa, Glycine max
  Coding DNA Sequence Number=SeqID_47690
MQIEAYILSPRIMSRAVAVPGALVVIAAVAGGALGGILGALVAIPVAASIIIIIQKVGPRLHSHVERGHLAHLLTVDLEHQWRLQLHRDRLDGEMPGGVGADRFVCSAEESPDAVVPDEGPQGLQPLQRAVGADHEHVQLAVVQHSVRQQADSALHHPAIADEHGVPAHRHRLLTVDRQ

SEQ ID NO: 139376 - protein, 177 aa, Glycine max
  Coding DNA Sequence Number=SeqID_47691
  Gene Ontology: Mol. function=helicase activity; Biological process =viral genome replication
  Homolog annotation: Hit_ID=A2Q378; Match level="QueryCoverage=92%, HitCoverage=10%, E-value=2e-43, Identity=51%"; Hit description =Putative uncharacterized protein
MEWCNQSTSIKYLFKYINKGSDRITAFLGNQDEIKQYLDCRYVSPPEACWKIFAFPMHVRSPAVERLYFHLENQQHVYWTDDQQIGEVLSKNTIKESMFTAWMHSNKICSYGRDLTYHQYISRFVYVARKRCWQPRKQGNTIGRLIWVPPSAGELFYLRMMLSTIKLIDTVDLEGGP

SEQ ID NO: 139377 - protein, 82 aa, Glycine max
  Coding DNA Sequence Number=SeqID_47692
MARSVFASCPYFRDLYGRELKGFLVIIPKVVISLLMVSGGIIPFEEHIVAVGTTSMICITQNMMKAMNCIETSSFDQIAYLE

SEQ ID NO: 139378 - protein, 114 aa, Glycine max
  Coding DNA Sequence Number=SeqID_47693
MMLLLSNILPSDRNANHPLQKYQLVCVVPTWGSHPQDTQWTRKSPTGPWGFQLWLRASISPIGCPYPPGKGSRLQTPSGPEEVQQGLELSSSNYGSSISSTSTCNLQQGHQTPY

SEQ ID NO: 139379 - protein, 43 aa, Glycine max
  Coding DNA Sequence Number=SeqID_47694
MREVLSKKGGEDEAQDTERIVSCAPIGDGAPARKSAALITDCF

SEQ ID NO: 139380 - protein, 72 aa, Glycine max
  Coding DNA Sequence Number=SeqID_47695
MALMMEKQLRKKKMQQRIQNQMMMILMPPHDHQTFIFAFYSYYELLPSRIFTSQQQEHGDRGSRKLMSREMS

SEQ ID NO: 139381 - protein, 89 aa, Glycine max
  Coding DNA Sequence Number=SeqID_47696
MFAPKVTINHGRGWQVARHVVNVLPKALHAVAIEPRKSVPYAKGKLGEALGGSGSTCAAWADLSITIPPTSLDACRRPPKPRIGYSDSM

SEQ ID NO: 139382 - protein, 179 aa, Glycine max
  Coding DNA Sequence Number=SeqID_47697
  Homolog annotation: Hit_ID=Q6UUU1; Match level="QueryCoverage=33%, HitCoverage=40%, E-value=1e-18, Identity=78%"; Hit description =Putative uncharacterized protein
ANWSSTAVAAALELVDPPGCRNSIIYSRSSLTMIARISNQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139383 - protein, 391 aa, Glycine max
  Coding DNA Sequence Number=SeqID_47698
  Gene Ontology: Mol. function=pyridoxal phosphate binding; Biological process=amino acid metabolic process
  Homolog annotation: Hit_ID=Q9A3N4; Match level="QueryCoverage=21%, HitCoverage=20%, E-value=8e-13, Identity=48%"; Hit description =Methionine-gamma-lyase
EHAAVADVFYPGLPGTAGAEIARRQQAAGGGLVAFELKGGLAAGRRLLDSLRLARIAVSLGDPETLIQHPATMTHASYTAEDRTGPRGAVTASRPAPQRFECRPLSAAPRSGCRTAAPPAARVPRSLAHGQLVRAEAVQQAVAVEHDLVVFHAPGTAVVVEQIDHLLELGQRLALQVPVAGQHCALLRARLDRALDHLVLLLLAQVERTDGGGHVHQQPLILLAVFLHHALRLLQDQSALHQPSIARQSVGNEQVGQPHFVQFPHVGAVLRHPLSQHDLDAAFDLAIHAARLGCGVDVRHVAGRMVGGVDRRAHPLAGAADLGQGSGFLRLAIGREAGQRGDRHRQHHADGECGAHAVQRGAKALEQRQHADRDGSGQQQQERAAQRAADA

SEQ ID NO: 139384 - protein, 201 aa, Glycine max
  Coding DNA Sequence Number=SeqID_47699
  Homolog annotation: Hit_ID=Q6WAY6; Match level="QueryCoverage=53%, HitCoverage=19%, E-value=3e-15, Identity=41%"; Hit description =Putative uncharacterized protein
MVGFTPFRQEVRHACLLEGHHSCTEKGGANWDQLLANKEGAFVNWFPRWKEGRVGVLISCGGFPNVPLMGTRGCISYNLVLAIRQLGYPMRGAPLEDELAPVISRGFNKTNVETLQKVRKAWEVLQKKDKELRGSNNGSIDGYRKWLKAHVQGLDWLPSLRTAKREEDEALEEDEEVQALRTKRKQAQTVKERFKSATLKI

SEQ ID NO: 139385 - protein, 153 aa, Glycine max
  Coding DNA Sequence Number=SeqID_47700
MGTNPTDKRFYQVKVKGLDTTSIKELGRLMEPLQMQAFRKTYGKILELTIAEDVLSGEENHTLSSGCLPSLSRIATVVKDSSKRFGPHKTDSKRHSGPTTEVLRRQGEGYGQSRRLGPVYGCVSFANFWGRPLSKRRWFGGPSSNRRFPCIPP

SEQ ID NO: 139386 - protein, 58 aa, Glycine max
  Coding DNA Sequence Number=SeqID_47701
MGVQIETRPTWALQKIPPELLLLEEATLLTWASWEFREGFDRSSTFFIRSSSFFDLQL

SEQ ID NO: 139387 - protein, 149 aa, Glycine max
  Coding DNA Sequence Number=SeqID_47702
MASRKHKSIGSRPIVQYETRRFSSLDAWTRYTDNVLGRNILPERKVEIYHTELDEFKAELERHNFHKGLTNLVDRSIDLALVKEFCANLYSSEDRPPNQSRVKDYREIEVALCTPGRGFILNSEGHPGKILRKDLTTLAQCGVSSYTPT

SEQ ID NO: 139388 - protein, 31 aa, Glycine max
  Coding DNA Sequence Number=SeqID_47703
FERHKKQEQERDKNKNKNKNANNRTRTKTQT

SEQ ID NO: 139389 - protein, 79 aa, Glycine max
  Coding DNA Sequence Number=SeqID_47704
  Subcellular localization annotation: CTP_CleavageSite=35; ConfidenceScore=5.02e-01
MSGTSLSTSGKVVNTRKGQMKNPVTAKESNAMGVKAMDTSKAEPSQDAGHRRKAHSDELKSEKTGQKKKRIGTWKLQEL

SEQ ID NO: 139390 - protein, 312 aa, Glycine max
  Coding DNA Sequence Number=SeqID_47705
  Gene Ontology: Biological process=transposition, DNA-mediated
  Homolog annotation: Hit_ID=Q6UUU1; Match level="QueryCoverage=27%, HitCoverage=55%, E-value=3e-18, Identity=61%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIREIHEELNLIADAGQSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMAAFVSSTPDTQFR

SEQ ID NO: 139391 - protein, 42 aa, Glycine max
  Coding DNA Sequence Number=SeqID_47706
MAEIYIDTRTRKDGSSVNEKAAIVIDELKTSKRLKQRVRKIY

SEQ ID NO: 139392 - protein, 201 aa, Glycine max
  Coding DNA Sequence Number=SeqID_47707
  Pfam annotation: Domain name=G-patch; Domain location=36-82; Score =14.5; E_value=0.0033; Accession=PF01585.14; Description=G-patch domain
MPYVEAAEESLETAFQSFEVVSISSVDSFSGQACLSDAVVMMARVILGNGYEPGMGLGKDNGGINSLINAKGNRGKYGLGYKPTQADMKRSIAGRKSSGQSSQLRQGSKGSPPCHISRSFISAGLGDEGQVVAIYEDDLGNWRVEERPGIYATSIISDDESPEGTNTWDPLINFEQERIKRKMKGTRMWDFPQKLEKDGRP

SEQ ID NO: 139393 - protein, 188 aa, Glycine max
  Coding DNA Sequence Number=SeqID_47708
MVGYTPSSFADLVFVDERIKVGLKRGKFDRPTLINEKPGANREDEKEEGTHVVTAIPTWPNFPPAQQSHYSAKICPSHYSPPNHPQRSSLNQPKSLPAAYAMPNTTLNTNQNTNQGRNFPAKKPVEFTPIPMSYANLLPYLVDNSIVAITPAKVPQPPFFRGYDSNLTCAYHRGVSRHSIEHCMTPEA

SEQ ID NO: 139394 - protein, 131 aa, Glycine max
  Coding DNA Sequence Number=SeqID_47709
MGEVEEIQEKMKADMEAMATMMEAMMSVKKIMEANAVAIAATSVVAKVNPTSPSSLKQMNHPTSNMVGKDLGSTGGPHDVQIQNEHALPSYGLPLNYTPPNVAYTPNKNVNNSTPIPIESQQPQTDHAHVS

SEQ ID NO: 139395 - protein, 90 aa, Glycine max
  Coding DNA Sequence Number=SeqID_47710
IVPTRHPVDPEKSNRSLRFPALVTGLCQSYRVPVTPARSCHRDIGIAPARPPVDPEKSNRVLGFSALITSLCQFYGVFVAPNKVIKPPVN

SEQ ID NO: 139396 - protein, 64 aa, Glycine max
  Coding DNA Sequence Number=SeqID_47711
  Subcellular localization annotation: CTP_CleavageSite=16; ConfidenceScore=5.03e-01
MKENNKGVSHAESPTVATYPSAGGRRVTRGMRVPRKEYARSRHQRLFEENVGKTGKDAIYELFK

SEQ ID NO: 139397 - protein, 45 aa, Glycine max
  Coding DNA Sequence Number=SeqID_47712
MAPLSLQDTGLPCSDVLCLSSAGKRRRSVSHDPILHLRPFLSTYK

SEQ ID NO: 139398 - protein, 63 aa, Glycine max
  Coding DNA Sequence Number=SeqID_47713
LKTEENEELTMNVEERLKIFTAGACHPALPGELSSPRRAQLAQASQVASSRSNRLLEEETGRP

SEQ ID NO: 139399 - protein, 139 aa, Glycine max
  Coding DNA Sequence Number=SeqID_47714
  Gene Ontology: Mol. function=transporter activity; Cellular component= integral to membrane; Biological process=transport
  Homolog annotation: Hit_ID=Q8GKU1; Match level="QueryCoverage=100%, HitCoverage=13%, E-value=3e-50, Identity=72%"; Hit description=AdeE
MAAGALALWTLPVEQYPDIAPPGVTVTANYPGASAKTVEDSVTQIIEQQIKGIDGLLYFSSTSSSAGQARISLSFEQQTDPDIAQVQVQNAVNQATSRLPQEVQQQGISVTKSQGDSLMVVALYDTQGRMDSVDINDFL

SEQ ID NO: 139400 - protein, 15 aa, Glycine max
  Coding DNA Sequence Number=SeqID_47715
RFPDYGKLNPLLDLP

SEQ ID NO: 139401 - protein, 102 aa, Glycine max
  Coding DNA Sequence Number=SeqID_47716
MLGKLGRIDGDPVLRQTRIWATWEYVSSVGGGLQGMVGLCAHCGCGKTCCAPSPDRHLVPHVMEWYLEICRGGQETLGTSGGVLLPKTKLDQSRPNPGIVGQ

SEQ ID NO: 139402 - protein, 109 aa, Glycine max
  Coding DNA Sequence Number=SeqID_47717
MIRGDTLWLFTPFCHPEAAGPMTSRDQVWSFCTLVSSRGGGPDDTRKYPSGYPYKHSFAICPLGPSRIFLQKDVASGGSNLARLGELSSPGRAELAWASWAATTSPILL

SEQ ID NO: 139403 - protein, 31 aa, Glycine max
  Coding DNA Sequence Number=SeqID_47718
YIKSALRQGLFFPAQNSLNLTAVADADYVDT

SEQ ID NO: 139404 - protein, 122 aa, Glycine max
  Coding DNA Sequence Number=SeqID_47719
MDLREQNMKEGVITKQGQLLLKAIPYSNYSSVAFDRELHCQPVARTVRNPSDCYLVVELASNSKFKLYQEWMSKKIAKLQGADGMKGDPNRGSLLTRIYVDDIVFGGMSNENASTFCPTDAI

SEQ ID NO: 139405 - protein, 184 aa, Glycine max
  Coding DNA Sequence Number=SeqID_47720
MTRRGQCGHSAPFCHPEAAGPMTRRDKLWSFCTLLSSRGGGPDDTQRPMWSFCTLLSSRGGRPDDMQRPMWSFCTLLSSRGGGPDDMQRQIMVILHPAHADGRKYPSGYDEDMTKSKGKDPLEGLGGPMTRARARKAKEALQQVLSILFEYKPKFQGEKSKGPIGNLGISLLGDQMVADLLAVG

SEQ ID NO: 139406 - protein, 70 aa, Glycine max
  Coding DNA Sequence Number=SeqID_47721
MEVDEPCLGLWLPLNYQAFSLQNSFLVDVLVWAKGGVRVGGVEWQSQHGFLPHPHPLHLPQFSDSFKQDD

SEQ ID NO: 139407 - protein, 114 aa, Glycine max
  Coding DNA Sequence Number=SeqID_47722
MASYGGELVPLDLEIEATFRRNNAKRKRKLLHNRTVASILEEAHFSESSSSNSPTSRESQTTKFEAEVIAEEQPRRMTLEDYSSTSVPQFFTSIARPEVQAQNITYPHSLIQLI

SEQ ID NO: 139408 - protein, 57 aa, Glycine max
  Coding DNA Sequence Number=SeqID_47723
MSMMGELKGLQTMKTSRRRIFIKSKYCGMNSKRWDGKLAKDHPGYDTVVLIGDISKG

SEQ ID NO: 139409 - protein, 213 aa, Glycine max
  Coding DNA Sequence Number=SeqID_47724
  Gene Ontology: Mol. function=NADH dehydrogenase (ubiquinone) activity; Cellular component=integral to membrane; Biological process=electron transport
  Homolog annotation: Hit_ID=Q5MA12; Match level="QueryCoverage=28%, HitCoverage=42%, E-value=7e-28, Identity=96%"; Hit description=NADH -ubiquinone oxidoreductase chain 1
MPPVFISWKSPAEERAVGQAESGHHLGWEWLSPYASFDESTPVASSKWLVNHAFPPSKQCSSPTLTALGWGKTAMSSSVQDSTPSRAGCRPRWSWEPTYTFLGLALPQHLNQMRAPKRNQPSLFQKALLGRRCLFTSLGQCSKHESVTPPSPMLSHRQRLGKRGRATCRETCTCGSGRGPRYTVLICVGPRNSSEIVMAQKQIWSGIPLFPVL

SEQ ID NO: 139410 - protein, 70 aa, Glycine max
  Coding DNA Sequence Number=SeqID_47725
MGQQRVKKYENNDDTSPIPSHLLCTPGQNNPKLQKVLKGTVKSGFSLKACNELQNKDQGKHRFSKGLSKE

SEQ ID NO: 139411 - protein, 258 aa, Glycine max
  Coding DNA Sequence Number=SeqID_47726
MFMKGIASVLLKPLGARLGALAAGALSGVAISDPVIASRVEAWVLAGVLLAADLVGSYLRSKTQEKKSAEKQANQQYANDMAAAQQQREWQLEDREEERAYNRAQLDETREYSRQVFSHLVEDAEKAGFNPLTALRAGGGASYNAAAGLAPLSATPITRQAPVKQAVGGSPLGDAVSGIGDFIANFDPFADQKREQEYRLVESQIAALNASALSGAPRGSASFATGGFERRVSGQSGVLSKSGKNAPGEGTIVGGDDP

SEQ ID NO: 139412 - protein, 117 aa, Glycine max
  Coding DNA Sequence Number=SeqID_47727
  Subcellular localization annotation: CTP_CleavageSite=31; ConfidenceScore=5.14e-01
MGPSVATLPPRPWSKRQKGLVGKSTARNKFRGALWGSNNELKLQREERDQSWVDSLILKDKLKACSRSKRNLSQRLCETETNMLAIISKYQEELNLATAHEHKVADEYAQVYAEKEA

SEQ ID NO: 139413 - protein, 69 aa, Glycine max
  Coding DNA Sequence Number=SeqID_47728
MTCLSKDNPIRRHSYGCFVGSPMCPESVIKPGTPIFPAWLHNLHSKTPKTETGTLFVFRLMQTQFKSKR

SEQ ID NO: 139414 - protein, 63 aa, Glycine max
  Coding DNA Sequence Number=SeqID_47729
MSLPSAVHVSSTFESGAPRMSLPSAVRQFSILHFYSEPHECHCLALFMCPPSSSAEPLQKKKE

SEQ ID NO: 139415 - protein, 75 aa, Glycine max
  Coding DNA Sequence Number=SeqID_47730
  Subcellular localization annotation: CTP_CleavageSite=42; ConfidenceScore=5.21e-01
MYQAYFSNDPSQSVAVTAARNHHTRRAYAPLQGRVVPFAAFRAAQLLGRAIGAGLCAITPAAKGRMCATAIICWH

SEQ ID NO: 139416 - protein, 248 aa, Glycine max
  Coding DNA Sequence Number=SeqID_47731
  Homolog annotation: Hit_ID=UPI00016621D1; Match level="QueryCoverage =77%, HitCoverage=34%, E-value=2e-08, Identity=27%"; Hit description =UPI00016621D1 related cluster
LHALTFRGLHILAFRGLHVLTLRGLNVLALRGLHVLTIRGLHALTSRGLHVLALRGLHVLTIRGLHALTSRGLHVLALRGLLALALGLHALTFRGPHVLTFRGLHALAIRGLHVLTFVGLHALTFRGLHVLANRGLHAFTFRGLHVLANRGLHALTLRGLHALTSRGLYILALRGLHALTFRGLRVLIFSVLHIRTLREFKDGPTVRAHPEREAITQLLCIPGQDFTRAAAKRRVRIMRTNMNTLTQI

SEQ ID NO: 139417 - protein, 187 aa, Glycine max
  Coding DNA Sequence Number=SeqID_47732
  Homolog annotation: Hit_ID=Q8GEG1; Match level="QueryCoverage=68%, HitCoverage=94%, E-value=3e-72, Identity=100%"; Hit description =Putative uncharacterized protein
MTFGAPKKTREGEGRFAVLGALPLPRSLNSLKLGRWGRISSLNRLIRLSTESGPKRKERTCEQKASKRPGTVKRPRCWRFSIGSAPLTSITKIDAQVRGGETRQDYKDTRRFPLEAPSCALLFRPCRLPDTCPPFSLREAWRFLIAHAVGISVRCRSFAPSWAVCTNPPFSPTAAPYPVTIVLSPTR

SEQ ID NO: 139418 - protein, 160 aa, Glycine max
  Coding DNA Sequence Number=SeqID_47733
  Pfam annotation: Domain name=G-patch; Domain location=31-70; Score =25.6; E_value=0.00015; Accession=PF01585.14; Description=G-patch domain
NGLQSFEVVSVASVDSFSGQPYLSNAAVMMARVMLGNGYEPGMGLGKDNGGITSLISAKGNRGKFGLGYKPTQADIKKGTTGGKSGGQGSRLGQEVKGGPPCHISRSFISAGLGHEGQVVAICEDDSPSGSELVRPCPPGFRLGNWRVEERPDIYATSIM

SEQ ID NO: 139419 - protein, 252 aa, Glycine max
  Coding DNA Sequence Number=SeqID_47734
MAPEELEQLTQQIRDHLKELITKKVTRQRMLSFNQMQSQFQSQMQSQGLALPPEPEVGPSVARVITKGSCVDPSATDPNTGDSDKCGLYIEENPSCLVVVSSSKPADRPDPEHEDLSEIAHGGQCLSISVIQLWIMHLTETSMCAGNSYVYGFLEPQSIQRSGQSQFESESYMKSWMQNSKRDVCLGAYLNGPDNYLKGIINRSVLFSNTFALALLNNINILMFLVFNSALKGLDDTPQPKSKVGARWIVVK

SEQ ID NO: 139420 - protein, 68 aa, Glycine max
  Coding DNA Sequence Number=SeqID_47735
MYDSTGFPFECKYVHNVNSLPICEMAPRKLASKRSRKDKVAEGTSSAPEYDSHRFRSAEHQQRFEAIK

SEQ ID NO: 139421 - protein, 57 aa, Glycine max
  Coding DNA Sequence Number=SeqID_47736
MACNLCLTASRYLAPVATFPFAGEQGEAHGCAFQRRKDARSRHQRLFVENVGKTEGN

SEQ ID NO: 139422 - protein, 95 aa, Glycine max
  Coding DNA Sequence Number=SeqID_47737
MASIIGDATPPSPKTARLMAKMIKLGDQMRSMSYEDEERMERMIKENDESLGRIHRSSEALSMRGMKRMREEGGTRYKEKRNHRSYGGRQREEGI

SEQ ID NO: 139423 - protein, 89 aa, Glycine max
  Coding DNA Sequence Number=SeqID_47738
MGVVLPWIRPLELVHKLPFIVGGNVPLPKGTLKIIPILYWRIPMNPTFPNKGSPPIEGIPLKAKGSQWNFSLIPNMMASKELFNLHFPI

SEQ ID NO: 139424 - protein, 130 aa, Glycine max
  Coding DNA Sequence Number=SeqID_47739
  Gene Ontology: Mol. function=helicase activity; Biological process =protein amino acid phosphorylation
  Homolog annotation: Hit_ID=A2Q378; Match level="QueryCoverage=79%, HitCoverage=6%, E-value=1e-17, Identity=41%"; Hit description =Putative uncharacterized protein
  Pfam annotation: Domain name=DUF889; Domain location=1-128; Score= -24.5; E_value=8.1e-10; Accession=PF05970.5; Description=Eukaryotic protein of unknown function (DUF889)
MHLEANIDATDREETSASAQWILDIGDGIVGQQNDGYGSIEIPKDLLITKYDDPLYAIVNSTFPNLSHHHNNHEYFQSTAILASTNEIVQQVNDYILSLIPADIISGKNIGQNVYIPRMSMSPSQFPMAF

SEQ ID NO: 139425 - protein, 21 aa, Glycine max
  Coding DNA Sequence Number=SeqID_47740
MEEKATEIWMKPLPKREDKSG

SEQ ID NO: 139426 - protein, 218 aa, Glycine max
  Coding DNA Sequence Number=SeqID_47741
  Homolog annotation: Hit_ID=A5C169; Match level="QueryCoverage=55%, HitCoverage=10%, E-value=7e-07, Identity=29%"; Hit description =Putative uncharacterized protein
MVIDQSLFFELTQLSSDGVPFEGTLDDEWKFNFCVSDARQMVCTNQVDMTGRLLAGSLAFECRIIHFLIVRILLPRSSNLAHVFEEDLIVMWVFLTGRQIDWAHLVRYRMHKALRSNAPLPYHHLITLFLQHFNVPLDSEPFVKVKRSFSIGENVVSSFGYRKERDVSWVKKDASVQVVEDRSPSPPPHNILDRLDGLHTFVCECFDSLDSRIDVMDA

SEQ ID NO: 139427 - protein, 216 aa, Glycine max
  Coding DNA Sequence Number=SeqID_47742
  Homolog annotation: Hit_ID=A7PVR3; Match level="QueryCoverage=93%, HitCoverage=26%, E-value=4e-49, Identity=47%"; Hit description =Chromosome chr8 scaffold_34, whole genome shotgun sequence
MSPPPWEALILVATYLDPKTLAMASCVSKSWFSSMSSDIIWKPILATHFPSLSTLPSSAPTVAYRRLFSMGHTATTHRLRGPSKPSLSLGDLVFAVSICTRDSNIVSIASPCDALRVDAPGVFRFGVGCDGAVLREGVEEVRMAWNVVLRGWRGVFTMMERVGKELPAPGCCSGAVESAVVADLKVRMCGGEDKNVNGVRVNEAKVYLKDFEFSNA

SEQ ID NO: 139428 - protein, 36 aa, Glycine max
  Coding DNA Sequence Number=SeqID_47743
MATKMKRCLFQALGSMAPIMSMPHIENGQGVAKTFN

SEQ ID NO: 139429 - protein, 101 aa, Glycine max
  Coding DNA Sequence Number=SeqID_47744
  Pfam annotation: Domain name=zf-CCHC; Domain location=77-94; Score =29.9; E_value=9.5e-06; Accession=PF00098.14; Description=Zinc knuckle
MELQRLNQNEETNKKKRIIALKASSSMQEENEKEDEEDEEDFSLFVKKFQKFVKKRRIERRQNFNNGKRSQEDSQILICYKCNQLGHIKANCPSNEEWPEK

SEQ ID NO: 139430 - protein, 202 aa, Glycine max
  Coding DNA Sequence Number=SeqID_47745
MDWSLRLTDAILPPRTLDKRLQEDWVSDAREGPRVLMSLRQRTPLMKKIQGVTSSTWSYVTNSNNTFFQGCCKKVTKEEKLYKGEGLKKSKIIWKCLEEKDDEYKSKSLTFFGRIMHWNNMHFVFPSVGTFQEVNDHDLLVIYYLWKKIPLSLPYLIINHIIKAIKPIKSTSGVPYGILMTLIFKHYGVLLEDEAKDEEVLT

SEQ ID NO: 139431 - protein, 128 aa, Glycine max
  Coding DNA Sequence Number=SeqID_47746
  Gene Ontology: Mol. function=hydrolase activity
  Homolog annotation: Hit_ID=A7PVS1; Match level="QueryCoverage=37%, HitCoverage=12%, E-value=3e-14, Identity=75%"; Hit description =Chromosome chr8 scaffold_34, whole genome shotgun sequence
  Subcellular localization annotation: CTP_CleavageSite=42; ConfidenceScore=5.32e-01
METHHGGQWNKAFLPLLLLLSVFSTVGSSSSAIRFRLAPLARGAAERQVPMQAGAPFKIALFADLHFGEDAWTDWGPRQDLNSIRVMSTVLHNENPGGLFLKGTHQWSWRVQYVTAPSELVSGDGESM

SEQ ID NO: 139432 - protein, 389 aa, Glycine max
  Coding DNA Sequence Number=SeqID_47747
  Gene Ontology: Mol. function=metal ion binding
  Homolog annotation: Hit_ID=A7Q061; Match level="QueryCoverage=98%, HitCoverage=98%, E-value=1e-107, Identity=56%"; Hit description =Chromosome chr8 scaffold_41, whole genome shotgun sequence
  Pfam annotation: Domain name=zf-C3HC4; Domain location=28-60; Score =5.5; E_value=0.022; Accession=PF00097.16; Description=Zinc finger, C3HC4 type (RING finger)
MEGKTESHMTSAAAFVEGGVQEACDDACSICLEDFCKSDPATVTNCKHEFHLQCILEWHVLIFFHVSEKLPVSYVLATYQLEGCYQLYAFHHSQELLEAVELERSLRDTPSRNAAIFHHPTLGDFELQHLPMGVNEADIEERIIQHLTAAAAMRRSHHLSRREGHRTRPSAHGRPHFLVYSTQPSAPPSAAGGGSEPAAIPVGSPSTPLTFDGNEQSSLQQIPHVQTQSSSLTSASTVSTTNLQGVHSDDRSFASHSFPASQDRAQPSEQSFSDSLRSRFNAVSMRYKDSISKGTRGWKERLFSPNSSMSELGSEVRRELNAKIASVSRLMERLETRENNSAAGTSLSNHLVNRSIAETSNQSNVEARGENSLHGNNTPTTFSASSDSK

SEQ ID NO: 139433 - protein, 90 aa, Glycine max
  Coding DNA Sequence Number=SeqID_47748
MPPPGKDPKGKQKHKKWSHRKHRSGSKEPSGHQEGSSWDKKLKSQDTEIARLRLALATTDKEKEEALLMRREFSRRLFVTTCLVATTPLL

SEQ ID NO: 139434 - protein, 153 aa, Glycine max
  Coding DNA Sequence Number=SeqID_47749
  Homolog annotation: Hit_ID=UPI00016621D1; Match level="QueryCoverage =91%, HitCoverage=40%, E-value=2e-09, Identity=30%"; Hit description =UPI00016621D1 related cluster
RGLHALSCRGLHVFAIRGLQVLAFRGLHVLTFRGPHVLTLRRLHALTFRGLHVLVVRGLHVLAFRGLHVLTFRGPHILAFRGLHALTLRGLHILAFRGLQVLAFRGLHVFTYRGPQVFAFRGLYALTFRGPYALTFKGLHLLAFRGLHAITFR

SEQ ID NO: 139435 - protein, 166 aa, Glycine max
  Coding DNA Sequence Number=SeqID_47750
MHHLITTLRLGPFVNNLCIKLASDLNKLRRRTAKYVKMEELAESVRTEEESKPLEGEKGKSPRPTKASHKHHCRRFRWGRSHRLWRKRHMDIPESKILPHDDPLFDSAKEQFAVDMPRIDQSFKDAKPIAQRKRKIGEERSQSGMLEGYIPIPEHRSPGQWSSRTL

SEQ ID NO: 139436 - protein, 220 aa, Glycine max
  Coding DNA Sequence Number=SeqID_47751
MESENGVAMEDEKHVIGETTKENINKEAENSCNAEIQTKNEVSETDVKAEGPKSAASKISKLAKGHVGKGGVASKNNKSATKDKPNLKSTTSYQTHRPNLSKSFSFPAKSAGGEGVKKSTNGTLAKTETKHANGAKAEASIRRSSRLTNSEVNSKEAETNTGNSNQRTSLTSITSLKTSELDNFYSFVFGLHVHDSYYVYQSGIFTVNAVTKSLTSEESL

SEQ ID NO: 139437 - protein, 50 aa, Glycine max
  Coding DNA Sequence Number=SeqID_47752
MWTTTENWGRSLPPSSPRRAGLLPPEATAFWRNLLEGPSGPGFYLHPYFY

SEQ ID NO: 139438 - protein, 98 aa, Glycine max
  Coding DNA Sequence Number=SeqID_47753
  Subcellular localization annotation: CTP_CleavageSite=40; ConfidenceScore=5.32e-01
MASSSAKTMDRLKLLTFPFWRCLDSLTTLFPPPGTPTRFIASHSSKALFSKEKLNMQQGQACIPLVRFPDPNYGFFKGSVKTPYYRTQHIRDTQRNSN

SEQ ID NO: 139439 - protein, 294 aa, Glycine max
  Coding DNA Sequence Number=SeqID_47754
MAVFWSLQLNLPTSKGIEELLGMGSQAINEYVELNRLTKPMHMSLSEQPMEVDEISTFPSTVLDFGKYFFRNFSTTSSHVRRTPAIFTVLQISTYVTSVTLRGRSSAMMRSSRLVCGLIIGMGDDDSNDEVWYLLQVASISGFKAPNNGSLASHCHERLYTLGDDVDGRRRGMDNGRKGRMVRDGGFSLFEKLRLWRVWRCDHALSAVASGFSEYGNDHALSAGFTLSAPLGFFIGLFRIKLELATKQGDALGLSCVLSELSHSSTFSSRLLLQVFASIFLQSTCNLPSFDSCW

SEQ ID NO: 139440 - protein, 251 aa, Glycine max
  Coding DNA Sequence Number=SeqID_47755
MASVLCGPWVPISMRDREICNIISVCPASPVLEVLYGICTSSSDWEKEEGDWLVVGGGTVGGRTGDGGAGVLLDVGQVDHEVQQLKGQGVKSDPLCITKSHDQCGKIKLGSDGLGDLCERWGSKVEVAQDAPCLGQCGTGVSRVLLPLWNDGRGLQKVIQCLNIKLNDFPLHSIVLWCTVIWVIGILIKVPHQSNVDPLLWEAYKPSLPLSPLELPIELVVHSGVSSTFLSERMFWRRSPMWAPPPEAGWT

SEQ ID NO: 139441 - protein, 160 aa, Glycine max
  Coding DNA Sequence Number=SeqID_47756
  Gene Ontology: Mol. function=binding; Cellular component =mitochondrion; Biological process=one-carbon compound metabolic process
  Homolog annotation: Hit_ID=A7Q1F1; Match level="QueryCoverage=68%, HitCoverage=7%, E-value=3e-31, Identity=66%"; Hit description =Chromosome chr7 scaffold_44, whole genome shotgun sequence
  Pfam annotation: Domain name=HEAT; Domain location=36-72; Score=12.2; E_value=0.41; Accession=PF02985.13; Description=HEAT repeat
  Pfam annotation: Domain name=HEAT; Domain location=77-113; Score=6.0; E_value=3.5; Accession=PF02985.13; Description=HEAT repeat
  Pfam module annotation: Pfam domain module=HEAT::HEAT; Domain location=36-72::77-113
MEEALQLSRAKDIKERMAGMERLHQLLEVSRKSLSSFEVTSLINTFIELLKDNNFRVSQTTLQALSSAAIHISEHYKLHINTFFYVVFNHLGDTKQPIRAACCLLLTLMERLKSNMGFAVNIQLLSGSLANFHVCTTLLKPHERIMALDLPYGGHLSHGY

SEQ ID NO: 139442 - protein, 276 aa, Glycine max
  Coding DNA Sequence Number=SeqID_47757
  Gene Ontology: Mol. function=kinase activity; Biological process =carbohydrate metabolic process
  Homolog annotation: Hit_ID=A7P7W2; Match level="QueryCoverage=23%, HitCoverage=17%, E-value=2e-13, Identity=58%"; Hit description =Chromosome chr3 scaffold_8, whole genome shotgun sequence
MDSTQAECSHVVTQISSQHVISISDALLQSKMMTLADLMEATEVCNGIVLAKVIAVESENGWSYQSCTKSRDEEVLHSSGAIQGSASVDAFEFVVGLIFGVFGSYLCFFLLLVLEHSGDGTETRGFVASDFGTRGARFAIIDKDGRIQAEAKREYPIYLETLFSLLQDVPLHLHKHIVSISIDGTSATTIIVDRTCKRILQDSGTLKRVAWGLDVGTRVVNFEYVDEAKATAEEAAQKRAMETLNSSKRTHFWEELLRDKYQEHKVEEFNALGKSK

SEQ ID NO: 139443 - protein, 85 aa, Glycine max
  Coding DNA Sequence Number=SeqID_47758
MGEKRGSVVYDETPKPAIESMSVIKKFRKLLLLFNEALFLVEFELWNHGKKLSFPNRVSLVTRRRFKNNGEGSPIYARNRNGKGR

SEQ ID NO: 139444 - protein, 276 aa, Glycine max
  Coding DNA Sequence Number=SeqID_47759
MTKKLPYYLELVRVFYNNLEIHEGVIFFEVHKISIVVDQSLFYSLTKLSSQGVTFEGTLVDDWKPIYSSLDAHKMVCVANVDMSSRLLVGSFTFECHIMHYILYRVLLPCSTDLGQATEEDLILMWALQTGCQIDWAHLIRYCMHNALRANAPLPYPHLVTLFLKHFKVPLTNEPSVKVNCSFAIRAVVVAPFGYKKDLDGQWVRKHDYQTNAPKERTPSPPPRDPSSTLLNDVLNEIWDLRAFVGKRFDSMNSRITRLEDDMGFTRRCFDPPTDP

SEQ ID NO: 139445 - protein, 78 aa, Glycine max
  Coding DNA Sequence Number=SeqID_47760
GGRSSEIRILDFRKYFFRKLLSTFPEEVVPEDTFGTTSSGIGASNFRKKFFRKLLRPIPEEVVPEVELALATSGRSSL

SEQ ID NO: 139446 - protein, 214 aa, Glycine max
  Coding DNA Sequence Number=SeqID_47761
  Homolog annotation: Hit_ID=Q2HSV3; Match level="QueryCoverage=63%, HitCoverage=20%, E-value=3e-13, Identity=35%"; Hit description=IMP dehydrogenase/GMP reductase, putative
AHMKGITGAPYRACCDALTVTDVSWFPYTEHRGVKAFELISSFHGQLRLGPMVVTARPERVVRQFGYIQSIPPPPVSARLSHDDIDDKWMHFAEHVLPAVELCLVPGQVSADYMEWFFRISHPFMIPTEAGDQPRDALAADPEEYIQLPSSQVPVAFDPPPHVDDYDEYEAIAQRLERVLNLRMVTAGTELYEIMQDCLTITRGRVSADGSVRA

SEQ ID NO: 139447 - protein, 105 aa, Glycine max
  Coding DNA Sequence Number=SeqID_47762
MVTIQVSEDGEGIVEVEEEQHTMSSFPLCPHPKQHLHLPLLIGYKWVYKIKENLDYSIKKYKQMWRNVNGDIGSGDKRNGGDSGGGDHNGGMMVVAMVKVVIMVK

SEQ ID NO: 139448 - protein, 178 aa, Glycine max
  Coding DNA Sequence Number=SeqID_47763
  Gene Ontology: Cellular component=anchored to membrane
  Homolog annotation: Hit_ID=A7Q077; Match level="QueryCoverage=83%, HitCoverage=93%, E-value=1e-40, Identity=58%"; Hit description =Chromosome chr8 scaffold_41, whole genome shotgun sequence
  Pfam annotation: Domain name=E1_DerP2_DerF2; Domain location=27-169; Score=41.9; E_value=2.2e-09; Accession=PF02221.6; Description=ML domain
MYVHLLSSNDPQETSLISFSAESEGEGELDDKKADYDVEVKGVEIYPDPIARGQPATFSIAATTGKALSGGKLAIDVSYFGWHIHSETHDLCGETTCPVSVGDFVIAHSQVLPGFTLPHTALFSPNVMSMSAYMSSFPWRGLKVSYSLKMKMFDGNKHELTNITFGFDIGFGSSVADS

SEQ ID NO: 139449 - protein, 73 aa, Glycine max
  Coding DNA Sequence Number=SeqID_47764
MGEHSGLVRAAGVGVTVRQYFGLALASSHTSMSINPEELEHLTQKIRDQLEQSTIEKVTRQLMLSFSQMHFEM

SEQ ID NO: 139450 - protein, 215 aa, Glycine max
  Coding DNA Sequence Number=SeqID_47765
  Gene Ontology: Mol. function=sequence-specific DNA binding; Cellular component=nucleus; Biological process=regulation of transcription, DNA-dependent
  Homolog annotation: Hit_ID=A5AZX6; Match level="QueryCoverage=71%, HitCoverage=73%, E-value=1e-23, Identity=40%"; Hit description =Putative uncharacterized protein
  Pfam annotation: Domain name=SRF-TF; Domain location=1-49; Score =68.2; E_value=2.7e-17; Accession=PF00319.9; Description=SRF-type transcription factor (DNA-binding and dimerisation domain)
  Subcellular localization annotation: CTP_CleavageSite=21; ConfidenceScore=5.21e-01
MSNKRNLQVTFSKRRTGIFKKASELTTLCGMNLAVIMSSPGNRVFSFGSPSVDSVIQHYTAQGPPPLLNLELNEASIDEHELHVHLNNLSDQIAAEKKHKKDLNRMLNAAEEHVWFVMPIKSMNDAQLETYKKMLEELKTYANEKREKLLQRLPNTSMGVATLTHDFSKIHGTKGGKLTCFLEIPHVTLSERHLKRKGWVQFRGILTFGKQNAPL

SEQ ID NO: 139451 - protein, 50 aa, Glycine max
  Coding DNA Sequence Number=SeqID_47766
  Gene Ontology: Mol. function=nucleoside-triphosphatase activity
  Homolog annotation: Hit_ID=Q9ZNT0; Match level="QueryCoverage=78%, HitCoverage=8%, E-value=8e-10, Identity=66%"; Hit description =Putative ATPase
  Pfam annotation: Domain name=Vps4_C; Domain location=10-46; Score= -16.8; E_value=0.062; Accession=PF09336.1; Description=Vps4 C terminal oligomerisation domain
MFFFKNPEGMWIPCGPKQQGAIQTSMQELAAKGLAFKVVISLIETGECLP

SEQ ID NO: 139452 - protein, 523 aa, Glycine max
  Coding DNA Sequence Number=SeqID_47767
  Gene Ontology: Mol. function=phosphoprotein phosphatase activity
  Homolog annotation: Hit_ID=Q5XM22; Match level="QueryCoverage=23%, HitCoverage=89%, E-value=6e-28, Identity=46%"; Hit description =Resistance-like protein HAAS-2
MVRTRGLRRVVGTGRGRDLSQDVAEDVPRRRRPTASARRQRVTQRVEDVPQLAEDVPHAPDGSPERTGAADGAESDRVASDGTTADDEGFPSGPRDPSDLIGFADHVAHNIWSGQERPDLKFVSHGRKVDKFGRPAAEIEGMIATTGLDPLIRCSMITGALHSFEPLATSDAVALLMELLEVTPDEAPAETRQAGGPHVQLSWLWDMYQTRVYLLHLVGCTLFANKSATHVHVVHLQAFRDLAQAGTFYWGAAALVHLYDQLNETSRALTRQMAGYISLLQCWIYEHFPSVHRSVVDDGYAEASPRACRWLTCKAHMTGIKGAPYRTRIDALTVTDVCWMSYAEHWGVRGYDLISSYMGQVRWGPIIVYLRPERVVRQMGYILTVPPPSVRDSLTCTDIDDRWVQFSDHVAPTGELCVVPGQVAPDYMEWFFQISHPFVTSTEDTVELRPTPPPPTHDDDFVEPPIAEVPVASDPPTHSVRVINLRMVTAGTDLYDIMDLCLRIARDDDPDDSLRSRQRARID

SEQ ID NO: 139453 - protein, 124 aa, Glycine max
  Coding DNA Sequence Number=SeqID_47768
  Subcellular localization annotation: CTP_CleavageSite=89; ConfidenceScore=5.42e-01
MAKLGAQPYASLGSDLLYGRCPSFDKSSCNGVDNTSRLVEGFCFPFSRPALAPMSFSFGSTVSVPTLVRVLPISIIRLIGLKFMNKILQVSEFDEVFNLVFQNTTFLNGVSSVAMISSTLGEIG

SEQ ID NO: 139454 - protein, 46 aa, Glycine max
  Coding DNA Sequence Number=SeqID_47769
GVSSLSSFLHSAAIHLPRSKGNPLMKKILGLQAPMELASGRRESLN

SEQ ID NO: 139455 - protein, 115 aa, Glycine max
  Coding DNA Sequence Number=SeqID_47770
MGSYGGHSLTGEGAMPVWVHLEDPSAACICGLHGVVFQISHPFMIPTQAGDQPRHAPGPDHEDYMQPDIPQVPVAFDPPRHAVDDYEGYETIAERLERVLNLRMVTTGTELHDIM

SEQ ID NO: 139456 - protein, 275 aa, Glycine max
  Coding DNA Sequence Number=SeqID_47771
  Gene Ontology: Mol. function=transcription factor activity; Cellular component=nucleus; Biological process=regulation of transcription, DNA-dependent
  Homolog annotation: Hit_ID=A4ZVU9; Match level="QueryCoverage=61%, HitCoverage=50%, E-value=5e-53, Identity=64%"; Hit description=CCAAT- binding transcription factor
  Pfam annotation: Domain name=CBFB_NFYA; Domain location=87-143; Score= 120.6; E_value=4.5e-33; Accession=PF02045.6; Description=CCAAT -binding transcription factor (CBF-BNF-YA) subunit B
MAMQTVYLKEHEGLVHSSVGQLSSVTSAPWWSALGSQPVYGEYCGQMKSFSLEISNYVDQFGAGKQAARGVEQLLDKGHTTQFTIFPGPTYVNAKQYHGIIRRRQSRAKAVLENKMIKRRKPYMHESRHLHATRRPRGCGGRFLNTKSSTDGNGKNESEVIKTSGRQFQSSASQSSEVLQSEVGMLNSSKQTNRSSPNISGSEVTSMYSREGFDGFSVNPLGSSVHSLADMIGSEHGIIRPTKWVAAVPGEEVLFPFPVFIVTNFVLEACLYIWF

SEQ ID NO: 139457 - protein, 305 aa, Glycine max
  Coding DNA Sequence Number=SeqID_47772
  Gene Ontology: Mol. function=SNAP receptor activity; Cellular component=membrane; Biological process=intracellular protein transport
  Homolog annotation: Hit_ID=Q9ZSD5; Match level="QueryCoverage=93%, HitCoverage=92%, E-value=3e-87, Identity=61%"; Hit description =Syntaxin-related protein Nt-syr1
  Pfam annotation: Domain name=SNARE; Domain location=215-277; Score =91.0; E_value=3.7e-24; Accession=PF05739.10; Description=SNARE domain
  Pfam annotation: Domain name=Syntaxin; Domain location=39-146; Score =90.9; E_value=4.1e-24; Accession=PF00804.16; Description=Syntaxin
  Pfam module annotation: Pfam domain module=SNARE::Syntaxin; Domain location=215-277::39-146
MNDLFSGSFSRTNDQVSPDHHHVIEMAATASPTAEGSVNLEKFFQEVEQVKEELKELERLHENLRGSHEKSKILHSAKAVKELRLRMDSDVTLALKNAKLVKVRLEALDRSNQTSQSLPGSGPGSSSDRTRTSVVSGLRKKLKDSMDSFNSLRQKISSEYRETVQRRYYTVTGENPDDKTIDLLISTGESETFLQKAIQQQGRASVMDTIQEIQERHDTVKEIERNLNELHQVFLDMAVLVQSQGEQLDDIESHVARANSYVRGGVQQLHVARKHQKNTRKWTCIAIILLIIIILIIVLPIVLRN

SEQ ID NO: 139458 - protein, 915 aa, Glycine max
  Coding DNA Sequence Number=SeqID_47773
  Gene Ontology: Mol. function=ATP-dependent helicase activity; Cellular component=intracellular; Biological process=transport
  Homolog annotation: Hit_ID=Q9FW67; Match level="QueryCoverage=92%, HitCoverage=93%, E-value=0.0, Identity=63%"; Hit description =Putative ATP-dependent RNA helicase
  Pfam annotation: Domain name=DEAD; Domain location=151-341; Score= -4.6; E_value=9.3e-05; Accession=PF00270.20; Description=DEADDEAH box helicase
  Pfam annotation: Domain name=DUF1605; Domain location=731-844; Score =95.7; E_value=1.4e-25; Accession=PF07717.7; Description=Domain of unknown function (DUF1605)
  Pfam annotation: Domain name=HA2; Domain location=603-694; Score =108.6; E_value=1.9e-29; Accession=PF04408.14; Description=Helicase associated domain (HA2)
  Pfam annotation: Domain name=Helicase_C; Domain location=444-541; Score=34.7; E_value=3.3e-07; Accession=PF00271.22; Description =Helicase conserved C-terminal domain
  Pfam module annotation: Pfam domain module=DEAD::DUF1605::HA2::Helicas e_C; Domain location=151-341::731-844::603-694::444-541
MTCVEIGDGDGRLKMYVKVAWLGFDTRIRQFTKGLSVTSSWCCTWSGQFFGYPKVHIVLVLLIKMSTDIERRVGNLLNSSQSTGATLSSLPSISADLGQKQSAAPIKYVSSRQTDSSKEKLSVALKERQELVQASDSLKEMKSFREKLPAFKMKSEFLKAVQENQVLVVSGETGCGKTTQLPQFLLEEEISCLRGADCNIICTQPRRVSAISVAARISAERGESLGEAVGYQIRLESKRSAETRLLFCTTGVLLRQLGGEKGGVRGGCMSHTCSKYKTIYEPSSNSVQDPDLTGVSHLLVDEIHERGMNEDFLIIILRDLLPRRPDLRLILMSATINADMFSKYFANAPTMHIPGFTYPVAEHFLEDVLEKTRYSIKSDFDNFEGNSRRRRKQQDSKKDPLTEMFEAYTNYKNYSLGVRKSLEAWSGSQIDLGLVEATIEYICRNEAGGAILVFLTGWDEISKLLDKLKGNNLVGDPSKKIVLATNIAESSITIDDVVYVIDWGKAKETSYDALNKLACLLPSWISKASAHQRRGRAGRVQPGVCYRLYPKLIHDAMPQYQLAEILRTPLQELCLHIKSLQLGTVGSFLEKALQPPDPLAVKNAIELLKTIGALDEQEELTPLGQHLCNIPLDPNIGKMLLMGSIFQCLNPALTIAASLAYRNPFVLPINRKEEADAAKQFFAGDSCSDHIALLKAFEGWKEAKRSGNEKQFCWDNFLSPATLRLIDNMRMQFLNLLSDIGFVDKSRGANVYNQYSHDLEMVCAILCAGLYPNVVQCKRRGKRTAFYTKEVGKVDIHPASVNAGIYLFPLPYMVYSEKVKTTSIYIKDSTNISDYALLLFGGNLVPSKSGEGIDMLGGYLHFSASKSVIELIRKLRGELDKLLNRKIEEPGFDVSAEGKGVVAAAVELLHSQVMR

SEQ ID NO: 139459 - protein, 2277 aa, Glycine max
  Coding DNA Sequence Number=SeqID_47774
  Homolog annotation: Hit_ID=A7Q2J0; Match level="QueryCoverage=55%, HitCoverage=98%, E-value=0.0, Identity=50%"; Hit description =Chromosome chr1 scaffold_46, whole genome shotgun sequence
  Pfam annotation: Domain name=Extensin_2; Domain location=1823-2162; Score=-127.4; E_value=0.025; Accession=PF04554.4; Description =Extensin-like region
MGRPEPCVLFAQNFVHPHLDEYVDEVMFSEPIVITACEFLEQSASSVAQAVTLVGISAKLIAADLFRATSPPSFAIEVFVHCEGETRFRRLCQPFLYSHSSSNVLEVEAVVTSHLVVRGSYRSLSLVIYGNTAEDLGQFNIDIDDNALTDLVDSTEGKLEDLPPALRSTSFTIDDSRSYLNVLSIPVPATDISVEVNLFLGLMLKFLEFSDLGDAGHKIVNTVVSAISSYISSDICESIGGRYQMRKRSENLEELHIVVDEARKELLEVYKVLHKKFRSESSECSSDAYYLEMDAEMLDSKTLVDMFNQYFHFQRNSSCIGDHCLSQSEHALLGLSMAYLLCSGRKSGFQFVSSGGMEQLALFFSKDGQNSTTIMLLLLGVVERATRYSVGCEAFLGWWPREDDSIPSSISEGYSHLLKLILSKPRHDVASLATYLLHRLRFYEIASRYESAVLSVLGNISTVGRVTDVTLNMLSSSEILLRKLLKLINSRGPIEDPSPIACASRSLITGQTDGLLSYKTTSSLISSSSCCFSDCDIDSHLLGLLKERGFLSLSTALLSSSKLRMESGHAMEIFMDVTSSIEAVILSFLFCRSGLIFLLQDPELSSTLIHALRSGHRGNKEDCIPLRYASILISKGFFCSPLEIGMIIEMHLKMVNAIDSLLSSNPQSEEFLWVVWELSTLSRLSSDLNLLMICRSDCGRQALLALGNFPEAVSILIEALSSFKESESVGKNSGSQWSKLLVLTLLHSGSSAVNLTIFHSAAEIIEAIVTDSTASSLGSWIGHALELHRALHFSSPGSNRKDAPSRLLEWIDAGVVYHKQGGIGLLRYAAVLASGGDAQLTTVLVSDLTDVENVVGESSSGSDINVMENLGKFISEKSFDGVTLRDSSLAQLTTALRILSFISENPTVAATLYDEGAVIVIYAILVNCRFMLERSSNNYDYLVDEGTECNATSDLLLERNRELNIVDLLVPSLVLLITLLQKLQEAKEQHRNTKLMNALLRLHSEISPKLAACADDLSSPYPDYAIGYGAVCHLVASALAFWPVHGWSPGLFHTLLASVQSTSLLTLGPKETCSLLYLLIDLFPEEDIWLWTSGMPLLTARRMLAVGNILGPQKERHVNWYLESGHQEKLVGQLAPHLDKIAEIILHYAVSALVVIQDLLRVFVIRIACQNAKYASMLIKPALSSVIHHVSESSCPSDTDAYKVLRLLDFLVSLLEHPLGKGLLLREGTLQILTKVLDRCFVIVDVDGKQIHDRSSAKCSFNFFSWCLPIFNFMMLLFRSEISRHYPRRDDFKNFEKLSDEDCALILRYLLKSCQVLPVGKELLACLTAFKELASCGEGQMAFGATHFGIHSHALELEPRKDDRNVNYNVSSVAEWIKCPPLLSCWMKLFRSIDTKEGLSAYAIEAAYALSVGSLQFCMDGDSSYEFVSNFEFFNIEYLYHIAGKFTVSFLVSLNSDRVVALKYLFGISNDMTRSDGFPEENINYILEFSALLSSKASMDDCLVNSQSQIPLYQVSESVKSLSLVLQRPVDSMKLEDVVLHQNEVLVFSKTHQLLENSVEKIDDHLNVGGLGDKFLWECPETLPDRLTQTTLAAKRKLPSMDGPVRRARGESFQADMSSQNAFSRGVAQSAVSSGPTRRDAFRQRKPNTSRPPSMHVDDYVAREKNVEGVTNVISVPRAGSTGGRPPSIHVDEFMARQRERHNPSATVVGEAVGHPKDASPVKPTDTEKLNKSKQLKTDLYDDLQGIDIVFDGEESDPDDKLPFPQLDDDLQQPAPVIIEQSSPHSIVEETESDVVDSSQFSQMGTPLGSNIDENGQTEFSSKMSGSRPDMSLTRESSVSSDRKYVEQADDTKNVQARPSGRYDSVSSNTSFPMSLYNNPSTSMQSPADSRMVSQNYLLKNSPQHAGIASGSQGLYDQRFLTNQPPLPPMPPPPTVSPVISHATDSVPGHSSPFVNSLAGTQRPVAFQVRSDYSSPFINGSTAASSVPVPDSKYSRTSVSSPGGPSRVAPPLPPTPPPFASNQYNLPSVKTSASQPSMYNQTSIGATELSQASISSSGARLSSYPNPPMMSAGFSRSASMPLTMFGNSPNQQQTENQPSILQSISVPPASFQSMHPVTQLQPLQPPQLPRPPQPPQLLRPPVHALQQLEQGMAVQSNVQVHHQLQMLQQPQVPSMQTYYQTQQQQFSHEQQQVEYTQQPGNSLSQQQQDAAMSLHEYFKSPEAIQSLLSDRDKLCQLLEQHPKLMQMLQMFGRLRVGNGKLRNWKNWANCSRMMMTK

SEQ ID NO: 139460 - protein, 81 aa, Glycine max
  Coding DNA Sequence Number=SeqID_47775
MVIFHHGVAAEDKGEEVRGAWRGCFNGGKERERGEQKIEEGKGGEKLNFELCLTRLSFIKVTTSVTHTSIYSLGSFLEKLP

SEQ ID NO: 139461 - protein, 116 aa, Glycine max
  Coding DNA Sequence Number=SeqID_47776
MSRLCLKGYSRRNQSEGELDGEVQVDVGVQGGVELNQNPQSEVEVEECGINKVEDGVDSQVKFEAKSHDEDEFVVEEEVSSEETSVVVDRVKYPTLNVLGDHDVEVKFELQYSSIK

SEQ ID NO: 139462 - protein, 179 aa, Glycine max
  Coding DNA Sequence Number=SeqID_47777
MAILWCNKSFQSQGGLKKKNTSLGPITRDKESKQKGNTIGIDGEMDKARKRVEQTEQQNKVDFQEHDGRQEVSYTKEVMFTKGKREKEKQNLIVTSLMGFTRMFPVKEELRFSTEYPCINQVKYKNQELLHCVPDSYENGSHLKHHRKEIHEVAVINGAVVDRGSSLVNISFGWDRPGP

SEQ ID NO: 139463 - protein, 128 aa, Glycine max
  Coding DNA Sequence Number=SeqID_47778
MDERDFADHVMQVHEALKSEREKWEKAIQAELIATQVKEAIAHVTEEPSNEATYVQKDVLDVVVVFSSSSSNPKDVAFISYAAPNALSKDRFQAIVTQAMTKQREETQELVNQAIMKQREEMQKEVRA

SEQ ID NO: 139464 - protein, 458 aa, Glycine max
  Coding DNA Sequence Number=SeqID_47779
  Homolog annotation: Hit_ID=A2Q4W6; Match level="QueryCoverage=33%, HitCoverage=20%, E-value=3e-09, Identity=29%"; Hit description=RNA -binding region RNP-1
  Pfam annotation: Domain name=RRM_1; Domain location=31-101; Score =25.6; E_value=0.00018; Accession=PF00076.13; Description=RNA recognition motif. (a.k.a. RRM, RB
DPRRSHDGNGYGQQREIRKINWRDASDVHSFYFTRFPEDMNETNLWYEFKKWGDVREVFIARNRNKRGKRYGFVRFKGVKDVTWLERKLDNLVVGGLKMHVNVSKHGRERTSHGKASRGRRQEKGHGAANWNTKQRMEKTSYKLLEDTNSKGTLADTMGKQLQQMKETTLYVKVLMTDSKNLTRGRNLRNPSPTGFVSYSSVQLNIPMKEKTWLNNTWVGRLKNLALFDRMEDDLMWNGGDDITPKYIRDDMVLLIGLTETKAAQMVKEANEQGSSLFYSLEKSTPQLRTGYRLVDDEMDELYRLDRGRILDRCKCWGRISIGSSEEISSDDSESEIGTQMMNGDVMSEIEPSEEDFLPSAEGDEQAHEWVISDTCSGQREVDRSNHRPDKSEKIQAQGKKATGPWAHCWALKNTNNNAHNEVNSVIKNHDNLSPAMRGSGLKEVAEWKELDKEQPPT

SEQ ID NO: 139465 - protein, 273 aa, Glycine max
  Coding DNA Sequence Number=SeqID_47780
MRAHGRSPRNRRPPHPSAWPGHRPHREAADRPPLAAPRERRVRRTGAVDRSSRHANRTGGAPASEPLHPTALKTMAAPEKWGLLGAADMEHWGRSSSRCDRQRWGRFERSVAFIRAPEALFQIVNSASEAPPPRLSAPSCRESRRAARCSVETSLRSTTARSVGSEIAREAVTPGATTGLQLAEQRRTVAARARRELFQPMPRQVVQAALVGEIREDLLSQCRRVRAGLQSYPQLDPRIVDRVDDVDHVDLTVAAPGELRGGPHILRHLAQRR

SEQ ID NO: 139466 - protein, 138 aa, Glycine max
  Coding DNA Sequence Number=SeqID_47781
MTLLLSNILPSDCSADLPLRKGSAHKTPSGLEGAQQGPGVSSSDYGPLSDLQGHPVDPKKSNRVLGFPALITGLCHFYGVPVTLGKVIRFPTNRAFIKKYCAPGRRKAKHHNSLGIASNRQQMHRRHLQSPSAHPQKG

SEQ ID NO: 139467 - protein, 120 aa, Glycine max
  Coding DNA Sequence Number=SeqID_47782
MTGPLDESISCFLIKVGPWVLVPNTFRGLYVLAIRGLHILACRGLHALAFRGLRVLIFRASSFLLSVPGSPPDIGGRPTVRAHPEREAITGARFHPCRCKKTSADHAHQHDHPYMDDVAI

SEQ ID NO: 139468 - protein, 143 aa, Glycine max
  Coding DNA Sequence Number=SeqID_47783
MSVLELYIEKDVTSGSMFHSANSLTSCGNYLSNDETQPPTNMSNLHVDEDDDDDYLVSNSYVEESLDEDDSVDGISDTDDEVTDMIQPVRIVTQQKVYKEFKIHFGMMFCIIIISTGVIRMMRTFVVWRCHRVLMLAKNYMLA

SEQ ID NO: 139469 - protein, 76 aa, Glycine max
  Coding DNA Sequence Number=SeqID_47784
LKPLQFQAKRREGQAAGVSLSEAYVLSECHPLSKALSSLSVMRNPRRGSARDVLAHQPPRESRLNLLLGSSAEPLM

SEQ ID NO: 139470 - protein, 177 aa, Glycine max
  Coding DNA Sequence Number=SeqID_47785
PKWKNFGDYYEGRHRSHLRPHSHRREKERKPQEANIKLSYFHGKDNVEANLDWEIRVEQQLKKKSTSKSYGSHSYPKKDQGQGILGVTPSKPKDDKGKTIEKQAPKANIYSSQDEATTSPSSSESEKAKGEESSEEIYPQEEGQPLVVKEKCKEALASIATPLGLEFIPQVKKLLDE

SEQ ID NO: 139471 - protein, 79 aa, Glycine max
  Coding DNA Sequence Number=SeqID_47786
  Homolog annotation: Hit_ID=UPI0000ECBAF8; Match level="QueryCoverage =51%, HitCoverage=48%, E-value=1e-16, Identity=100%"; Hit description= UPI0000ECBAF8 related cluster
MASTNLNSMPCMPYNYHLKLPLHLTNCMQAWHWPSFYNVVTGKTLALPNLIALQHIPLSPAGVIAKRPAPIALPNSCAA

SEQ ID NO: 139472 - protein, 206 aa, Glycine max
  Coding DNA Sequence Number=SeqID_47787
  Subcellular localization annotation: CTP_CleavageSite=42; ConfidenceScore=5.17e-01
MSRGSGDLGDARWGAIAQNQAWPIPTQPRHSQSVRTCDVPKQASSRQSTNKRTKVHEAKRLVWRLASYLFCVIYEKSPLVPMYKGCGNSFLGIGNRLLTLIAMAAQLIHDRVVMECLKGVWETLEGNERCRFRGTIRLTATSLVHPEQPVRTLQQPVEWILPTPTPYRLVEPVQVIEVSSSEEDLEEDPEELPPEPAVDAPELPRG

SEQ ID NO: 139473 - protein, 124 aa, Glycine max
  Coding DNA Sequence Number=SeqID_47788
MDMNLGFLISALITALCKARGVTSDSMTFESLSLAINLAYIKQNCWNLDDPLVTFQGTCKSRARRSEAPSTSTPPTSAPSTSAPSTYPLPPPPTAPILPGPSAQSSEVSLSMLQSLHQGKLLIM

SEQ ID NO: 139474 - protein, 199 aa, Glycine max
  Coding DNA Sequence Number=SeqID_47789
  Homolog annotation: Hit_ID=Q5QJQ3; Match level="QueryCoverage=15%, HitCoverage=24%, E-value=4e-11, Identity=100%"; Hit description =Putative uncharacterized protein
MTVKTSDTCSSRRRSQLVCKRMPGADKPVRARQRMRKEKIPHQAPFAIQAAQLLGRAIGAGLFAITPAGERGMCCKAIKLGNARVFPVTTFILDLTYAFKFICFCCKESKTLVRGCGSRETCRASCINESANARGEAVCVLGALPLPRSLTRCARSFGCGERYQLTQRRSFAPSWAVCTNPPFSPTAAPYPVTIVLSPT

SEQ ID NO: 139475 - protein, 48 aa, Glycine max
  Coding DNA Sequence Number=SeqID_47790
MNDNQFVGLRIRFVGGGCTNSARFFGGGCTNNARQSIRGAPDLMVEDA

SEQ ID NO: 139476 - protein, 112 aa, Glycine max
  Coding DNA Sequence Number=SeqID_47791
MVLPPRETRPAQGRLVHRFPGGDSSSALDVAGHSHCQVLPGYSSRVLCQCLAHGGGRVGPAVMGKGNILPNDHNSDLPLPKCQLVYAILTLESRMDEEMTDLLDFLGSSGAS

SEQ ID NO: 139477 - protein, 82 aa, Glycine max
  Coding DNA Sequence Number=SeqID_47792
MAFLEETSSQTVVNSTLGFIFPNGSIVHNDSGISFQASSPFPIRVPNGCDLETLKTRIHNTIKLTDNQFLDEIYYRQPFTYA

SEQ ID NO: 139478 - protein, 68 aa, Glycine max
  Coding DNA Sequence Number=SeqID_47793
  Homolog annotation: Hit_ID=Q2QXM6; Match level="QueryCoverage=45%, HitCoverage=2%, E-value=8e-07, Identity=70%"; Hit description =Retrotransposon protein, putative, unclassified
MAMASKIWHFNTHALKLLHEKNMMRDLPSIKENNEEVWVKAMEEEIQMIEKNNTWELVNRPYGKDIIG

SEQ ID NO: 139479 - protein, 136 aa, Glycine max
  Coding DNA Sequence Number=SeqID_47794
MDVYAGTLSMEFGDITVHFNILDAMKYPSEDLSVFRAEIIDHVVDEYMTDLYSNLHASHSSCIESEIVLDHMSEFDAESESESDIDCIESDRAAQCTRQDKMSNEELKLQDPRCRIQCPGHPARKYWSCCTMHKAR

SEQ ID NO: 139480 - protein, 131 aa, Glycine max
  Coding DNA Sequence Number=SeqID_47795
HIRYLSQFSSRIILDPKYLDVEFFNDETFDCYQVFQNSGLVDFMSLKLPHYPELVKVFYCNLKIQDGIISSEVHDIPMIIDQSLFFSLTHLPSQGAPLEGTIVDEWKFDYSSHDARRMVCNDQAEMPGRLL

SEQ ID NO: 139481 - protein, 376 aa, Glycine max
  Coding DNA Sequence Number=SeqID_47796
  Gene Ontology: Mol. function=metalloendopeptidase activity; Cellular component=proteinaceous extracellular matrix; Biological process =metabolic process
  Homolog annotation: Hit_ID=Q93Z89; Match level="QueryCoverage=68%, HitCoverage=70%, E-value=1e-101, Identity=73%"; Hit description =Matrix metalloproteinase MMP2
  Pfam annotation: Domain name=PG_binding_1; Domain location=124-186; Score=32.1; E_value=2e-06; Accession=PF01471.9; Description=Putative peptidoglycan binding domain
  Pfam annotation: Domain name=Peptidase_M10; Domain location=211-373; Score=63.2; E_value=8.7e-16; Accession=PF00413.15; Description =Matrixin
  Pfam module annotation: Pfam domain module=PG_binding_1::Peptidase _M10; Domain location=124-186::211-373
MVFAESDPVENLAEQRGLTIPSGQLVNDELKTLQTNSFNPKSEELKSKDIKKLPSVEFLKKKHDGVKDFSQEANLKIPTWIGRIIRNRKGKPSQKPKHPPPPPDYRVQLKSDPPAPNAPPKQINIKGLSVVKDYLSDYGYIESSGPFTDSFDQEIISAIKTYQNFSNLQVTGGLNKQLIQQMLSIRCGVPDVNFDYNFTDDNISYPKAGHRWFPNRNLTYGFLPENQIPDNMTKVFRDSFARWAQASGTLSLRETTYDNADIQVGFYNFTNSRIEVYGGSTIFLQPDSSKKGVVLLDGNMGWLLPSENATLSKDDGVLDLETVAMHQIGHLLGLDHSHKEDSVMYPYILSSQSEQRKVQLSNSDKANIHLQFAKHD

SEQ ID NO: 139482 - protein, 182 aa, Glycine max
  Coding DNA Sequence Number=SeqID_47797
LRYSIASIAIDYGTQSDIRVKELQHSISSFSIYDGTQSDIRVKSYCRLNLLRASVIHFERLDILRDSIRHPSKNLLSFEFAQSFNIQFPAFRYITGLNRTSEASVFHFEHLDILQDSIRHPSKKLLSFEFAQSFYINFELFDILRDSIGHPSKRLLSFEFAQSFGLPFRASRYITGLNQTSE

SEQ ID NO: 139483 - protein, 98 aa, Glycine max
  Coding DNA Sequence Number=SeqID_47798
MGSTQNGGITATKIQNLMKDLNALEARVNGSNISQAEMELKKSLQEQLWTAAITYESMMRQKSRVKWIREGDTNSAYFHRLINHRRRLRRAEWSDEKS

SEQ ID NO: 139484 - protein, 205 aa, Glycine max
  Coding DNA Sequence Number=SeqID_47799
  Homolog annotation: Hit_ID=Q2HW20; Match level="QueryCoverage=74%, HitCoverage=91%, E-value=4e-09, Identity=23%"; Hit description =Putative uncharacterized protein
MGTFIQSAWEWNLLWRRPLFDNEVASAVGFLEDISHITLQQHEADSWTWKHESNGYYSSRSAYRLLQGISDVAGMDDIFKDLWKLKIPTKATIFAWSKIQHLWWESQSWIGTSGAYPINPRHHFLQHNIGMKGGKIYKRWKCWWVALNWSIWQQRNKVIFMNAPFNGSKLLEDALFVAWTWFRAMEENFTIHFNFWSSNLPAGFQ

SEQ ID NO: 139485 - protein, 73 aa, Glycine max
  Coding DNA Sequence Number=SeqID_47800
  Subcellular localization annotation: CTP_CleavageSite=58; ConfidenceScore=5.12e-01
MVLVVTIAAALTSIIPFMLIIVTICSFKASVSAFICSCTSSISPITLALARVWTWGCDASSIGACRPRIFFIN

SEQ ID NO: 139486 - protein, 97 aa, Glycine max
  Coding DNA Sequence Number=SeqID_47801
MGVQIATRPTWAFQKIPPEGGCFWRKQPSSPGRAGGRSEEENCSARLVIRESLEIGEKNWFREENPSRGASVTFPWEFSRRFSIVLSVLRSFFGLQP

SEQ ID NO: 139487 - protein, 368 aa, Glycine max
  Coding DNA Sequence Number=SeqID_47802
  Subcellular localization annotation: CTP_CleavageSite=38; ConfidenceScore=5.46e-01
MPTLPPFISPISPTKLMKSCYGGTSKTGVTYVKYTSLKGSTRMAGDTGSCGSRESRMQKDWRGGGCQGDKRADEAQTPTILINPDEGGEYWCNETWVGMLKKVMEVETLEDRITWELGYNVRTKFLGDDMVLLPGMSDDKAQLLIQSETESDDSLFYSLEKWTPKCRPNNRVVWLQLWGFLIQVWEMKNIRRAVAAIGDVIESDDDTEDRRRLDRARVLVRTPLPPLIRSEVIIRVGELEYRVWIVEETGFEGGSNRKGSSPSDGWSEMITSDDEGEVGDVLDDTNTNFSFSPELPNQKLSPSRTQRAEGGTDVRCCDLRPLGNIQADVTPKEKSKGTVEGMLGSSFGKLNLGDSFAGTEEEAANTKE

SEQ ID NO: 139488 - protein, 125 aa, Glycine max
  Coding DNA Sequence Number=SeqID_47803
  Subcellular localization annotation: CTP_CleavageSite=38; ConfidenceScore=5.04e-01
MPISPCGSISWSVPSRHRDRIHMTPSGPEKVQQGPGVSSSGYGPLSVLHGARNLMSSIVCRDRARRTPGGPKEVQQGPGVSSSDYGPLLVLRSARRPNKVIRPCINRAFIKKYYAPRRAQGETPQ

SEQ ID NO: 139489 - protein, 100 aa, Glycine max
  Coding DNA Sequence Number=SeqID_47804
MLWKLGRIDGDPVLRETRIWATWEYVSSVGGGQQGWWVYARIVMWKLVVHHRPTAPSTHVMEWYLEICRGGQETLGTSGGVLLPKTKLDQSRPNPGIVGQ

SEQ ID NO: 139490 - protein, 97 aa, Glycine max
  Coding DNA Sequence Number=SeqID_47805
METLQVSQVPELRRSEFLIGGYVGARASLLSTIPPFVAMTQELVARGDTLRLSAPRHSVTPSVIDEQRPIWSSAPLPEMSSFPDGHLSMSHMFQNYV

SEQ ID NO: 139491 - protein, 56 aa, Glycine max
  Coding DNA Sequence Number=SeqID_47806
MKILSSRVVFTLEEGISTSYVDKSGAFAPTYPPLERKSDLRSSFLCVNQVILFTRK

SEQ ID NO: 139492 - protein, 210 aa, Glycine max
  Coding DNA Sequence Number=SeqID_47807
  Homolog annotation: Hit_ID=A5BSR3; Match level="QueryCoverage=57%, HitCoverage=37%, E-value=4e-08, Identity=32%"; Hit description =Putative uncharacterized protein
MARTKRYGQMTSKVAKEISDRIDSLEEQMTQGSFVPHGRDDILNTAIGKPEHPGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKGSNVETVDVDPSGDKNVSLKPTMGLYVQRQHTTVLVALGKICEGGSAIHNVTYADDVVR

SEQ ID NO: 139493 - protein, 153 aa, Glycine max
  Coding DNA Sequence Number=SeqID_47808
  Homolog annotation: Hit_ID=Q2QVF2; Match level="QueryCoverage=47%, HitCoverage=8%, E-value=1e-09, Identity=40%"; Hit description =Transposon protein, putative, CACTA, En/Spm sub-class
  Subcellular localization annotation: CTP_CleavageSite=63; ConfidenceScore=5.79e-01
MVSPPASPPPPSPPPPPPPSHTSPLSSAMKRTRKASRLRSLSTRPPGAKRPVVHVDPATDKVDGSHRKKLRTYLGNVTRDKVDVTYKNWKEVPTSQNDLIWEDIQVEFEILEASDSRTKKKLLQTVGERWRQFKSDLMKKWALTADQDGVDDN

SEQ ID NO: 139494 - protein, 61 aa, Glycine max
  Coding DNA Sequence Number=SeqID_47809
MKNGEEQRSTMKNFHRIAYGSVTEPKCIAKGLEHFETAPPSPIYRQKREVLAAQRLNEEDF

SEQ ID NO: 139495 - protein, 66 aa, Glycine max
  Coding DNA Sequence Number=SeqID_47810
MNPKRIKVIPEWPTPPSVEGRNPEYQEPRDLRSNPFQGGGNDAIIPCGHWIEKTPCRLGQRSKVRP

SEQ ID NO: 139496 - protein, 220 aa, Glycine max
  Coding DNA Sequence Number=SeqID_47811
  Pfam annotation: Domain name=zf-CCHC; Domain location=8-25; Score =22.6; E_value=0.00058; Accession=PF00098.14; Description=Zinc knuckle
MQEKTSSIKCFKCLGRGHITSQCPTTKSMIMRGQDIYSSQDKATTSPSSSESEKAKGEESSEEIYPQEERQPLVVKEKCKEVSVSSKRLAKKETHFTIKTNIKETFPLRQPPHFLFCKKTLASIATLLGLQFIPQSQNRHQVPKIGGMMNVLSGATLFCKITRAPNIFMVCVHRDPLGLGSSSSMDSFASWKMNGSGMEKEEREETPLQGEDESRRSSPP

SEQ ID NO: 139497 - protein, 39 aa, Glycine max
  Coding DNA Sequence Number=SeqID_47812
MQEMAPKKLSTKRSRRDAKGEGTSAAPEFDSHHFKSAEH

SEQ ID NO: 139498 - protein, 106 aa, Glycine max
  Coding DNA Sequence Number=SeqID_47813
SFGVPVTPSKVIRSSITQAFIEKYCMPRQAQGDAPQAADAPPPPHQADPAGSLGMERYLKHLVAWPGDWSEAQVGEELAGSPGAAEEACMDEEMMDLLGFLGGSGA

SEQ ID NO: 139499 - protein, 38 aa, Glycine max
  Coding DNA Sequence Number=SeqID_47814
MATPMSTACYLDKDETGQSIDIKKYRDFKQIPKNHILV

SEQ ID NO: 139500 - protein, 207 aa, Glycine max
  Coding DNA Sequence Number=SeqID_47815
  Gene Ontology: Mol. function=homocysteine S-methyltransferase activity; Cellular component=intracellular; Biological process=folic acid and derivative biosynthetic process
  Homolog annotation: Hit_ID=P37586; Match level="QueryCoverage=100%, HitCoverage=16%, E-value=1e-106, Identity=92%"; Hit description =Methionine synthase
  Pfam annotation: Domain name=S-methyl_trans; Domain location=1-207; Score=179.8; E_value=6.9e-51; Accession=PF02574.7; Description =Homocysteine S-methyltransferase
MGTMIQGYRLSEDDFRGERFADWPCDLKGNNDLLVLSKPSVIKDIHNAYFEAGADIVETNTFNSTTIAMADYQMESLSAEINFEAAKLARACADEWTARTPDKPRYVAGVLGPTNRTASISPDVNDPAFRNITFDQLVAAYRESTKALVEGGSDLILIETVFDTLNAKAAIYAVKEEFEALGVDLPIMISGTITDASGRTLSGQTTE

SEQ ID NO: 139501 - protein, 328 aa, Glycine max
  Coding DNA Sequence Number=SeqID_47816
  Gene Ontology: Mol. function=phosphoprotein phosphatase activity; Biological process=intracellular signaling cascade
  Homolog annotation: Hit_ID=Q5XM22; Match level="QueryCoverage=43%, HitCoverage=97%, E-value=2e-29, Identity=45%"; Hit description =Resistance-like protein HAAS-2
MDDAVQMLVDLLMVSPESARAETVQCRGSYVRLQWVCDIYQHRCQAGHWTAAARPYLLHLLGCTLFANKSATNVHVVYLEALRDLSMTERYAWGVAALVHMYDQLNDASMSHSRQLGGYITLLQIYEHFPSVAESTADQDYDEASPRACRWIATKKTVKSIRTPLYRERLDRLRIPDVCWIPYGEHREVRDFHVRSCYSGLLRWGPVAVYYRPERVVQQFGYTQTIPAPPVDSWVSYDDIHDRWMHYEDHIVPAGEVCVVPGACSNDYIDWFFRISHPFMTPGHAVDHLPHGHAPQPRVVPQAPQTDILRVPEPGASSTSTEEPRHAV

SEQ ID NO: 139502 - protein, 41 aa, Glycine max
  Coding DNA Sequence Number=SeqID_47817
  Subcellular localization annotation: CTP_CleavageSite=22; ConfidenceScore=5.31e-01
MGSPPASPPPPPALSDASASPSAVKRTRKASRLRSLSTRPP

SEQ ID NO: 139503 - protein, 62 aa, Glycine max
  Coding DNA Sequence Number=SeqID_47818
GQDHLELPSGVGTKHEQQKPIKVRQRRGQDWPYLVVYYLQVLRNGCNWGWGHDRLIVAPSIR

SEQ ID NO: 139504 - protein, 42 aa, Glycine max
  Coding DNA Sequence Number=SeqID_47819
MGEAEELPLLATVAKVNPMLPSGLKQMNHPTSNMVGKNLGST

SEQ ID NO: 139505 - protein, 107 aa, Glycine max
  Coding DNA Sequence Number=SeqID_47820
AHESSHCIPIEEHTREVHYMGNQQRQGYNQGGFSEFQQGPYNQQGQWRSHPGNQFNKDQGGPSNRSHQQGPNIFQRTTKLEETLAQFMQVTMSNHKSTESALKNLEI

SEQ ID NO: 139506 - protein, 96 aa, Glycine max
  Coding DNA Sequence Number=SeqID_47821
MYDIATIMPISPCGRVTPTRHPVDPENSNRALGFPALVMGLYQSYRVPVPPGKGSRPQDTQWTQRNQQGPGVSSSDYGPLSILRGACRPQQCHQAP

SEQ ID NO: 139507 - protein, 76 aa, Glycine max
  Coding DNA Sequence Number=SeqID_47822
MGAKYLEAVKQRLHAIKQWFPDEIREINSWGSRLDGGGCMNGNQFMGLRTRFDGGGCTNSARQSIREAPDSMVEDA

SEQ ID NO: 139508 - protein, 173 aa, Glycine max
  Coding DNA Sequence Number=SeqID_47823
  Homolog annotation: Hit_ID=A6FJQ2; Match level="QueryCoverage=21%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPVQPDRCALSGNYRLEFQP

SEQ ID NO: 139509 - protein, 118 aa, Glycine max
  Coding DNA Sequence Number=SeqID_47824
MEGLVDLAAIDAFLAFHHGKESPVVAILAMYDTFDRGCEKSSARIVCCALALYVWMSKCSLDGIRGCINYNLVLAIRQLGYPMRGVPSDESITPFIARGFSDHNARVLQGVRKAWDAA

SEQ ID NO: 139510 - protein, 69 aa, Glycine max
  Coding DNA Sequence Number=SeqID_47825
MEDCLEGPHLGNHETQLQTRKWRTHEGKRNTWGSEKGGEWRIALRVRTQAIMKQSSKLESGGHMNSVRQ

SEQ ID NO: 139511 - protein, 77 aa, Glycine max
  Coding DNA Sequence Number=SeqID_47826
ATLEDPLPRLSATGVFAVGAQKPFCLHVAHIAAVRRVTHAVRALGGQRCADAVLAAAVLCASAQQQSGAADFSAYPE

SEQ ID NO: 139512 - protein, 282 aa, Glycine max
  Coding DNA Sequence Number=SeqID_47827
  Homolog annotation: Hit_ID=A9R3S2; Match level="QueryCoverage=19%, HitCoverage=85%, E-value=7e-14, Identity=69%"; Hit description =Putative uncharacterized protein
MLVDIPAAQQSRIFGIIQSSVWVGEQWRGQTQRATGGRTSGDGGIFLLVGFEVCLELFVDGDHIGSIAVQRAQFTGAYQFDDQLQGGLFWAAGRMGNFMRHQISLLIVVSAAQFSPDCAANGRGAGTHSHAFRTTGMVQKESVMLIGFVLLVSACGHDACDALPVSERIYPTKVACEEMADRIHKVRPNVVLLCGEVHPASAAGCRFTIRPPLNLLRAIRAKPTALRAAACAICASMSMTANMPEASELPWQPRGRQQVVHQFQHQNNHHQHPELVAAYPIL

SEQ ID NO: 139513 - protein, 683 aa, Glycine max
  Coding DNA Sequence Number=SeqID_47828
  Gene Ontology: Mol. function=lactate transmembrane transporter activity; Cellular component=integral to membrane; Biological process=lactate transport
  Homolog annotation: Hit_ID=A7MNF4; Match level="QueryCoverage=68%, HitCoverage=83%, E-value=0.0, Identity=72%"; Hit description =Putative uncharacterized protein
  Pfam annotation: Domain name=Lactate_perm; Domain location=236-683; Score=770.8; E_value=8.7e-229; Accession=PF02652.5; Description=L -lactate permease
LFHLRCLAAGCVSPAGLVGAGRRLAAGRDDSEPGCRRAADAAAGARCRSPSATDCQSAVSAGRDERVSFCAAAGAVAVGRHRRLRSRCRVPAGDGAGARSSAAAAGRRAAGGLHAGRRIHHRRLHAVYCRSVAGAHPQFCQRMADAGRRDAGADRTQSAFSSAQLCARLWCGSALIGPTNKARQLQCGPTNCGAEPGNNLRRTPAFADAPHPSGDLWRNGMQVWQQNYDPLNNLWLSSLVAVIPIVFFFFALIKLKLKGYQAGTITVVLALLVALLLYGMPVPQALASVAYGFLYGLWPIAWIIVAAVFVYKISVKTGQFDIIRASILSITPDQRLQMLIVGFSFGAFLEGAAGFGAPVAITAALLVGLGFNPLYAAGLCLIVNTAPVAFGAMGIPIIVAGQVTGLDSFQIGQMAGRQLPFLTLIVLFWIMAIMDGWRGIKETWPAVMVAGGSFAIAQYLSSNFLGPELPDIISSLASLICLTLFLRRWQPVRIFRFKEPAPEAAPSGTQRYTLAQIVRAWMPFLFLTATVTLWSIPPFKALFAKGGALYDWVFSVPVPLLHELVARMPPVVSAATPYAALFKFDVVSATGTAILLAAVISVIFLRMKPAAALRTFGETLKELALPIYSIGMVLAFAFISNYSGLSATLALALAHTGQAFTFFSPFLGWLGVFLTGSDTSSNA

SEQ ID NO: 139514 - protein, 119 aa, Glycine max
  Coding DNA Sequence Number=SeqID_47829
MGYLHYPVAQTVAARFIAHFISRTVAECAINYALCKKHAETLDNRGKRLALLLQHAINHAGKLVDFKLSDVTVSAHFAHVIFVGAAGQRRVNHHRNLPQRVVALDVARQGKAVHLRHFE

SEQ ID NO: 139515 - protein, 139 aa, Glycine max
  Coding DNA Sequence Number=SeqID_47830
  Homolog annotation: Hit_ID=B0HC01; Match level="QueryCoverage=23%, HitCoverage=70%, E-value=3e-11, Identity=100%"; Hit description =Putative uncharacterized protein
MRKRHASRREKGGQVSGKRQGRNRRAHEGASRGKRLGGGAYGKTPATRPFYGSWPFAGLLLTCSFLRYPLILWITVLPPLSELIPLAAAERPSAARNSYDHDYEFELGTHADGLKYPSGYRYNHSFAISKTERLIACRD

SEQ ID NO: 139516 - protein, 206 aa, Glycine max
  Coding DNA Sequence Number=SeqID_47831
  Homolog annotation: Hit_ID=Q2HW90; Match level="QueryCoverage=82%, HitCoverage=31%, E-value=4e-20, Identity=35%"; Hit description =Putative uncharacterized protein
MANLDEWVPFMDVLALLIFGVVLFPNVDGLVDLAAIDAFLAYHHSKESPVVAVLTDLFDTFDRRCEKRSARIICCLPALCVWLVSHLFQQDVRHPCPLRSHRSCVEKRRVDWDQHLAGVGGRIVNWFPRWKEGNEGVLFSCGGYPNILLIGTRGCINYNPSLAIRQLGYPMRGATTEESLSPFLVRDLACKISRLYKESIRRGRAR

SEQ ID NO: 139517 - protein, 85 aa, Glycine max
  Coding DNA Sequence Number=SeqID_47832
  Homolog annotation: Hit_ID=UPI0000ECBAF8; Match level="QueryCoverage =48%, HitCoverage=48%, E-value=1e-16, Identity=100%"; Hit description= UPI0000ECBAF8 related cluster
MSNDVQPNGDDPFVGWQSVNSSFFKDWQSRPAGMQAWHWPSFYNVVTGKTLALPNLIALQHIPLSPAGVIAKRPAPIALPNSCAA

SEQ ID NO: 139518 - protein, 28 aa, Glycine max
  Coding DNA Sequence Number=SeqID_47833
MGGVACARQGNLNTYYLVFLNDNIEYEK

SEQ ID NO: 139519 - protein, 84 aa, Glycine max
  Coding DNA Sequence Number=SeqID_47834
  Subcellular localization annotation: CTP_CleavageSite=41; ConfidenceScore=5.43e-01
MAEPSKKRKGSSSTATAAAHHRHGPSEAPTTPIHPSFSSPRSSTLFSSDDQRLRYLSQFSSRIILDPKYLDVDFFNDETFDCYQ

SEQ ID NO: 139520 - protein, 73 aa, Glycine max
  Coding DNA Sequence Number=SeqID_47835
MTEWIVIIKKGEIVEAMSSKVILMMPKNQELSNVSSKDSRIKLQVSRFKNQDSSIKIKTQDSRFKNQEKTQSR

SEQ ID NO: 139521 - protein, 115 aa, Glycine max
  Coding DNA Sequence Number=SeqID_47836
AADAPPLPHQVDPAGSFGMERYLQHLVCQQAANHRGQVQTHECLNQLSLSLQSQGFAPFACPTPDQFRAEVAWPGDWPEAQAGEAPAEAPGDVEEARMDEKMTDLLGFLGGSGAT

SEQ ID NO: 139522 - protein, 68 aa, Glycine max
  Coding DNA Sequence Number=SeqID_47837
MELGLKCDTLKGSLFSGPIVSPPFDRDLLLSEGEVVISRDIADDALKAFHKDILATWASFKTLTSNAR

SEQ ID NO: 139523 - protein, 81 aa, Glycine max
  Coding DNA Sequence Number=SeqID_47838
MRGTVHEPQVNIGADQKFPTSNIQSCGFGMTDPLDESISCFLIRVNPLGTSYPHHQRATRPPHQRTTRPRLERATRPHLGY

SEQ ID NO: 139524 - protein, 73 aa, Glycine max
  Coding DNA Sequence Number=SeqID_47839
  Subcellular localization annotation: CTP_CleavageSite=45; ConfidenceScore=5.10e-01
MGMSSPPLITHKLISSSQDNFLFKLHSLQVFAQQNLSNSLDSDPSLSRISHMQKLLEKMAKIPGTWTCLSRNL

SEQ ID NO: 139525 - protein, 185 aa, Glycine max
  Coding DNA Sequence Number=SeqID_47840
MTGPLNESISCFLKRVDPWVLVPSPSEDYMSSPSEGCTPSPSQDYTSLPSEDCTSSPSEGYMHALKGLRVLTFRGLHALAFKGLLALILRGLRVLTFRGLHALAFRGLLALILRGLRVLTFRGLHALAFRGLHALTFRGLHVLTFRGLHVLSIRGLHVLAFRGIHVLTFRGLHVLAFRRLDALSF

SEQ ID NO: 139526 - protein, 256 aa, Glycine max
  Coding DNA Sequence Number=SeqID_47841
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVNLLHPLPSWQNITKAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139527 - protein, 203 aa, Glycine max
  Coding DNA Sequence Number=SeqID_47842
MDNEKGVQEQMKADLSALKDQMASISDVMLKLQKTIEDKATTTASSTVREAEPVLQPALNPSLDRNTAVFGRMYSPQAYPYGLPLDFTPRATPEDLSQAPTFEGQLPPYDNYPGQDDGEGDTHLGPLLHLKDPSPHELPPPNIVRHIPASPILVKESVPFAEDKGKIEALEERLRAVEGLGQLPILGFNGFMSRAQYLHSSQV

SEQ ID NO: 139528 - protein, 111 aa, Glycine max
  Coding DNA Sequence Number=SeqID_47843
RSLSIGAGVVSSIGYRKERDGSWVKKDAQPQAADDRSPSPPPQRDDSSSFMQNVLDKLDGLLTFVGERFDSLDSRIDVIDARFAGMDTRITQLEEDMSFICQCFDLPPPSS

SEQ ID NO: 139529 - protein, 86 aa, Glycine max
  Coding DNA Sequence Number=SeqID_47844
MFFKRFTLCSIRACKPRIFFINGFLCFLEDEWQRNGERERERRRHFKEKMSLEEAHHHRRPWIRAWRKKEMNEGRGREEHEILCSK

SEQ ID NO: 139530 - protein, 70 aa, Glycine max
  Coding DNA Sequence Number=SeqID_47845
MKFVVEDIWYRIGRGRHLGELPVLYAICGSRRGVIRNSLLECLQARNGFRKNNGGEFQLKGLPEETRELG

SEQ ID NO: 139531 - protein, 186 aa, Glycine max
  Coding DNA Sequence Number=SeqID_47846
  Gene Ontology: Cellular component=1-2nm peptidoglycan-based cell wall; Biological process=regulation of cell growth
  Homolog annotation: Hit_ID=A6TF22; Match level="QueryCoverage=100%, HitCoverage=26%, E-value=1e-90, Identity=89%"; Hit description =Putative dehydrogenase
  Pfam annotation: Domain name=IgaA; Domain location=1-186; Score= -264.3; E_value=2.3e-09; Accession=PF07095.2; Description =Intracellular growth attenuator protein IgaA
MCNIRTPGAWSAKEASPFTPFDCSQIIWNDAPPLPLPESDIVGKATALVQAVQRQLHPDPDDDSHVSPALRSAIQKSGMVLLDDFGDIVLKTNDLCSAKDDCVRLKNALVNLGNTRNWEALTKRATAGKLDGVNVLLRPVSAESLENLVTTSTAPFVMRETSRAAQALNSPAPGGFLIASDEGSEL

SEQ ID NO: 139532 - protein, 69 aa, Glycine max
  Coding DNA Sequence Number=SeqID_47847
  Subcellular localization annotation: CTP_CleavageSite=33; ConfidenceScore=5.21e-01
MWVQIATRPTWAVQKIPPEGGCFWRKLPSSPGRAGKSKPRHFRNVSVGDFAKIFNRSLTFFVRSSVFNW

SEQ ID NO: 139533 - protein, 135 aa, Glycine max
  Coding DNA Sequence Number=SeqID_47848
  Homolog annotation: Hit_ID=A0ST23; Match level="QueryCoverage=23%, HitCoverage=65%, E-value=1e-11, Identity=100%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPRIPIGPMRFVGKPVVPAALMNRPTRGERRFAYWALFRFLAH

SEQ ID NO: 139534 - protein, 86 aa, Glycine max
  Coding DNA Sequence Number=SeqID_47849
MGEVDEVQERIKDDMEAMKEQMATMIEVMMSMKKIMEVNAAVVATTSAIAKVNLTPSSSLNQINNLISGMVGKELGSMGGPHFVQV

SEQ ID NO: 139535 - protein, 128 aa, Glycine max
  Coding DNA Sequence Number=SeqID_47850
MAAQLIHDRVVMECLRVFGRPSKAMRVHPEQPAHTLQQPVEWILPTPTPYRLVEPVQVIEVSSSEEDLEEDPEELPPVPAMDAPDLPEDDEDPLPDVDSPEDIILASEADSTEESGPGGTTNSDDSSS

SEQ ID NO: 139536 - protein, 70 aa, Glycine max
  Coding DNA Sequence Number=SeqID_47851
MADEHQHRVTLEDYSSSSVPQFFTREAKKWLHSFKGNNLKTWEEVVEKFLKKYFPESKTAEGKVVISSFH

SEQ ID NO: 139537 - protein, 144 aa, Glycine max
  Coding DNA Sequence Number=SeqID_47852
MQNPKNVSAITLRSGNQIQVPPPVAAPAPEPVKLHSTPEKEDEIVAQKRKLPNKNFHAGGPSSSNSNLQQPPIPLPFPPRAIPNKKMEEAEKDILETFRKVDVSSIGACRPRIFFINGFLYFLEDEWQRNGEGRERGDATSRRR

SEQ ID NO: 139538 - protein, 217 aa, Glycine max
  Coding DNA Sequence Number=SeqID_47853
  Homolog annotation: Hit_ID=A5BSR3; Match level="QueryCoverage=54%, HitCoverage=38%, E-value=1e-07, Identity=35%"; Hit description =Putative uncharacterized protein
MTSESAQEIADKIDSLEEQVTQGSFVPHGRQDILNTAIGRPNHGGRVRVAGSGVTITQYYGRALRTCSNSSTSITQQQLDEVIARLREGMSGQIREELRSQIKEELRTQLEEENKRSLERMTMALKEAIKIELSHKGSLESLIIQPELQQLGARVSTKGSNAQSNAQPSREYDGDVIPKMGLYVQRKDGTLGLVAMGRIMDRDSVIRTVAYADDVVR

SEQ ID NO: 139539 - protein, 72 aa, Glycine max
  Coding DNA Sequence Number=SeqID_47854
  Homolog annotation: Hit_ID=Q51617; Match level="QueryCoverage=51%, HitCoverage=53%, E-value=2e-12, Identity=94%"; Hit description =Putative uncharacterized protein
MTVKTSDTCSSRRRSQLVCKRMPGADKPVRARQRVLAECTICGVNTAQMRKEKIPHQAPFTIQAAQLLGRAI

SEQ ID NO: 139540 - protein, 96 aa, Glycine max
  Coding DNA Sequence Number=SeqID_47855
MRQFGYSQTISTLPVDSWVSYDDIHERWIHYSDHMVPADEVCVVSVIPQAPQTDIPHVPEPGAPSTSARPAVEEPRHAVVGAPSEPRGGHARLIDT

SEQ ID NO: 139541 - protein, 132 aa, Glycine max
  Coding DNA Sequence Number=SeqID_47856
ATLPEGRKADRYPVSGRVGTGERTRELPGGHACLWKNASNAAFLRFLAFCWPFAHMFFPALSPDSVDNRITAFEKRKSAQYANRLSPRVGRFINAAGTTGFPTGKRAVSATQLIYDHDYEFELGTQSFFEEW

SEQ ID NO: 139542 - protein, 86 aa, Glycine max
  Coding DNA Sequence Number=SeqID_47857
MGKAVKTELMRFSLAFANNGLPHRPIFRADPYRNSKVREWNIHLTTIERRCCLPTPVLGFAHTPKFSLIVVYLKTRDQFKAFQDTL

SEQ ID NO: 139543 - protein, 175 aa, Glycine max
  Coding DNA Sequence Number=SeqID_47858
RDAAPEGTNATPDYDSHHFRSAEHQDDEYTDFQEEIARRQWTSLVTPTAQFDPDIVLEFYSYAWPTEEGVRKARSVTLVRGGTGPMRFDEEAVAQLLCIPGQDFARTAAGRRVRIMRTSMTTLTLMRMTLLLSNVLPSDHNSDLPLPKCQLVYAILTRMSVYVAQLIADTIYLFA

SEQ ID NO: 139544 - protein, 113 aa, Glycine max
  Coding DNA Sequence Number=SeqID_47859
MVRTRGLGRALGQVTGKGVGRGDHDDSDDAPQRRRPTASARRQRVAVTADHVDEPVIPSPDVQDDPMEAPVAVEDIPADTGAEAAEDAHEGFPGGPSDPSVLTLYADHVACSV

SEQ ID NO: 139545 - protein, 89 aa, Glycine max
  Coding DNA Sequence Number=SeqID_47860
  Subcellular localization annotation: CTP_CleavageSite=33; ConfidenceScore=5.50e-01
MYAQNKSQSKRNKRGVVDKSRAFAPTYPQFVMRNSTYVVLDNCETKNSLGVFFTKMRSCFSKETKLPTDQSNICFLDEKQCVYRGRRVC

SEQ ID NO: 139546 - protein, 63 aa, Glycine max
  Coding DNA Sequence Number=SeqID_47861
MTLRRKVQGLIDAGWLKFEENRVIFKCKPLVSLLKRPAPEFGLPRPFNQRLLVLHVGGVAVKQ

SEQ ID NO: 139547 - protein, 191 aa, Glycine max
  Coding DNA Sequence Number=SeqID_47862
  Subcellular localization annotation: CTP_CleavageSite=31; ConfidenceScore=5.15e-01
MLSFNQMQSQFQSQMQSQGLTLPFEPEVGPSAARVSTKESCVGPSRNDPDTGNSDKCGLYVEENPPHLVTLGRLYEGSTIVNNISLLHDQVKVGVEEVRDADAPIPVPTEEGVVGPAKPSDRPDHDVNDPLYLMTLTIPQLFLKPLQVMWDDIVFGVFNDNFPLYIKYEDLSEIAHGGQCLRISIIQLWIL

SEQ ID NO: 139548 - protein, 67 aa, Glycine max
  Coding DNA Sequence Number=SeqID_47863
AGRGLDDAPQPKSKAPARWIVVKMPTIILGTFRNNWEAYFNDPRPLEPERLKALWIQWAQFYLRVRD

SEQ ID NO: 139549 - protein, 173 aa, Glycine max
  Coding DNA Sequence Number=SeqID_47864
GLHVLAFRGLHILANRGLHALTFRGLHVLALRVLHALTLGTSYPTDRLRGLHVLTIRGLHALTSRGLHKGLHVLTIRGLHALTSRGLHVFALRGLHALTLGTSYPHRQRTTRPRLERTTRPHHQRAARPYLLEDYMTTRPHHQRAARPYLTRGLHVLALRGLHALTLGTSYPH

SEQ ID NO: 139550 - protein, 92 aa, Glycine max
  Coding DNA Sequence Number=SeqID_47865
  Subcellular localization annotation: CTP_CleavageSite=66; ConfidenceScore=5.50e-01
MASMDTSAMVNSKIFPCNLGMRGSGEFVPFLDTTSRGSKMPQRTFLRRRHGPSVGLFTVGIKKNPYAMPMQKTQCGNVHSMTIFTEHKQKGI

SEQ ID NO: 139551 - protein, 229 aa, Glycine max
  Coding DNA Sequence Number=SeqID_47866
MIGPLDESISYFLIRVDPWVLVPIALRGLHALTFRGLHVLAFRGLHALAFRGLHVLTFRGLRALAFRGLHALAFRGHTPSPSKDYTSLPSEDYTSSPSEDYTSSPSKDYISSPSEDYTSLLLEGYTPSPSEDYTSSPSEDYMSSPSEGCTPSPSEDYTSLPSEDYMSLPSEGYTTSPLEDYTSSPSEGYTPSPLEHYMSSPLEDYTSSPSEDYPSSPSEGYTPSPSKDY

SEQ ID NO: 139552 - protein, 75 aa, Glycine max
  Coding DNA Sequence Number=SeqID_47867
MGVENGIIIIKKGEIMEAMLSKIILMMPKTQVKNQESSKFQESKSCSIKASFKNQRVVQSRFKIKVKIQEKTQLR

SEQ ID NO: 139553 - protein, 67 aa, Glycine max
  Coding DNA Sequence Number=SeqID_47868
MWVRAIGLFAQATYAPEFGLPRPFNQRLLVLHVVGGTVKQRVKDNPSLVFKNPLQQETHGLLIPFQK

SEQ ID NO: 139554 - protein, 128 aa, Glycine max
  Coding DNA Sequence Number=SeqID_47869
MARAGDNGGVYHQLDESQRLFLDAWTTQMQRLLNRNKEEPYRRIAKSSSFTLKPLSPRKVCDDQIRMREKREQEKENSEAPQRNMKKKSDTPEEKSDTQERESDNSNQNLKMSFPREIPQWTATLQEA

SEQ ID NO: 139555 - protein, 50 aa, Glycine max
  Coding DNA Sequence Number=SeqID_47870
MKILSSGVVFTLEEVDKSGAFAPTYPPSKRKSDLRSSFLCVNEVILFYLK

SEQ ID NO: 139556 - protein, 198 aa, Glycine max
  Coding DNA Sequence Number=SeqID_47871
  Homolog annotation: Hit_ID=A0ST23; Match level="QueryCoverage=22%, HitCoverage=91%, E-value=2e-11, Identity=73%"; Hit description =Putative reverse transcriptase
DAGSRQARQGASAGVGGCRGWLNYAASEQIVLRVHHMRAIGAGLFAITPAGERGMCCKAIKLGNARVFPDLGHHEVGDYDGDNHGVVLASEVDTLEVSISESDRRETSGQWCIDIVDIYALNGMEVALSGLVRLFSVRESAYNGVDHPSYLLGTELEFVIMVIAVSFGKPVVPAALMNRPTRGERRFAYWALFRFLAH

SEQ ID NO: 139557 - protein, 83 aa, Glycine max
  Coding DNA Sequence Number=SeqID_47872
  Subcellular localization annotation: CTP_CleavageSite=37; ConfidenceScore=5.16e-01
MYNYVLGTSSKISESIQRLNCRSRWQLSQRALRGRARARLTGALSKGGKMRGVATNVYLWKTSGKPKETGQNENSKFGSCIYA

SEQ ID NO: 139558 - protein, 110 aa, Glycine max
  Coding DNA Sequence Number=SeqID_47873
MILKEELAACARSKRSLDQHLEATEQSMLAIIGQYKEELNQSVTHEQKLVEDFAQVYAEKEVCLDLEWKSRPPASISLSKSHGRSVYGPRGDSWANQLLSAHDRFDGPYN

SEQ ID NO: 139559 - protein, 27 aa, Glycine max
  Coding DNA Sequence Number=SeqID_47874
MDSIDEEDPRPSSSHGATSCGSIIFQS

SEQ ID NO: 139560 - protein, 223 aa, Glycine max
  Coding DNA Sequence Number=SeqID_47875
  Homolog annotation: Hit_ID=A5AZ88; Match level="QueryCoverage=70%, HitCoverage=12%, E-value=5e-08, Identity=32%"; Hit description =Putative uncharacterized protein
MERSMIDAASGGALGDMTPAEARNLIKKMASNSQQFTARNDAIVIRGVHEVATNPSASSETKKLEGKLDALVNLVTQLALNQKSVPVARVCGLCSSADHHTDLCPSMQQPGAIEQPEAYAANIYNRPPQPQQQNQPQQNNYDLSSNRYNPGWRNHPNLRWSSPQQQQQQPAPSFQNAAGPSRPYIPPPIQQQQQPQKQPTVEAPPQPSLEELVRKMTMQNMQF

SEQ ID NO: 139561 - protein, 136 aa, Glycine max
  Coding DNA Sequence Number=SeqID_47876
  Homolog annotation: Hit_ID=A7QZ67; Match level="QueryCoverage=86%, HitCoverage=16%, E-value=3e-54, Identity=77%"; Hit description =Chromosome undetermined scaffold_265, whole genome shotgun sequence
  Pfam annotation: Domain name=DUF821; Domain location=1-136; Score= -93.9; E_value=2.3e-14; Accession=PF05686.3; Description=Arabidopsis thaliana protein of unknown function (DUF821)
MVYSVGRVERRHYEDTMAEQRAYAYWKGNPAVAETRQDLIKCNVSENQDWNARLFAQDWFRESQEGFNKSDLPSQCTYRYKVYIEGSAWSVSQKYILSCDSTTLLVKPKYYDFFTRGLIPVHHYWPIKDDDKCRSI

SEQ ID NO: 139562 - protein, 180 aa, Glycine max
  Coding DNA Sequence Number=SeqID_47877
  Homolog annotation: Hit_ID=A6H5B3; Match level="QueryCoverage=37%, HitCoverage=84%, E-value=1e-27, Identity=88%"; Hit description =Putative ribosomal protein S3
RGKESKSDSRSSGERNGSSLNRENGVVGELYKCRAARRSSRECCTLDGESPVAESITSLRSDPSSMGHVESRVNQQGPPCKAKYSWVTDSEVVPETTGAVAKASLHRAIVTAYGPEPGGEMPLEPRASWFSPKCVEAQQLTRHLGVKHCFGAGRESASSSRGNSPDHQLRPLNDRSVIKE

SEQ ID NO: 139563 - protein, 143 aa, Glycine max
  Coding DNA Sequence Number=SeqID_47878
MKATIRSFQEWTREVIRDQHSSFSASPINSALFTILGQVAPWVYHQLLALQWHIRAKARSRLDCDGEFHVSPPRLRDMCISVGLVGNSQGYWNGSHSTGFSFILTLFICPSFLIRLSMMTKFAFFQTHTDPFTGKDQIRKALK

SEQ ID NO: 139564 - protein, 193 aa, Glycine max
  Coding DNA Sequence Number=SeqID_47879
  Homolog annotation: Hit_ID=A0ST23; Match level="QueryCoverage=23%, HitCoverage=91%, E-value=2e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLSTLEDPPSKIYVALIETSESDSTQREIMVIRRPFAIQRQASPLARRDKLWLSAPFWGTELEFVIMVIAVSFGKPVVPAALMNRPTRGERRFAYWALFRFLAH

SEQ ID NO: 139565 - protein, 51 aa, Glycine max
  Coding DNA Sequence Number=SeqID_47880
MAEEHDQRITLEDYSRLPNEDPYAHLAMFIEICNTIKITGVPDEAIRMGIL

SEQ ID NO: 139566 - protein, 149 aa, Glycine max
  Coding DNA Sequence Number=SeqID_47881
NPSDLQPFDPEIDRTFHRLVRHHFIPFDHSEHSITGESVHSVIGDFEHPDLEHYNFEHSDSEHSDFAHSENMTQPPPRERTLREMAAPDFTYESLCIQYPDVDVPYVLKTELIHLLPKFHGLAGFSSFIRGSGKGLAVLPCSKVHHELG

SEQ ID NO: 139567 - protein, 154 aa, Glycine max
  Coding DNA Sequence Number=SeqID_47882
  Subcellular localization annotation: CTP_CleavageSite=51; ConfidenceScore=5.61e-01
MYPLLFSVTTTQVDVSSTCTTKDVPSNVLRQSSQAVSPSFFWKREKRDTKRIQAVSPWRILFGKGRKRDTKEFRQLVLRSFGKGRRETQKEFRQLVLGEFFFAKGEENEKINSTLLFSMFRKPENFRKLLAKEEEEEDVQRDSKIVKDCNNCYE

SEQ ID NO: 139568 - protein, 110 aa, Glycine max
  Coding DNA Sequence Number=SeqID_47883
MTLQVKPEFNRGGENPCQPVGHLSAEFTVVIHQRADGVAMHIQHLRQIIHFEVERFEKFILQDVPHAGALFGTGSGPEGIVSAIFCSGADPDTDPRLRLLPTGKLADTAR

SEQ ID NO: 139569 - protein, 109 aa, Glycine max
  Coding DNA Sequence Number=SeqID_47884
  Homolog annotation: Hit_ID=Q2HW90; Match level="QueryCoverage=78%, HitCoverage=17%, E-value=1e-08, Identity=39%"; Hit description =Putative uncharacterized protein
EWAPFIDVLTLLIFGVLLFPNVDGLVDLTAIDAFLAFHDRKEIPLIAILADLYDTFDRRCEKNSARIVCCTLTLYEANWDRLLASKEGASVNWFPRWKEGRTDILVSCG

SEQ ID NO: 139570 - protein, 110 aa, Glycine max
  Coding DNA Sequence Number=SeqID_47885
  Subcellular localization annotation: CTP_CleavageSite=45; ConfidenceScore=5.41e-01
MNSLPSAVHVSSTFESGVPRIDCLALFANSPFSTFIRSPMNLLPSAVHSGAPRIDCLALFANSPFSTFIRSPMNSLPSAFHVSSTNESGAARIDCLTLFANSPFSTFCGA

SEQ ID NO: 139571 - protein, 139 aa, Glycine max
  Coding DNA Sequence Number=SeqID_47886
  Homolog annotation: Hit_ID=Q6UUU1; Match level="QueryCoverage=43%, HitCoverage=40%, E-value=1e-18, Identity=78%"; Hit description =Putative uncharacterized protein
  Subcellular localization annotation: CTP_CleavageSite=32; ConfidenceScore=5.61e-01
APTPSSSTLPPSSSTEIPVIPPSPSQIPLPAPVSAVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139572 - protein, 127 aa, Glycine max
  Coding DNA Sequence Number=SeqID_47887
MTRGNPSDLQPFDPKIDRTFHRLVRHHFIPFDHPEHSITGESVHSVIGDFEHPDFEHYNFEHSDSKHSDFEHSENMAQPPPRERTLREMAAPDFTYESLCIQYPDEDVPYVLKTGLIHLLLKFHGLA

SEQ ID NO: 139573 - protein, 71 aa, Glycine max
  Coding DNA Sequence Number=SeqID_47888
MKHSSKLFGSRMQDRKRNSWGSEKKARMEDCTRGSLLVNDEAWLQTLWMEDARSKKQFMGLRKKGEDGGLH

SEQ ID NO: 139574 - protein, 73 aa, Glycine max
  Coding DNA Sequence Number=SeqID_47889
RHSVQLGHSVHFEHPDHIEHFVAGDSEYSDFEHSNTNFHTENMAQPPPRERNLREMVAPDFTYESLCIQYPDE

SEQ ID NO: 139575 - protein, 47 aa, Glycine max
  Coding DNA Sequence Number=SeqID_47890
EQNCLKQWSIAGMGLKGRTQVEARITIDRSSSHAQHWTSGKRSWGTT

SEQ ID NO: 139576 - protein, 159 aa, Glycine max
  Coding DNA Sequence Number=SeqID_47891
MTDLVRAEDDVNLHVPTGLSAAIDEGAEDDVSLCVLSGFSSYRQQKVYTDNHSGISAVSVTQKQQKVYTDNHSGIFARQRDSKVSMTDLMSAEDNILVSAEDDGNLRVPTGLSIAIDEGSQKTTLVSACYQAFRLTDNKKFIRITTRVFPAVSVTQKSV

SEQ ID NO: 139577 - protein, 78 aa, Glycine max
  Coding DNA Sequence Number=SeqID_47892
MDINNSLLSHDVGLLDEHVEKKGTSFVVQVEGTSTWVVVTENKRGYISCGSVQVEGTSTWLFKENKGGYIPCGSLLVK

SEQ ID NO: 139578 - protein, 75 aa, Glycine max
  Coding DNA Sequence Number=SeqID_47893
EPVQLIEVSSSEEDLEEDPKELPPELAMDAPDLPEDDEDPLSDVDSPEDIMSASEADSTEESGPEGTANSDDSSS

SEQ ID NO: 139579 - protein, 87 aa, Glycine max
  Coding DNA Sequence Number=SeqID_47894
  Gene Ontology: Mol. function=phosphoinositide binding; Biological process=intracellular signaling cascade
  Homolog annotation: Hit_ID=A7P9B0; Match level="QueryCoverage=81%, HitCoverage=7%, E-value=2e-33, Identity=92%"; Hit description =Chromosome chr3 scaffold_8, whole genome shotgun sequence
  Pfam annotation: Domain name=PX; Domain location=1-69; Score=10.3; E _value=0.0069; Accession=PF00787.15; Description=PX domain
YRNFERLHRHLKDIPNYTLHLPPKRIFSSSTDDAFVHQRCIQLDKYLQDLLSIANVAEQHEVWDFFSVSSKAIAILCMVAPPVNLLS

SEQ ID NO: 139580 - protein, 157 aa, Glycine max
  Coding DNA Sequence Number=SeqID_47895
  Homolog annotation: Hit_ID=Q6WAY6; Match level="QueryCoverage=22%, HitCoverage=6%, E-value=1e-07, Identity=66%"; Hit description =Putative uncharacterized protein
QGKSSGSYLGGICSIPLTGGVRKTVHGIVCCLPRSLCVVDFTPIPTRHETPHDQLVSSLEGRARKEFFSRVGTILNVPLIGTRGCINYNPALAIRQLGYPMRGAPTEESLLPFLVRDLGAQGLKVIQRIPQGVEESVRKDKELEASETASSEVIMDG

SEQ ID NO: 139581 - protein, 111 aa, Glycine max
  Coding DNA Sequence Number=SeqID_47896
  Gene Ontology: Mol. function=glutathione gamma-glutamylcysteinyltransf erase activity
  Homolog annotation: Hit_ID=A5C9E2; Match level="QueryCoverage=53%, HitCoverage=7%, E-value=5e-12, Identity=61%"; Hit description =Putative uncharacterized protein
MEIVDVSPIKVDIVEQIRTTGLFKHVTRWLDSKSSCCNTLANLGDKDMLPALAATKASEVVALGKLKTLTESTIRERALTAQHSSMITISKFEYEYLTNHAASVEEIADKK

SEQ ID NO: 139582 - protein, 90 aa, Glycine max
  Coding DNA Sequence Number=SeqID_47897
MAQPPPCERTLREMAAPDFIYESLCIQYPDEDVPYVLKTGLIHLLPKFHGLAGLCNMERSMIDAASGGALGDMTPTEAKNLIEKMASNSQ

SEQ ID NO: 139583 - protein, 49 aa, Glycine max
  Coding DNA Sequence Number=SeqID_47898
MDYENEQECGVNEPYVDCSDAFNTSQASWETSAWRGRLDGEVDLWDSQS

SEQ ID NO: 139584 - protein, 32 aa, Glycine max
  Coding DNA Sequence Number=SeqID_47899
MSNLGSKEDSFPSRKYTIGAHVAATWKPTYRQ

SEQ ID NO: 139585 - protein, 144 aa, Glycine max
  Coding DNA Sequence Number=SeqID_47900
GAKYVSARLPTQLAQKKVYTDNHSGISACQRDSYVSMTDLVSVEDDNVYTDNHSGISARQRDSNVNMTDLVSVEDDQKNVYTDNHSGISARQRDSNVNMTDLVSAEDDGAEDDVSLCMLSGFLSYRYQKNVLKVRTTTWVSPHV

SEQ ID NO: 139586 - protein, 407 aa, Glycine max
  Coding DNA Sequence Number=SeqID_47901
  Homolog annotation: Hit_ID=Q2HW90; Match level="QueryCoverage=52%, HitCoverage=40%, E-value=7e-26, Identity=37%"; Hit description =Putative uncharacterized protein
MASQEKWGPFADILALLIFGVVLFPNIDGLVDLAAIDAFLAYHHSKESPVVAILADLFDNFDRRCEKNSAWIVCCLPALCVWLISHLFQQDTRHPCPLQSYCSCSEKGRVDWDQHLAGIGGSAINWFPRWKEGKEGVLFSCGDYPNVPLIGTRGCINYNPALAIRQLGYPMRGTPTEESLSPFLVRDLGAQGLKVIQRIHKAWRSPLRKDKELRGIRNGVIGGYHGWLRIHMRGLDWLSKLKVIDEENFEAPEEDEEVRALKLELGKARLAKEKFKSAATHIRKECTELQEENAVTVRALEQETKRARKEEYGREKFRGALWGSNNELKLRRKERDRSRVHGMILKEELIVCARSKRSLAQHLEATEQSMLAIIGQYKEELNQSVAHEQKLVEDFAQVYAEKEARGR

SEQ ID NO: 139587 - protein, 82 aa, Glycine max
  Coding DNA Sequence Number=SeqID_47902
  Homolog annotation: Hit_ID=Q2AA51; Match level="QueryCoverage=78%, HitCoverage=19%, E-value=3e-08, Identity=45%"; Hit description =Retrotransposon gag protein
  Pfam annotation: Domain name=Retrotrans_gag; Domain location=1-76; Score=3.3; E_value=0.025; Accession=PF03732.8; Description =Retrotransposon gag protein
KAKRWLHSFKGNSLKTWEEVVEKFLKKYFPESKTVEGKATISSFHQFPDESLIEALERFRGCTICGGTHESGLCIPFEDQMQ

SEQ ID NO: 139588 - protein, 109 aa, Glycine max
  Coding DNA Sequence Number=SeqID_47903
MVTSILQLDSVNRFVKARAWFNPVTQGMAILIANTSSTFHRDERLGNTHAMHGKWENARCPMCAVKKTIWIFRLPTTKDETHIQRMCDGMMQMRESATGELTQHGNILK

SEQ ID NO: 139589 - protein, 215 aa, Glycine max
  Coding DNA Sequence Number=SeqID_47904
MGDQEETQEQMKAGMSALKEQMASMMEAMLGMRQLMEKNAATAAAVSSATEADPTLLATAHHPPPNTLGRGRNTLGHNNNPHLGYNREAYPYGLPPNYTPPVMQDDAGHISSPILEREPLRQPDEVHEDHQEYAQGDVEFCPPIPVEGPTPNTLPQPNLTAQPIILSTEGPPPMLLSPQNSKCQTLTSIKGLPVPRTVSRCIVARWAHTLGMRCY

SEQ ID NO: 139590 - protein, 72 aa, Glycine max
  Coding DNA Sequence Number=SeqID_47905
MGSSQAPSLKKRFYQVKVKSLGTTRLKELGQLIGQLQRQAFRKAYGKIWDLAMAKVSTEAIASLAQYYDQSL

SEQ ID NO: 139591 - protein, 110 aa, Glycine max
  Coding DNA Sequence Number=SeqID_47906
MTRGNPSDLQPFDPEIDRTFHRLVRHHFIPFDHPEHSITGESVHFVIGDFDHPDFEHYNFEYSDFKNSDFEHSENMAQPPPRERTLREMAAPDFTYESLCIQYPDEDIPY

SEQ ID NO: 139592 - protein, 106 aa, Glycine max
  Coding DNA Sequence Number=SeqID_47907
  Homolog annotation: Hit_ID=Q6WAY3; Match level="QueryCoverage=54%, HitCoverage=2%, E-value=3e-07, Identity=44%"; Hit description =Gag/pol polyprotein
  Subcellular localization annotation: CTP_CleavageSite=29; ConfidenceScore=5.01e-01
MSGRSSTRQFPSWKSGGHGRTKSNVLGTSSSSDDESPEGTNTWDPPINFEQEMNQTEDEGNEDVGLPPELERMVAHEDQEMGPHQEETELVDLGIGSGKREVKIGT

SEQ ID NO: 139593 - protein, 112 aa, Glycine max
  Coding DNA Sequence Number=SeqID_47908
MALILIQRKTKVKAFLGQHLLSPKMIRGRQKQPPKTSMHEKTSSIKYFKCLGRGHITSQCPTKKTMIMKGQDIYSIQDEATTSPSSSESEEAKWEKSNEEIYPQEERQPLMA

SEQ ID NO: 139594 - protein, 148 aa, Glycine max
  Coding DNA Sequence Number=SeqID_47909
MVGYAPSSFADLVFADKRIEAGLKRGKFDHPTLMSEKSAANEEDENEEGTHIVAAIPTWPNFPPVQQGHCSANIGPSHYPPPIHPQSLLAAHPMPSANQNTNQEMNFAAKKPIEFTPIPVSYADLLPYLLDNSMVAITPAKVPQPPFF

SEQ ID NO: 139595 - protein, 302 aa, Glycine max
  Coding DNA Sequence Number=SeqID_47910
  Gene Ontology: Mol. function=motor activity; Cellular component=cell projection
  Homolog annotation: Hit_ID=UPI00006A2D9E; Match level="QueryCoverage =73%, HitCoverage=85%, E-value=2e-18, Identity=17%"; Hit description =UPI00006A2D9E related cluster
GLHALALRRLHALALRGLHALAFKGLHTLAFRGLHVLTFRGLHALAFRGLHVLTFRGLHVLAFRGVHVLPFRGLQEYRSLAFRGLHVLTIRGLHVLTFRGLHVLTFRGLHTLTFRGQHVLPFRGLHALTFRGLHLFAFKGLHALAFRGLHVLTFIGLHALAFRGLHVLTFKELHTLAFSGLHALTFQSSHLRPKGTLVDDWKFDYSIHDARHMAHLIRYRMHKALRTNAPLPYPHLVTLFLHHFKIPLEDEPFVQVKRSFAISAGAIISFGYRKDDDGQWVRKQNLPQPIPDECTLSPPPIR

SEQ ID NO: 139596 - protein, 113 aa, Glycine max
  Coding DNA Sequence Number=SeqID_47911
MDKVDIFVPHPLTNACLLIQLSPEWWGVSHWVCLLKQPALLSVDFQDRFNQRLLILHVGGERSELSRIGCWTNGLSYLKKKGESSTTRDPRSLNPFSEIRRREEEVSRKRGRL

SEQ ID NO: 139597 - protein, 131 aa, Glycine max
  Coding DNA Sequence Number=SeqID_47912
MEIGSWKWKLLEVGNESYWKLKVENGGWKLEGEVVVIMKKGENVNHEDFDDIKKNLLEKEGDVNHASFDGVEKKSHVCHHQKGGECESLFQDSLKTKSCLKTMCFQDMQGSGNRLPGSVIDYQKTGLRNSC

SEQ ID NO: 139598 - protein, 125 aa, Glycine max
  Coding DNA Sequence Number=SeqID_47913
  Subcellular localization annotation: CTP_CleavageSite=53; ConfidenceScore=5.50e-01
MTFKIAPCVVSLVNVGTYTRFSSNFSQAASIRLCTLRFRAISELYLSQPTLLRASEARLTGASSKGGKCAESPPMFICGKRRKNRRKPVMKNIPDLGVVFTFEEGRQKQGSCSYVPSIEEEIRPT

SEQ ID NO: 139599 - protein, 248 aa, Glycine max
  Coding DNA Sequence Number=SeqID_47914
MGWYRRKAKMFVDPNNANTTALGDVVETLQYMVSPQGRNTWTVDDLVPYVDKLVIISEEQERITEPVSHGRALEREFPAQEFHILQSSVETRGIGRQREPVKAEQYSQQMMERGHGMYYTPATFSEYPSQMYQYPFEGHHTNTSASEHSFGGVAETQPHFSWPTMTHSQQHDAPMATPNAPFASQWNVPGAIPDMGDLLGVDLRQEFSAEAEQAEVGRQRGRRNSDRQARRWDRPCDTSSRHHGHHND

SEQ ID NO: 139600 - protein, 78 aa, Glycine max
  Coding DNA Sequence Number=SeqID_47915
MGCTHGPEIYPKAHKNPRAFSCISGPIYLEFSIQCPCGAWAGEAPAEAPAEAPDEADEAREDEEMTDLLDFLGGSGAT

SEQ ID NO: 139601 - protein, 110 aa, Glycine max
  Coding DNA Sequence Number=SeqID_47916
MIMRGQDIYSSQEETTSSPSSSGSEDEVRGEESREEVYPHEEGDLLMVRRLLGVPMEAGHILLGRPWQFDRKIIYNGLTNEITPHPSWHLICVASSNTFTGGQISTNYER

SEQ ID NO: 139602 - protein, 92 aa, Glycine max
  Coding DNA Sequence Number=SeqID_47917
MGGAVTLLDIPGSHEEKYLYLEACHSVWNSLETQTDHRGGGVSCARQGDLDTYFLVFLSESVVWTHLGYFLGDGTTFHLKVEIRCKHHIEHD

SEQ ID NO: 139603 - protein, 73 aa, Glycine max
  Coding DNA Sequence Number=SeqID_47918
MSEFTSNCPPQFLANLHQLDFARYVSGSYNAQWKASELLHDKHMLHSSCILEKMNVDEPLLGMATIALLSRYR

SEQ ID NO: 139604 - protein, 24 aa, Glycine max
  Coding DNA Sequence Number=SeqID_47919
MGKYGEFNVNLLRLSFIFSPMGSE

SEQ ID NO: 139605 - protein, 32 aa, Glycine max
  Coding DNA Sequence Number=SeqID_47920
KKANKRGKEEKERRDLACNVGADGCVFNVCVC

SEQ ID NO: 139606 - protein, 217 aa, Glycine max
  Coding DNA Sequence Number=SeqID_47921
  Gene Ontology: Mol. function=motor activity; Cellular component=cell projection
  Homolog annotation: Hit_ID=UPI00016621D1; Match level="QueryCoverage =99%, HitCoverage=40%, E-value=2e-18, Identity=32%"; Hit description =UPI00016621D1 related cluster
TFKGLHVLTFKGLHVLTFRGLHVLTFRGLHLLTFRGLHALAIRGLHVLAFRGLHALAIRGLHVLTFRGLDVLPFRGLHILPFRGLHVLSFRGLHALALRGLHTFTFKGLHILAFKDYTSSPSEDCTRLHVFTFKGLHVLTFRGLHVLTLRGLHALTFRGLHVLAFRRLHGFAFRVLHVLNFRGLHVLNFRGLHVLAFSGLHALIIKGDGILSRKGIG

SEQ ID NO: 139607 - protein, 69 aa, Glycine max
  Coding DNA Sequence Number=SeqID_47922
MDSTPSLAHQTFGHTEQGQSSSAATTNIENTNIEQQHHHDVGEPVILERRNPRCNRRPPPCGTGHRLGH

SEQ ID NO: 139608 - protein, 108 aa, Glycine max
  Coding DNA Sequence Number=SeqID_47923
  Subcellular localization annotation: CTP_CleavageSite=54; ConfidenceScore=5.24e-01
MRFLFNLVNSSTSKDPPGMYPPLFSLNNLVDVPSTRTDPQEMHPFLFSVNNPSRCTLYLYHKDYTLQCVKTKFLGGRRESQKEFRRLVLGEFFLAKGEENEKMNSTSF

SEQ ID NO: 139609 - protein, 166 aa, Glycine max
  Coding DNA Sequence Number=SeqID_47924
  Gene Ontology: Mol. function=endonuclease activity
  Homolog annotation: Hit_ID=Q9AY32; Match level="QueryCoverage=37%, HitCoverage=95%, E-value=9e-27, Identity=96%"; Hit description=RRNA intron-encoded homing endonuclease
  Subcellular localization annotation: CTP_CleavageSite=51; ConfidenceScore=5.14e-01
MVVTARNWTLGGVDRSASGVHRSARPFCRRCAPVLNWPGRASGAVTLKKLECSKQAYALYTLHGITPQDSDPIVLAFGIGVMINRDSQGHSYFIVRERKLGARRRSDTVLVSTINDADQGSADVAFRTPLAPYEKSKSLGSGGSMVARLKLKGIDGRAPPGVEPAA

SEQ ID NO: 139610 - protein, 249 aa, Glycine max
  Coding DNA Sequence Number=SeqID_47925
  Homolog annotation: Hit_ID=A5AZ88; Match level="QueryCoverage=32%, HitCoverage=7%, E-value=2e-08, Identity=40%"; Hit description =Putative uncharacterized protein
MTGGGILPLEIDFIESDRTNHVSGSTHTFDFLYEVQDEKPSPSTTIQPTTPELKPLPSNLKYAYLDDSKSCPVIISASLADAQEEKLLSRTVQLTKRKLNREDCNPRLLDVGKKCITKHFASLVNLSSNSLTAKGECKDPGTFEEDLSSSGIMLEALAVGSVPIILGRPFMKTARTKIDVYAGTLSMEFGDITVHFNILDAMKYPSEDLSVFRAEIIDHVVDEYMTDLYSNLHASHSSCIESEIVLDHM

SEQ ID NO: 139611 - protein, 123 aa, Glycine max
  Coding DNA Sequence Number=SeqID_47926
  Subcellular localization annotation: CTP_CleavageSite=5; ConfidenceScore=5.09e-01
MTKARQKGVRKGKRRRSLPPSSPRRARLLPPEGTAFWWNFLEGPRCYGTSQIVQQCFLFTSGMSQNFTDCATMLPFDFRYLTELHGFPNDGCQVPQSGQTWVASQQTDGPRAKLGYDNYVSLN

SEQ ID NO: 139612 - protein, 107 aa, Glycine max
  Coding DNA Sequence Number=SeqID_47927
MPSTSQGPKKGRMSSSKGPRTKLGYDTWETPLRKDQELRGIRNGIVATYPSAGERRETRRMRVPRKEYARSRHQCLFEENVGKTGKDAIYELLSERFGSCIYARGRY

SEQ ID NO: 139613 - protein, 133 aa, Glycine max
  Coding DNA Sequence Number=SeqID_47928
MIMRGQDIYSSQDKATTSPSSSEKEGQPLVVKEKCKEVSVSSKRLAKKETHFTIKTNIKETFPLRQPPHFLFCKKTLASIATPLGHEFIPQVKKLLDEGLVRKSLNPCALLVPRIGIIRHQIPKIGGMMNVFE

SEQ ID NO: 139614 - protein, 184 aa, Glycine max
  Coding DNA Sequence Number=SeqID_47929
  Homolog annotation: Hit_ID=Q84VH5; Match level="QueryCoverage=74%, HitCoverage=24%, E-value=1e-54, Identity=71%"; Hit description =Envelope-like protein
NLSVKYAILHRIGAANWVPTNHTSTVATESFAVKLPIAFPTVLCGIMLSQHPNVLNNIDSVMKRESPLSLHYKLFEGTHVPDIVSTSGKAAASGAVSKDALIAELKDTCKVLEATIKATTEKKMELERLIKRLSESGIDDGEAAEEEEAAEQEEEEAEEEEEEADEEDAAEDTESDDDDSEATP

SEQ ID NO: 139615 - protein, 106 aa, Glycine max
  Coding DNA Sequence Number=SeqID_47930
  Subcellular localization annotation: CTP_CleavageSite=15; ConfidenceScore=5.02e-01
MTKSSKINQRTTQVNQEQFKSSKIRIKKNSRLKKKVKSQESRFKVQDLKNQDQDSRLKKKVKSQESRFKVQDLKNQDQDSRLKIQESREGLIKISIKSFSQKLSST

SEQ ID NO: 139616 - protein, 82 aa, Glycine max
  Coding DNA Sequence Number=SeqID_47931
VYDPNMVSSWYLRHATKNACPMCAVKKMIWTFRLPVTKDETNIQRLRDNRRQMCKSATGGCTQRVHFMPPFLEPKWEELKGF

SEQ ID NO: 139617 - protein, 104 aa, Glycine max
  Coding DNA Sequence Number=SeqID_47932
MLGFTRNSPQISASPYQLDFTLYASGSYNAQWNAPGLLHDKHTLHSSRILRKVEVDEPWLGLWLPLNYQVYVGASQHRTLELGWCSSLEVQTDFVVDFRDGLCG

SEQ ID NO: 139618 - protein, 215 aa, Glycine max
  Coding DNA Sequence Number=SeqID_47933
  Gene Ontology: Mol. function=transcription factor activity; Biological process=regulation of transcription, DNA-dependent
  Homolog annotation: Hit_ID=A5CN43; Match level="QueryCoverage=77%, HitCoverage=78%, E-value=5e-18, Identity=38%"; Hit description =Putative transcriptional regulator, TetR family
  Pfam annotation: Domain name=TetR_N; Domain location=53-99; Score =47.7; E_value=4e-11; Accession=PF00440.14; Description=Bacterial regulatory proteins, tetR f
MTDRGRRTSQIRAGDLSPRLTVHSKKESAILHSMDDSAESLREQRKRETSRALTEAARRLTAERGFAGFTIEELCADAGVSRRTFFNYFESKENAVFGFTTIDSRQQALEEEFASQPGDLLDDFVQLTIRRFELFNPVEDAPALFAVIEQEPRLLKAAFEQMSKNEQHDRGLILRRMQGTAEAELRAEVIVHTVGALVRMSMDQLLHHQSTEGIL

SEQ ID NO: 139619 - protein, 56 aa, Glycine max
  Coding DNA Sequence Number=SeqID_47934
MEMMINDAFEQYRQHDPNIDACPKHCMLYLGDDEKSLDACKHCGTSRWYYPTRRIK

SEQ ID NO: 139620 - protein, 64 aa, Glycine max
  Coding DNA Sequence Number=SeqID_47935
MKKQQWKRSGRQRRKGERRRHPLGNKPWKKELHHQDEPWIRSLERILQWRKRKRERKREAGARN

SEQ ID NO: 139621 - protein, 57 aa, Glycine max
  Coding DNA Sequence Number=SeqID_47936
MGFSVEGNEHMVCILKKSIYSLKASFSPMVSGTNDLGLLHETKKFLSINFEVKDMGE

SEQ ID NO: 139622 - protein, 18 aa, Glycine max
  Coding DNA Sequence Number=SeqID_47937
MASIMDAREGPRVLMSLR

SEQ ID NO: 139623 - protein, 41 aa, Glycine max
  Coding DNA Sequence Number=SeqID_47938
MEKRDTKNSEQGLETRKLRKLLAKEEEEEEVQKDVQRDSKL

SEQ ID NO: 139624 - protein, 100 aa, Glycine max
  Coding DNA Sequence Number=SeqID_47939
MNVYFLRAVHVSSTFEFGAEFHDCLSADPQGNPPYSTFVRSTMNIGSFAKYKKKEEVEMRVVITERAGWTKSVSYLCFPLISDERLARSVKFRNVAEIEK

SEQ ID NO: 139625 - protein, 109 aa, Glycine max
  Coding DNA Sequence Number=SeqID_47940
MEEFLSQVAWPRVQPSPLGGGEASVAQEPVLEEDEPIPLEPFVYKTDPTSAQEEVASPEPIPQSSPAPFLNDPQRSAPASVPDQPIVQDPPVATVLDLNEHAQDHSHNF

SEQ ID NO: 139626 - protein, 141 aa, Glycine max
  Coding DNA Sequence Number=SeqID_47941
  Subcellular localization annotation: CTP_CleavageSite=52; ConfidenceScore=5.47e-01
WANPPQQQQQQQQPVPLFQNAASLSRPYVPPPMQQQQQQQRQQATEAPSQPSLEELGQMDTQLNQAQSQNSDKLPSQTMQNPKNVSAITLRSGKQIEVPPLVAAPAPEPAQLHSTPEKEDELAAQRRKLPDPEGANKNFHA

SEQ ID NO: 139627 - protein, 54 aa, Glycine max
  Coding DNA Sequence Number=SeqID_47942
MSLSSAVHVSSVLKRGASEEKKKREGVETRVVITERAGRTKSVSYLCFPLIFDE

SEQ ID NO: 139628 - protein, 97 aa, Glycine max
  Coding DNA Sequence Number=SeqID_47943
MFVDYVNKTWIIPHKKNLLQSGRIRVEYAHWTVKRILQNSLKDLCSVWDAMNNMIMLQHVEIKASFETTSQWIQSICSRGDFAIQTKGYVRSKSASR

SEQ ID NO: 139629 - protein, 126 aa, Glycine max
  Coding DNA Sequence Number=SeqID_47944
MHKALRLNAPLPYPHLVTLFLQHFNIPLDSEPYVPIKRSFLIGTLVIESFGYQKEHDGSWVKKGARHDGEEGHDGEDLSLLSKIMDRFDEVDMHFNEMESRITKVEEDVSYIRSSFDLPPPPPPSS

SEQ ID NO: 139630 - protein, 68 aa, Glycine max
  Coding DNA Sequence Number=SeqID_47945
MSGLTRDSPQISASPHQLDFAPYASRSYNAQRNAPGLLHDKPTLHSSRILGKMEVVFVIGSAVDRLCG

SEQ ID NO: 139631 - protein, 241 aa, Glycine max
  Coding DNA Sequence Number=SeqID_47946
MSRNFADYLMMDVKYLEEVKRRLHVTKEWSPDEIMVGFGLRELKGYYTDMKETTSSIRQVCSTQRQGMEVKLENLTLYVNDNSHAKLVTFDFIGIAHYDPKCSSCWSSSSSAMRRKNLEEHLFPQLNFSSQLKGSPFSRWIAISSGDRRLSGNGGGFEGEGSSWGCHTMTKQSGPLRLERDLAMKRSDHCWSSIGTSGVIFKQLGDLKDAQGVRPIKVGIAIFRRIGGHVVVGGCKGQLVR

SEQ ID NO: 139632 - protein, 281 aa, Glycine max
  Coding DNA Sequence Number=SeqID_47947
  Gene Ontology: Mol. function=N-acetyltransferase activity; Cellular component=cytosol; Biological process=metabolic process
  Homolog annotation: Hit_ID=A9PAI8; Match level="QueryCoverage=28%, HitCoverage=33%, E-value=1e-22, Identity=64%"; Hit description =Putative uncharacterized protein
  Pfam annotation: Domain name=Acetyltransf_1; Domain location=180-259; Score=31.1; E_value=4.1e-06; Accession=PF00583.15; Description =Acetyltransferase (GNAT) family
MAKPSSNVTTRKNKTDPGWKAKEHLVGKSGNIASCKKTPLDVVEELKGYMVNKKSETTYSSTGSGNVPNIRDFEFGEPVGCDESEDEFEDSCNATALATKTNWFVIKLIKLKSFENMVATIGQYGPHFPISSYHDIRVPLLKKEVEYAENLMKGHREQWVKYGCTIMSYAWIDRKKNLKVEKKSQGSQIAWGLDVGTEKRGFYMENLFLRECYKTKGLGRMLLSAVAKQALKMGCKRVKWVMLDWNVLTIKFYEKMGANFIEEYRFFSLIEEALQAYGGPN

SEQ ID NO: 139633 - protein, 28 aa, Glycine max
  Coding DNA Sequence Number=SeqID_47948
MAHSFSNIKVLSAFVADGFSNTLTCYKG

SEQ ID NO: 139634 - protein, 60 aa, Glycine max
  Coding DNA Sequence Number=SeqID_47949
MCDMSHEDEEEDDDNNNTNNNYNDDNDDGHGGDHVSQQQHTITREYTRTRGGRGHRTRII

SEQ ID NO: 139635 - protein, 502 aa, Glycine max
  Coding DNA Sequence Number=SeqID_47950
  Gene Ontology: Mol. function=translation initiation factor activity; Cellular component=transcription factor complex; Biological process =regulation of transcription, DNA-dependent
  Homolog annotation: Hit_ID=Q9SS44; Match level="QueryCoverage=36%, HitCoverage=60%, E-value=5e-76, Identity=78%"; Hit description =Transcription initiation factor IIB-2
  Pfam annotation: Domain name=DUF1723; Domain location=278-327; Score =38.8; E_value=1.9e-08; Accession=PF08330.1; Description=Protein of unknown function (DUF1723)
  Pfam annotation: Domain name=TFIIB; Domain location=127-195; Score =37.1; E_value=6.2e-08; Accession=PF00382.10; Description =Transcription factor TFIIB repeat
  Pfam annotation: Domain name=TFIIB; Domain location=25-97; Score =58.0; E_value=3.2e-14; Accession=PF00382.10; Description =Transcription factor TFIIB repeat
  Pfam module annotation: Pfam domain module=DUF1723::TFIIB::TFIIB; Domain location=278-327::127-195::25-97
MKEMTGESQNCVYLYPLHMIVVIRIKVIAQGGYCALSCVADRANEIYKRVEDQKSSRGRNQDALLAACLYIACRQEDKPRTVKEICSVANGATKKEIGRAKEYIVKQLGLENGNAVEMGTIHAGDFMRRFCSNLCMNNQAVKAAQEAVQKSEEFDIRRSPISIAAAVIYIITQLSDDKKPLKDISLATGVAEGTIRNSYKDLYPHVAATVVEDVKHMNHAADEVHDLPQEVVVDDKRFELKLSSHGRKIEKFGRLASEFESIVAVTELSPLIACSLDIGERGLIYAFVERWHKETSSFHLPIENVTITLDDVASLLHLPITGAFHSFEALHVDQVVDLLVDLLECWIYEHFLTVASSIATEDYHERKPHACRSKSRKALLVSTYRKRLDRLTSDVICVALGQCATYYMEWFYMISHPFMSPTQFGDPPRHPPMPIVAAAMPEPLVVAPVDEDMPRHALEACQAITERLKRLINLRVVTKGTKAYTVTEECLRIVTGVTVQGN

SEQ ID NO: 139636 - protein, 65 aa, Glycine max
  Coding DNA Sequence Number=SeqID_47951
MEKMHWRHPGDIRANKPSAAEWLDQLPKNFWQEYEGDRWGPDQGERGLQMIVRFQLAFLLRWAEK

SEQ ID NO: 139637 - protein, 159 aa, Glycine max
  Coding DNA Sequence Number=SeqID_47952
MGYARCTQHYCWCTQQFIESIPFSLFREKAFLLSSLFCEIPWWSSSLRGFSGFIFHLHSRVEDAGKNGGSLVTVSLPEDPLGVLQELPEEDLPEDFRKKGSSGGNETTSGRTGLSESSRNTSSGMFPEDVLLPKTFRKRVLADDLSVVSEALSGRPFFR

SEQ ID NO: 139638 - protein, 291 aa, Glycine max
  Coding DNA Sequence Number=SeqID_47953
  Gene Ontology: Mol. function=helicase activity; Biological process =viral genome replication
  Homolog annotation: Hit_ID=Q8RV60; Match level="QueryCoverage=98%, HitCoverage=22%, E-value=1e-46, Identity=34%"; Hit description =Putative uncharacterized protein At2g05640
YIVPYNPRLLRKYQAHINVEWCNQSTSIKYLFKYINKGYDRVTVVLIHDDNDPIHNGSTHNDEIKEYLDCRYICPCESTWRIFGFPIHGKKPVVERLQFHLPGQHNVVYEDHDDIDDVLSKTNISDSKFISWMNINQNFVEGRSLTYVEFVSKFVYSKKKRCWQLRKKGYTIEKHVLLWVFCKMIKNSLRQSKKQKTGAQHIIRKLFVLLLLTATMNKPEQVWDQTWHWMVDDIVYNYKKSSTSPALQLDDRTLQNLVLLEIEQLLQTNQRSLTDYPSMPYPEDANCPTYL

SEQ ID NO: 139639 - protein, 344 aa, Glycine max
  Coding DNA Sequence Number=SeqID_47954
  Subcellular localization annotation: CTP_CleavageSite=38; ConfidenceScore=5.01e-01
MNFVFCIFLENVMNSLSALAALSKMASRKRKSIGARPTAQYDTRRFLSLDAWNRYTDNVLGRSILSERKVVIYHTEFDDFKTELERGNLHKRLTNLADGSIDLALVKEFYANLYSPGDPSPKQAREGETLPTYSRYCRLPTDHREIKDALCILGRGFNFNVEGHPRRILRKDLTTLAQVWSVLSYSNLAPTSHTSDLTIDRARLIFGLVSHMDMNIDALISGYMTSIAQSNSYRLGFPTLITALCRVQGVVSDSLTFKRLSPAINLAYIRKNCWNIDDLTIAFRGARRARARPANIPSSSAAPTPTPASTSTASSVPAHVDSQCFEAMLQSIHQGQILLLQSLQ

SEQ ID NO: 139640 - protein, 351 aa, Glycine max
  Coding DNA Sequence Number=SeqID_47955
SLATRPVGVERPVVHVDPISKRANGPHRKKLRTYLGIVARDKVDVAYHNWKQVPIAQKDLILEDIQAEFDIPESSDLSTKKKYFRSSERSGGSLNPSWEGYDFQEQKLMKEKQKKRWEEAAQSGSTDTVVDPPSPIRRHQTIDRIVSDYHLLEGSFVAHEHQDVLTAAIGRPEHPGRIRAARADVMIKHYFGPASRGSHTSSSMALEDLEQLTQKIKDQLDESITQKVTQQLMMSFSQIQSQMQSQMQSHGLALPPETEINVGCMSIPLGRVYEGLTIIHNVPLGNDQVKALNTFLAWLIHLVKLFSEQNKQGAEGPAKPVDMLDPDVNPLYLMTLTILQAAAGVVGCYHV

SEQ ID NO: 139641 - protein, 73 aa, Glycine max
  Coding DNA Sequence Number=SeqID_47956
MPLEGEDESRISSPPKEAMDKSLKVREDESREKERRVTKFMPQISLSDVILARSRSLDTCHKVLDDATSRKGR

SEQ ID NO: 139642 - protein, 71 aa, Glycine max
  Coding DNA Sequence Number=SeqID_47957
MARRLKEDWARDARECSRVLMSLRWRLQSPFLFLHSAAIDLQEAKDLIDEEDSSPTSSTWIHIMWYHNIFI

SEQ ID NO: 139643 - protein, 76 aa, Glycine max
  Coding DNA Sequence Number=SeqID_47958
MAVEWRRKRERRCHFKEKMSLEEAHHHRRRWIRAWRKKEMNEGRRREEHEILCSKRALKSEPTNPRSIPRFSTKCA

SEQ ID NO: 139644 - protein, 164 aa, Glycine max
  Coding DNA Sequence Number=SeqID_47959
MASRVDGRLSTASTREEPCKYCGIEGGGLPKMTLNGENRVPEWVAGTIEDLCLRVIPSFEEIHGVCRPSRGKGGPEWVAGTIEDLRLRVVRGVHPEFDQVEEKEGDLVHGVVGGNGAEMGTFRKLVDDDRIVVKPWEDGNLVIKSRDMSSQIEEGIGKGCKRLA

SEQ ID NO: 139645 - protein, 461 aa, Glycine max
  Coding DNA Sequence Number=SeqID_47960
  Gene Ontology: Mol. function=transferase activity, transferring glycosyl groups; Cellular component=integral to membrane; Biological process=metabolic process
  Homolog annotation: Hit_ID=Q8S3B9; Match level="QueryCoverage=99%, HitCoverage=99%, E-value=0.0, Identity=78%"; Hit description =Putative glucosyltransferase
  Pfam annotation: Domain name=UDPGT; Domain location=14-461; Score= -102.0; E_value=1.8e-05; Accession=PF00201.9; Description=UDP -glucoronosyl and UDP-glucosyl transferase
MASSGKILPHQTQVVAVLIPFAAQGHLNQLLHLSRLILSHNIAVHYVCTATHIRQATLRDKNSISNIHFHGFEVPPFASPPPNPNNEETDFPSHLIPSFEASSHLREPVRNLLQSLSSQAKRVIVIHDAAMASVAQDATNMPNVENYTFQITCAFTTFVYLWDKMGRPSVEGLHVPEIPSMEGCFTPQFMDFIIAQRDFDKFSDGYIYNTSRAIEGAYIESMERISGGKKIWALGPFNPLAIEKKESKGRHLCMEWLDKQDPNSVIYVSFGTTTSFKEDQIEQIATGLEQSKQKFIWVLRDADKGDIFDGNETKRYELPNGFEERIKGIGLIVRDWAPQLEILSHTSTGGFMSHCGWNSCLESITMGVPIASWPMHSDQPRNTVLITQVLKVGLVVKDWAQRNALVTASVVEKVVRRLIETEEGDEIRQRAVRLKNAIHRSKDEGGVSHLEMESFIAHITN

SEQ ID NO: 139646 - protein, 105 aa, Glycine max
  Coding DNA Sequence Number=SeqID_47961
METAEVGPVVRGCTGSRKRKHGGSRGTFLVRAGLGVAWQMWLKIDRDSNMGLQEVRGLQEAQKREFLALEARVFASRAWFLTKIFDEALALGRLGIWDFRVEGNR

SEQ ID NO: 139647 - protein, 62 aa, Glycine max
  Coding DNA Sequence Number=SeqID_47962
  Gene Ontology: Mol. function=transferase activity, transferring glycosyl groups; Biological process=metabolic process
  Homolog annotation: Hit_ID=Q8S3B6; Match level="QueryCoverage=74%, HitCoverage=9%, E-value=3e-10, Identity=63%"; Hit description =Putative glucosyltransferase
MAYMPLKFLFKQGCFPTQFIDFIIAQRDFIKFNDGNLYNTSKAIEDPMENMAVDPPNGIRRY

SEQ ID NO: 139648 - protein, 49 aa, Glycine max
  Coding DNA Sequence Number=SeqID_47963
MRMKDGFVGQKRLLYEDTGSLRSRLLYDNCCGGSNCSYGHDGCGDGGCG

SEQ ID NO: 139649 - protein, 731 aa, Glycine max
  Coding DNA Sequence Number=SeqID_47964
  Pfam annotation: Domain name=RRM_1; Domain location=36-106; Score =29.8; E_value=9.7e-06; Accession=PF00076.13; Description=RNA recognition motif. (a.k.a. RRM, RB
MAGPKQHYDGQRQGQTGQQRNHHQANWRDRADITTFYFTRFPEDASDKELWYHFKQMGDVREIFISKQRNKEGRRYGFVRYKGVSNASYMERKLDNIIVGGLKLHVNIPKYGRGKEIKEQNAAEHGWQKEGGNQRRSVAADPNTKRSYVEVVTSHTENKERRRRTSSLMAAHGRTHSSIILEISEEVKKRYADTWVGRLKRQQVFERVDDELSWILGSNVLPKYLGDDMVLRIGLSDTKAQELIREEINHGTSAFYGLEKWNSKTKPGNRLIWVQCWGIPLVAWSIDNLRKIVAAVGDLVEVDDDFEDMQRLDRARVLVRTPWRSTVEHMVTAHIDGDEIYSDVEDSDTFQSWPTDTSPPSTTSKMHGDTTFRQSLAKTNNQSGTSTPLGIARSKRARGPSSALSHPGAENGKETYLEECHPTLPGAGYEEMESQPAGAAGLGMQKWKDNLQGLLASTEESQKGEVAVLDQGHMGESFQNHSNRPLGDSLNKSRDTNVNLIGPNLNMGPYKPTTPTNQQNARQKKPVSALLVYLRKKGCSKKWAQDRGKEINPKTLDFADNPINHKDSAVSCGSDEALVSPKQGQLQQSPSLSSSFNKKDMEDEDDVYRDLARELGVSFAENKSNAVKVMTDMDNRENSSTSAAWSAIRKLTLANNIDILCIQETKKESVDVKLCQYLWSDNSVSWECVPSSNAAGGLLCIWNNGSFLVDRRVLGRGFIMLESTWIKENKR

SEQ ID NO: 139650 - protein, 137 aa, Glycine max
  Coding DNA Sequence Number=SeqID_47965
MTTIEILVMVMVTVAVAVDVALVVVVMQMVMANNGDDDGDDRSGISSGGNNVSDVGGRGSIVGNSGSGDNNDGGDIDGSGDGDVNVDDCDSDDGVSGDGGGCCNDIGGVCQTRFCFKNCISSSKLKLTTTPNGSLCF

SEQ ID NO: 139651 - protein, 199 aa, Glycine max
  Coding DNA Sequence Number=SeqID_47966
MTLRSVNMNNSSFFQILPRAQQMECCAHLEIDPVYPESEHPPHLSDGKTGESERATTSPDKELERSGEQQLLQMRESEMIIIGGDGGSTSSSGEGGFATGDCGSAGTGSTRAGVGSRGAASLGLTTKGRAPGHATCSRNCSVWELWTSDLIVVDGGAGVDDEGLSSALALFLDAISSLSHRYLNRRMSVHPYKMNSLSA

SEQ ID NO: 139652 - protein, 294 aa, Glycine max
  Coding DNA Sequence Number=SeqID_47967
  Homolog annotation: Hit_ID=A2Q4P8; Match level="QueryCoverage=16%, HitCoverage=21%, E-value=1e-10, Identity=65%"; Hit description=IMP dehydrogenase/GMP reductase, related
  Pfam annotation: Domain name=DUF1723; Domain location=24-73; Score =50.5; E_value=5.7e-12; Accession=PF08330.1; Description=Protein of unknown function (DUF1723)
PALEIEGLVAAVGLSPLIAFSLDIGYRGLISGFVERWHKETSSFHLPIGEVTITLDDVALLLHLPIIGAFHSFEALHMNKVLLLLTELLEVSSEEARAKTSESYAWGVVALVHMYGNLNDPSKSSAKQLAGYITLLETIPPHPAAPTLCIEDIDDRWIQFFEYLAPVGQICVALGQCVTDYMEWFYMISHPFMSSAQPRDLPKHLPVLHDDTFIEPDIPQHPMVAGAMDEALTDAPFHVEQPRHVVHPVVARAMDEALTDAPAYVEQPRHALACQAIAERLERLLNLRIVTKGT

SEQ ID NO: 139653 - protein, 74 aa, Glycine max
  Coding DNA Sequence Number=SeqID_47968
MLAFIIAKRGCEDESDAGFALVEVALVGDHDELNVATNAPANFLSHILTHLTKCLPSFKSLTNTPTLGSPFPQQ

SEQ ID NO: 139654 - protein, 115 aa, Glycine max
  Coding DNA Sequence Number=SeqID_47969
MNLTVSIKTFMNYTPSYKKTWLAKQRALEMIHGSWEELYAKLPKVLGALQSCVLGTMVAAQTGYTYMEKMHWWHLGDIRANKPSAPEWLDQLPKKNLGTMLRRGEMLGTYDYKFV

SEQ ID NO: 139655 - protein, 104 aa, Glycine max
  Coding DNA Sequence Number=SeqID_47970
MECLEGVWETLEGNERCRFRGTIRLTATSLPIQVIEVSSSEEDLEEEPEELPPEPAVDALDFPEDDEDPLPDVDSPEDVMLASEADSTEESGPRGTTNSDGSSS

SEQ ID NO: 139656 - protein, 242 aa, Glycine max
  Coding DNA Sequence Number=SeqID_47971
MAANSWTYADAMRSFVLKAIWADWFQTKLSLVNTVVKGPMLYSLHFRVYWFDPLSRNEVAKMPDMLLDNGTIDQDIVKKHNKEPRARNEAIARMAETEEGVWFEGNSAANRQIQVPETSTIALREPSRHHRGRDSKLANFCKSSSSLRVMEFWLAVNKSCVGGNQGHSLSGSGALSTRLENEVLVRAWADWEFVRGRRRSREVDVEVHGAAEGRAEMSEPLVVASEHLAAADLGGFCLHIWF

SEQ ID NO: 139657 - protein, 412 aa, Glycine max
  Coding DNA Sequence Number=SeqID_47972
MANSKAADEKTGGISRTFRPSTSQDFQTTSQNVTCGIASGVKDVHELARQLDQLVIGGLKLYVNIPKYGRDMATKAETPPVPNKQEGKQQNEAPYRGHHQATRSLTSYEEVVARDRYKVEQPKETYKEDTKRGESRSSLYLDIPMNDKHWLRQAWVGCLKDLRWTHGRYSRTHGEGDIGGSRLYVLFAGEMAPEPQNGPEISLRIVAAIGELVDADDNTEEARRVDRARVLIRMPWSPAIHHTMSVDIGGEVYQEIDSDDSCWGSPTKDTKGAPNNNETEEKNSSKGQTPPVTPSVVKARAVKGSEAPPGTVSGGVLTSSHPAGVGPAEALFVQRVQLPNPTFGVTDTCGAASQCHVARHQLTEGFSEPTFERNQKRKGEQVGVIENPEGAQREHKKGNLETESAEAEKEML

SEQ ID NO: 139658 - protein, 241 aa, Glycine max
  Coding DNA Sequence Number=SeqID_47973
MKEFYANLYVPDDKSPKQVRVRGHLIKFDVDSLNTFLETPVVVEPDPQELAARLCIPGRGFVLNAKGLPWKLLRKDLTTMAQTLSVLSYSNLAPTSHTSDLNLDRAKLVYRLVMKMNMNLGSLISGQISLIAQSNSSRLGFPTLITALCKARGVTSDSLTFESLSPAINLAYIKKNCWNLDEPSVTFLGTQKSRARRSEAPSTSVVPAPLHQLHLLLFFLHHQQLQFFQVPPLRAQSFPCL

SEQ ID NO: 139659 - protein, 147 aa, Glycine max
  Coding DNA Sequence Number=SeqID_47974
  Gene Ontology: Mol. function=S-formylglutathione hydrolase activity; Cellular component=cytoplasmic membrane-bound vesicle; Biological process=biological_process
  Homolog annotation: Hit_ID=A7PWK3; Match level="QueryCoverage=97%, HitCoverage=38%, E-value=2e-47, Identity=65%"; Hit description =Chromosome chr8 scaffold_34, whole genome shotgun sequence
MNSVSAFAPIANPINCPWGQKAFSNYLGDNKSDWEDYDATCLVTKFPNVSSTILIDQGMVSIYKNMYPHTRSKFLLVLSSSYCQSTFQGEDDKFLPDQLLPHKFEQACKKANVPLLLRFQPGYDHLYYFIATFIDDHIRHHAQALKS

SEQ ID NO: 139660 - protein, 137 aa, Glycine max
  Coding DNA Sequence Number=SeqID_47975
MFLLDSIPPQPLEEGALAEFIFFLNWLTVVPVSVCMRRSSAGELVPLDLEIEATFRRNNAERKRKLLHDRTVALILEEAHFSKSSSSNSPTSRESQAAEFEAKVMAEEQPRRVTLEDYSSTSVPQFFTSILRLEVQA

SEQ ID NO: 139661 - protein, 124 aa, Glycine max
  Coding DNA Sequence Number=SeqID_47976
  Subcellular localization annotation: CTP_CleavageSite=19; ConfidenceScore=5.07e-01
MSSKRSSISTSNGSNWDPLCMSVNSPCHIHVMCGPIPFRKTVFYVSFKRQAKKSRTLHDNKDDDLKNQRMISRLNQEHFKVQVSSSKNQESSFKIQDSRLKILESRGDSIKISIKKFFQKLSST

SEQ ID NO: 139662 - protein, 40 aa, Glycine max
  Coding DNA Sequence Number=SeqID_47977
MWDNVGVEQVVSNRFQARGEREEQVQGFRARRKPMLTSTR

SEQ ID NO: 139663 - protein, 480 aa, Glycine max
  Coding DNA Sequence Number=SeqID_47978
  Gene Ontology: Mol. function=nucleic acid binding
  Homolog annotation: Hit_ID=A7PWK4; Match level="QueryCoverage=82%, HitCoverage=32%, E-value=1e-118, Identity=55%"; Hit description =Chromosome chr8 scaffold_34, whole genome shotgun sequence
  Subcellular localization annotation: CTP_CleavageSite=61; ConfidenceScore=5.32e-01
MTPTQRTLVFTRASHTGCVYDLSLLSHRDLSYPSHPFFRAKASSPLSLTSSYSSSLFRKIRRMDRKSKRNHSFSYSTLFNLEPLKNFKLPREDDDDFDYYGNNSQEDESRDSQGERENYCNGNVHAREQNSSSKRVWSENSDTDDENKGRYYGTHMTQERYQSMLGDHVQKYKRRRKDAMSNTDQNQVVVPLVKSNNGLKIQKSGNDCRGASHAEERASEWLQDQKQGNFSRADFKQQYGTDRIMYEPAVLDIGNGISYEIPPIYDKLAPMLNLPNFLDIHVDEFYLKSTLDLGSLAAMRAADKRFGTRNQAGMGEPLSQYESLQARIKAMPASNSPHKFSLKVSDVGLNLSIPEGAAGTIKRSILSEGGVLQVYYVKVLEKGDTYEIIERSLPKKQKVRKDSALIEKEEMDRIGKIWINIVKMKVSRSLKWIKGANIRTRKLARDMLLLWKRVDKEMPKNFVMDPNLVHYNNNNKALSH

SEQ ID NO: 139664 - protein, 62 aa, Glycine max
  Coding DNA Sequence Number=SeqID_47979
FKLGLAGQEALSANPLRFLNSWKCAKRACCAKPELLSKALSAAYYAKPQMLIVPYNFKLGLE

SEQ ID NO: 139665 - protein, 93 aa, Glycine max
  Coding DNA Sequence Number=SeqID_47980
MEDFDAQVAWPGAQPSPFGGGGAFAAQELASKEPTIVEGEPLSSLLILIQPSLAPIPNDATPSAPASKLDQPISKDSPAAQVLDLNEHAQEQP

SEQ ID NO: 139666 - protein, 57 aa, Glycine max
  Coding DNA Sequence Number=SeqID_47981
  Subcellular localization annotation: CTP_CleavageSite=48; ConfidenceScore=5.04e-01
MSCEARSSMLVNLSDKPAKRICALSGTSVLTFRAKRALCAKLECVFVEAELSASMLR

SEQ ID NO: 139667 - protein, 60 aa, Glycine max
  Coding DNA Sequence Number=SeqID_47982
  Gene Ontology: Mol. function=metal ion binding; Cellular component =intracellular
  Homolog annotation: Hit_ID=A9PDJ1; Match level="QueryCoverage=68%, HitCoverage=8%, E-value=4e-11, Identity=80%"; Hit description =Putative uncharacterized protein
MERVVATVSNYHGSERFNLIKLISQTGGNYIGAMSKSITHLWPKVSKGSAKISCKKYSRE

SEQ ID NO: 139668 - protein, 142 aa, Glycine max
  Coding DNA Sequence Number=SeqID_47983
MGSNQTPMPKKRFYQVKIKSLEVASLRELGQLMGQLQRQAFTKAYVPTVEEFEEILRCPLGGKKPYLFSGFYPSMARVSKAKALANQGEWASFVDILALLIFGVVLFPNVKGVVDLAVIDIFLAFHHGKESPIVAILADMYD

SEQ ID NO: 139669 - protein, 72 aa, Glycine max
  Coding DNA Sequence Number=SeqID_47984
MVFHAVSTKRGYMIVYRKGKILQNIRNDKGSEVEVVTMMMVTIVMVLVTTMVGWNTGGGGEMVIVTVVAVEW

SEQ ID NO: 139670 - protein, 118 aa, Glycine max
  Coding DNA Sequence Number=SeqID_47985
  Subcellular localization annotation: CTP_CleavageSite=29; ConfidenceScore=5.54e-01
MSPPPLGPHNHSQTHLNLSGRLPFQAPVFADLRTTKSLKLSGTWTFLSLELSRHAEASRKRQTPIKNLISSLNSGWTKAARLAGWLLAQRTSTTHPSSRFFLALSQGMLHSADGSLSQ

SEQ ID NO: 139671 - protein, 78 aa, Glycine max
  Coding DNA Sequence Number=SeqID_47986
  Gene Ontology: Mol. function=subtilase activity; Biological process =proteolysis
  Homolog annotation: Hit_ID=A7QXF8; Match level="QueryCoverage=92%, HitCoverage=7%, E-value=1e-22, Identity=63%"; Hit description =Chromosome undetermined scaffold_222, whole genome shotgun sequence
MKYNCDLINMSYGEATLLPDYGCCFVDLVNEVVNKHRLIFVSSPGVGAYVSLAMAAGAHCVVEPPSDGLEYTLVYSLL

SEQ ID NO: 139672 - protein, 55 aa, Glycine max
  Coding DNA Sequence Number=SeqID_47987
MVVPNVGFQWRTMEVHGGYWWLWVVKKKLGTLGKGFGRKKEKGMVVFQGYTKNKT

SEQ ID NO: 139673 - protein, 35 aa, Glycine max
  Coding DNA Sequence Number=SeqID_47988
MSRNFADYLTIDVKYLEAVKQRLHATKEWSPDEIR

SEQ ID NO: 139674 - protein, 142 aa, Glycine max
  Coding DNA Sequence Number=SeqID_47989
  Subcellular localization annotation: CTP_CleavageSite=48; ConfidenceScore=5.26e-01
MSSVIYAFKDYNVFCFTLSKTTMSSVIYTFRDYNVFSHLCFQRSQYLQSFTLSKTTMSSVIYAFRDYNVFSHSCFQRLQYLQSFSLSKTAMSSIIYAFKDYNVFCFILSTTTMSSVITLSETTMSSVIYAFKDYNVFSHLRF

SEQ ID NO: 139675 - protein, 72 aa, Glycine max
  Coding DNA Sequence Number=SeqID_47990
  Subcellular localization annotation: CTP_CleavageSite=50; ConfidenceScore=5.23e-01
CQKLQLSLAHHWAKRTSTAKHSFSVLSAIEESGRTSISRSHTKREISALSAAVVFSQAQRTIGAKLKPTYSR

SEQ ID NO: 139676 - protein, 74 aa, Glycine max
  Coding DNA Sequence Number=SeqID_47991
  Subcellular localization annotation: CTP_CleavageSite=36; ConfidenceScore=5.69e-01
MKCQKLQLSLAHQWAKRTSTATCSFSVLSATKESVRSSISRSRAKREISALSTAVVFNQAQRTTGAKLKPTYSR

SEQ ID NO: 139677 - protein, 69 aa, Glycine max
  Coding DNA Sequence Number=SeqID_47992
MLMVVVCSGDADDDNNSDGGDNAIGHGEELMQSYPARALDRKLQVDWARDAREGPRVLMSLRVDFGPKG

SEQ ID NO: 139678 - protein, 103 aa, Glycine max
  Coding DNA Sequence Number=SeqID_47993
MKADMEAMKEQMTTMMEAMMDMKKIIEVNVVVAAAASTITKRDPTHPPIFNQESHLVSDVEGQGCATGVPAKNVTNPIPVCIEIHQTQPDQTQAYNSNAREEA

SEQ ID NO: 139679 - protein, 159 aa, Glycine max
  Coding DNA Sequence Number=SeqID_47994
MGSSQKPSFKKRFYQVKIKSLEVTSLRKLGQLMGQLQQQAFRKAYAIDVFIAYHNHKESPIVAMLADLYDTFDRRCEESNARIVCCTPALYVGLVSHLFFQEGRPVYPLQGYRSCVEKGKANWDQLLASMGGRLLIGSLARRKEESRFYLHAKDVQMFP

SEQ ID NO: 139680 - protein, 132 aa, Glycine max
  Coding DNA Sequence Number=SeqID_47995
MHLPQLISDVIYCLRGLCRKTPSGPEEGQQGLGVASSKYGSLSVLGSACRPQQGHQVPPTNRAFIKKFCVSRQAQGETPQQPGNGRQRATDAPPSPLEFTSAHPQKGLSIAYTTWPTNRRPSPKPKDAPSCS

SEQ ID NO: 139681 - protein, 280 aa, Glycine max
  Coding DNA Sequence Number=SeqID_47996
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=38%, E-value=5e-87, Identity=82%"; Hit description=DNA -directed RNA polymerase subunit beta
  Pfam annotation: Domain name=RNA_pol_Rpb2_6; Domain location=1-189; Score=108.0; E_value=2.8e-29; Accession=PF00562.19; Description=RNA polymerase Rpb2, domain 6
  Pfam annotation: Domain name=RNA_pol_Rpb2_7; Domain location=191-268; Score=144.1; E_value=3.8e-40; Accession=PF04560.11; Description=RNA polymerase Rpb2, domain 7
  Pfam module annotation: Pfam domain module=RNA_pol_Rpb2_6::RNA_pol _Rpb2_7; Domain location=1-189::191-268
MPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGVSRSGHYALVTQQPLRGRAKQGGQRVGEMEVWALEGFGVAHILQEMLTYKSDHIKTRQEVLGTTIIGGTIPKPTDAPESFRLLVRELRSLAMELNHFLVSEKNFRIHRKEA

SEQ ID NO: 139682 - protein, 104 aa, Glycine max
  Coding DNA Sequence Number=SeqID_47997
MKLCFYKRQKTKLEEVAQSESTKVVIDPSSPIRRHDSLEEQASKGSFVPYGRQDLLTAAIGRSKHPSCVRAAGFGVTIKQYFGSVPRTSCSSSSLAPEELKKLT

SEQ ID NO: 139683 - protein, 71 aa, Glycine max
  Coding DNA Sequence Number=SeqID_47998
MVLLVGHSEAICPLPKHLKHFMFLVPILDEEVEVLCLLPPTLDAADFPCGDVAAGLDKLPPSFLDLLAQFW

SEQ ID NO: 139684 - protein, 92 aa, Glycine max
  Coding DNA Sequence Number=SeqID_47999
MKLAKYRLKAQVEKDEGLSGEGQSPRVEKDEGQTYQGNPCGVYPDLSSFTGSGVYPDLSSFTGSGVIQIFVACIKRSAPTQVHIIWYQSFGS

SEQ ID NO: 139685 - protein, 71 aa, Glycine max
  Coding DNA Sequence Number=SeqID_48000
  Subcellular localization annotation: CTP_CleavageSite=40; ConfidenceScore=5.50e-01
GSNWAASSSTFLKNGFRGFCGFRNTSVKFPKTLESKCFPNAFVSDSVEILHHSSSFFTVLHPFFVRSSFFN

SEQ ID NO: 139686 - protein, 48 aa, Glycine max
  Coding DNA Sequence Number=SeqID_48001
MNALSAPVRLACSSQLSKFGFPDEHMAQGRPGVKHPTTSPILLLPSQI

SEQ ID NO: 139687 - protein, 179 aa, Glycine max
  Coding DNA Sequence Number=SeqID_48002
  Homolog annotation: Hit_ID=Q84VH5; Match level="QueryCoverage=33%, HitCoverage=8%, E-value=1e-19, Identity=83%"; Hit description =Envelope-like protein
KVAIPSKKRKEISSSDSDDDVELDVPDIKRAKKSGKKVPGNVPDAPLDNISFHSIGNVERSGEDIAASEHQIAKEITAKQVQHWPKKMGSFCREAIEVCNPAQDGAANWMYPPIILPPQESTEEEDQASEETPAPRAPEPAPGDLIDLEEVESDEDPLPTVGTWHCRKLQSRKGKTPIK

SEQ ID NO: 139688 - protein, 107 aa, Glycine max
  Coding DNA Sequence Number=SeqID_48003
MINDGTYEFGDPTVKWLHMPPDSWVTVTKGGVVDKSRAFAPTYPQFVMRNSDLRQGLTFSPWVKVYDKLGFWLKACRTAGHDICQGLASGSGIKGMSHIISMIHMQQ

SEQ ID NO: 139689 - protein, 22 aa, Glycine max
  Coding DNA Sequence Number=SeqID_48004
MVLKCHNDPTVNESEIVVFLRQ

SEQ ID NO: 139690 - protein, 43 aa, Glycine max
  Coding DNA Sequence Number=SeqID_48005
RIMKMEMNCEAGFMCAQVSRTVHQTGGSCTGTIPRLQTKNKLC

SEQ ID NO: 139691 - protein, 119 aa, Glycine max
  Coding DNA Sequence Number=SeqID_48006
MEGLQLSAVSGVVVVVGLVEECHNCSAVVDFAAEVEEVYCKYLQHKLQATQLLQVAAWKGKGLSNMERSMIDAASGGALGDMTPAEARNLIEKMASNSQQNLIEAVPESNKHENAVTRK

SEQ ID NO: 139692 - protein, 231 aa, Glycine max
  Coding DNA Sequence Number=SeqID_48007
  Homolog annotation: Hit_ID=Q0ZCD0; Match level="QueryCoverage=74%, HitCoverage=14%, E-value=3e-08, Identity=26%"; Hit description =Integrase
MERSMIDAASGGALGGMTPAEARNLIEKMASNSQQFSARNDVIVLRGVHEVATDSSSSAENKNLEGKLDSLVNLVTQLAMNQKSAFAPVVRVCGLCSSADHHTDLCPSLQQSGVNEQPEAYAANICNRPPQQQNQKQQNNYDLSSNRYNPGRRNHPNLRWASPPQQQQQQSVPPYQNVAGPSKPYVPPPMQQQQRQQATEAPSQPSLEELVRKMTIQNMQFSKRQEPPSEL

SEQ ID NO: 139693 - protein, 148 aa, Glycine max
  Coding DNA Sequence Number=SeqID_48008
  Gene Ontology: Biological process=transposition, DNA-mediated
  Homolog annotation: Hit_ID=Q1J7G7; Match level="QueryCoverage=27%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVPSARLSARLALSPIPLTRANREGGAKRK

SEQ ID NO: 139694 - protein, 153 aa, Glycine max
  Coding DNA Sequence Number=SeqID_48009
  Homolog annotation: Hit_ID=A1FRT4; Match level="QueryCoverage=100%, HitCoverage=18%, E-value=6e-87, Identity=98%"; Hit description=TonB -dependent receptor precursor
MRYENDFYHNYPWQISARNQRASYHYTPYSPWIDLRATFASNKTRLFYPPVEDSSYIGRRTHSSLSSWTLDNTSRFDIGALQARWNTGIKHQSDIYVADTPILRGANPQGRSQLDSVFSTLELQYDIYALTAGLRQDRFGIRGHIPVCSDVPG

SEQ ID NO: 139695 - protein, 86 aa, Glycine max
  Coding DNA Sequence Number=SeqID_48010
  Homolog annotation: Hit_ID=Q6WAY4; Match level="QueryCoverage=77%, HitCoverage=12%, E-value=4e-07, Identity=46%"; Hit description =Putative uncharacterized protein
MGTNQIGKRFYQVKIKGLDVTSLKELGRLMGPLQMQAFRKVNGKILDLTIAGVFTEAVVSLTQYYDQPLRCFTFGDFQIVPTVEEF

SEQ ID NO: 139696 - protein, 100 aa, Glycine max
  Coding DNA Sequence Number=SeqID_48011
MGVCRHFPNERGESSARLRQGSQCKFSICIRLKMEGRNRIKHLASFLCMPVDATWIVEECTELLKDRVDLMVWNASPNNLGLMPYEMIIPRNIIPMGDPP

SEQ ID NO: 139697 - protein, 163 aa, Glycine max
  Coding DNA Sequence Number=SeqID_48012
  Homolog annotation: Hit_ID=Q6UUU1; Match level="QueryCoverage=36%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIRIPGVSPWRLPRALSFRSKLDCMHEPPVQSDRCALSGNYRLESNPERHAKAPLAAAT

SEQ ID NO: 139698 - protein, 63 aa, Glycine max
  Coding DNA Sequence Number=SeqID_48013
MLEEIIHWPTVDDSDFLHPRKEFPPQRQNFVTGEEQMRGRLRFGRKNPISFSSPNPGVLQVAI

SEQ ID NO: 139699 - protein, 41 aa, Glycine max
  Coding DNA Sequence Number=SeqID_48014
MACPKGQKVAFGTYALVEEAEYWWENTRQCLDAEDKWPQIS

SEQ ID NO: 139700 - protein, 124 aa, Glycine max
  Coding DNA Sequence Number=SeqID_48015
  Pfam annotation: Domain name=Ins_element1; Domain location=68-121; Score=-20.8; E_value=0.014; Accession=PF03811.4; Description =Insertion element protein
DRYIEQLSEVPQNVLYDAIGIYQRCMVKVGTFYVPINVSYSPKVGPGLPGINRDTRIYLFCEVIFRHSCPSCSATDGVVSNGKSTAGHQRWQVAIGAGLFAITPAGERGMCCKAIKLGNARVFP

SEQ ID NO: 139701 - protein, 62 aa, Glycine max
  Coding DNA Sequence Number=SeqID_48016
MMIWKQRAKLVMATARKVLKHPVYGIVILRLGIYASRPNVSKLRSFIGSTNPSILIPDDVPK

SEQ ID NO: 139702 - protein, 128 aa, Glycine max
  Coding DNA Sequence Number=SeqID_48017
  Gene Ontology: Mol. function=nucleic acid binding
  Homolog annotation: Hit_ID=A5BBA3; Match level="QueryCoverage=71%, HitCoverage=16%, E-value=5e-20, Identity=39%"; Hit description =Putative uncharacterized protein
MTHDQELFRELDKSLVSQVRIGNGDLITIKRKGTVAIESCADVNDKKIFNIKMRGQSFSFDPLEEEQTTYPVIVNNTKVWHKRLGHFHHVAVEEQYVISLDHYATNALNNANSTMKKASSVYSKEMDQ

SEQ ID NO: 139703 - protein, 250 aa, Glycine max
  Coding DNA Sequence Number=SeqID_48018
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARAHRQKGLALSWGWNHMVWLCLHSNLILNPHVLWEKPGGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139704 - protein, 367 aa, Glycine max
  Coding DNA Sequence Number=SeqID_48019
  Homolog annotation: Hit_ID=Q2HW90; Match level="QueryCoverage=86%, HitCoverage=66%, E-value=6e-30, Identity=30%"; Hit description =Putative uncharacterized protein
MGPLQMQAFRKGYGKILDLTIAEIFIEAVVSLTQYYDQPLRCFTFGDFQLVPTIEEFEEILGCPLGGRKPYLFSGFLPSLSKIAVVVRDSARELDRVKQTRNDVVGHRSTWKARQGIWRIKRSESHLWMVDLAAIDAFLAYHHSKESPVVAILVDLFDTFDRRCEKSSSRIICCLPTLCVWLVSHLFQQDIRHPCPFRSHRSCVEKRRVDWDQHLAGIGGRTINWFPRWKEGNEGVLFSCGDYPNIPLIGTRGCINYNPALAIRQLGYPMRGAPAEESISHFLVRDFGAQSFKIIQRVHKAWERPLRKDKELRGIRNGIIGGYHEWLKVRTRGLDWLSKLKIINEENFEAPEEDEEVRALKTKLVKA

SEQ ID NO: 139705 - protein, 183 aa, Glycine max
  Coding DNA Sequence Number=SeqID_48020
LYSPIHLWPIRGGVMMLDLEILAHFLHHLIVQIGAIVSNDLPGESVSTNQLLLYESDYHTSRDISIRSRFDPLGEVIYRHKNEAVTIRRFGFDGPNDIYSPHGKRPRSGHNVQRMWRNIDIVRVCLTFMTLPYMSATIAFHSELVITDPKDFSGHSMPIGMCPARNLVDLLNHEVRLFGIYAS

SEQ ID NO: 139706 - protein, 102 aa, Glycine max
  Coding DNA Sequence Number=SeqID_48021
MTSSSAVGRSKEIRHLSESPTEGQEARQERFARLKTVLDSVDSRLDQAREIDRVRDNERARLRAEMDHDCDRWRALERKNAQMRLKVNELNLKKRGPLIKFK

SEQ ID NO: 139707 - protein, 72 aa, Glycine max
  Coding DNA Sequence Number=SeqID_48022
MSLPSAVHVSPLSSAKLLVTWKHKKKEEVEMRVVITERAGWTKSVSYLCFPLISDERLARSVKFRNVAEIEK

SEQ ID NO: 139708 - protein, 87 aa, Glycine max
  Coding DNA Sequence Number=SeqID_48023
MHVPYEKSPLKDLIEAQRSSLHRSSTSKRPSHGFCHTLISFGDHCSVACNFRLTTLRYLAPIVRQFVKFRDMSEIKRKHCYAIREIP

SEQ ID NO: 139709 - protein, 130 aa, Glycine max
  Coding DNA Sequence Number=SeqID_48024
MSDSKWRLLSLAEIAYSGWSFASLTLLSKVEEEPQSLVVFIVTAAVLEEEHMACLDQQHPGKEEQTVVVVEDLSISNLDDSSNLDCIYCLKGHNYSAIVGFAAEEIAAKKDRDLYGDLQKNIDHRLLQQV

SEQ ID NO: 139710 - protein, 51 aa, Glycine max
  Coding DNA Sequence Number=SeqID_48025
AHNISRRSKLNNGSSREIQMVITYHSDCPIQAHNISRSLKIEQQIPREIQT

SEQ ID NO: 139711 - protein, 175 aa, Glycine max
  Coding DNA Sequence Number=SeqID_48026
MGTNQTGKRFYQVKVKGLDTTSIKELGRLMEPLQMQAFRKIYGKILELTIEKISIEAIASLTQYYDQPLRCFTFGDFQLGKKTIPFLQMSPLFEQNCNYGQGFSKRFEPHKTDSERHSGPTTEVPRRQGEGYGQSRRLGPVYGCVSFANFWGCPLSKRRWFGGPSSNRRFPCIPP

SEQ ID NO: 139712 - protein, 58 aa, Glycine max
  Coding DNA Sequence Number=SeqID_48027
MTEIVCAEDDVNLACQRACWSRLTKGAEDDVSMTEIVGRPTKARLLLLRILNEELRPT

SEQ ID NO: 139713 - protein, 33 aa, Glycine max
  Coding DNA Sequence Number=SeqID_48028
MDHQKAAIRVMRYLKRTKYYMLTYKRSDQLEIT

SEQ ID NO: 139714 - protein, 288 aa, Glycine max
  Coding DNA Sequence Number=SeqID_48029
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPHNALPTKLTEHINFKTTPVYHLMCHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139715 - protein, 84 aa, Glycine max
  Coding DNA Sequence Number=SeqID_48030
  Subcellular localization annotation: CTP_CleavageSite=55; ConfidenceScore=5.50e-01
LFPPVQLLTGWSAHNSAHKHTDRKHSVASVAGCNAARTLTPAALNAPLRARPSPSAAHVREGPIGAGLLLLRPTRRKGMCCVCD

SEQ ID NO: 139716 - protein, 89 aa, Glycine max
  Coding DNA Sequence Number=SeqID_48031
  Gene Ontology: Mol. function=chloramphenicol O-acetyltransferase activity; Biological process=response to antibiotic
  Homolog annotation: Hit_ID=A6P250; Match level="QueryCoverage=61%, HitCoverage=57%, E-value=2e-25, Identity=96%"; Hit description =Chloramphenicol acetyltransferase
  Pfam annotation: Domain name=CAT; Domain location=1-47; Score=-86.8; E_value=1.4e-06; Accession=PF00302.9; Description=Chloramphenicol acetyltransferase
MDNFFAPVFTMGKYYTQGDKVLMPLAIQVHHAVCDGFHVGRMLNELQQYCDECSGALSAAGVVVTRSVTATLASADVRRCFCRYAPPRL

SEQ ID NO: 139717 - protein, 134 aa, Glycine max
  Coding DNA Sequence Number=SeqID_48032
MASAITWATWTLIRVRMAYTNWQREIEVMIARQDIAEQQCHPRLVQSGHAGVHDLHPPPYSDPGEILPRIRIELQDYLRVKLSHGSHQRRPMSASYLFLKVRILILPELDAPLSVERPSFDGLEAMLVLVALEM

SEQ ID NO: 139718 - protein, 71 aa, Glycine max
  Coding DNA Sequence Number=SeqID_48033
MWTTTGEELATQLAQASKVASSRSNSLLEEGSGRPKWLSKKLMKLTDCAKTPFFDFRHITEFHGSRKPASF

SEQ ID NO: 139719 - protein, 82 aa, Glycine max
  Coding DNA Sequence Number=SeqID_48034
MLATHYGYRATAKNLAVEAKLPYDAKVIAHPFKSSNCVIKDYNSMRIQDSRTSDSRVSEIKSRRCQDSSRRKSRVFKGFKFF

SEQ ID NO: 139720 - protein, 62 aa, Glycine max
  Coding DNA Sequence Number=SeqID_48035
MENNMTCPLSQPTLRREGDAGANGCVFQERKMCGVVTYVYSRKMSEKSEKGVSLAPTYPQLR

SEQ ID NO: 139721 - protein, 27 aa, Glycine max
  Coding DNA Sequence Number=SeqID_48036
NLHTFMLIMSPYNFALEVEISTVVYDV

SEQ ID NO: 139722 - protein, 44 aa, Glycine max
  Coding DNA Sequence Number=SeqID_48037
MLATGNRLLPSGNRLPERYVEAKLQDESTMIQRCFDDKNDDNKR

SEQ ID NO: 139723 - protein, 74 aa, Glycine max
  Coding DNA Sequence Number=SeqID_48038
MAVCICDGLHIHPKSISISYELQSGIQVKRYGCPNLRGQSISTFEGDDIYCASIGHPSQNFSPSKFNRVFHDKL

SEQ ID NO: 139724 - protein, 105 aa, Glycine max
  Coding DNA Sequence Number=SeqID_48039
MTTLGIISTEAIASLTQYYDQPLRCFTFGDFQLTPTVEEFEEILGCPLGGRKPYLFSGTKEMFGSKGESLGKSRQMGSIGGRPGALDLRSGPLSKRRWVGGPGSN

SEQ ID NO: 139725 - protein, 157 aa, Glycine max
  Coding DNA Sequence Number=SeqID_48040
MELDTHSAILAQNKVLTQQVEASTKQIGQLPQQYHQGGPQKMNQAHQVQRIFRCDFYGGSYKGYRGGSSSNQPYGWRPQNFGPTNTSLVGPSNNSNGDSSNKGPQQQQAQLDRLSKMEDTLNQFMQDNDEKKNKKGVEKENEKKDEVVTSEEVEEKM

SEQ ID NO: 139726 - protein, 202 aa, Glycine max
  Coding DNA Sequence Number=SeqID_48041
  Subcellular localization annotation: CTP_CleavageSite=35; ConfidenceScore=5.15e-01
MVKVGTSYVPINVSCFGPKVPNGSRHGPRHYLLPRAVQKAPSQSYSQYRATSRGDAPKLIDSSLTSHPPRLIAAATGRVRISPFGKPAATALSGQRAGDRVRALRYYPAALKGGCVHTGDYYVGYTEPGCPSRSVVEKKRRASAEYVDTTHYRANWSSRVAAALELTPPGAGFDRVRSRKWPVHNGRGSISWKMPGRYLTGK

SEQ ID NO: 139727 - protein, 178 aa, Glycine max
  Coding DNA Sequence Number=SeqID_48042
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=50%, E-value=7e-24, Identity=100%"; Hit description=LacZ protein
GTKAGTGPPLEVDGIDKLDLCKVTFGIRKCPAMTALKPTFKVEVPVDFPFDIEDNPGERTIQLKGKFRDEIIKVQVDIPNRPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 139728 - protein, 227 aa, Glycine max
  Coding DNA Sequence Number=SeqID_48043
ARVMGEVEEIQEKMKPDMEAIKEKMATMMEAMMSVKKIMEANAVAIAATSVVAKVNLMSPSGINQMNHPTSDMVGKDLGSTGSPHNVQIQNEHAYPQYGLPLNYTSPKVAYTPNKNVNNSTPIPIESQQPQTDHAHPCLGYATEGQAVGGIPLQNTLEDPQCHPQPQPSHSTAVKNPHAMAEMGKRKGLGPLKEVLDFDKYKGTTCPKNHPKMYCRKIRAYAKMRNC

SEQ ID NO: 139729 - protein, 125 aa, Glycine max
  Coding DNA Sequence Number=SeqID_48044
MPQNVLYDAIGIYQRCLFANRALEGDVPKLYDFSWRSWFLSAVLPVQLLRNWSRPIRTQAYRAGTSALASVAGVPDAAANSPPRRLNAAATGRPLSHVGKLRQLLNESATAGDRVRASSLLRQRR

SEQ ID NO: 139730 - protein, 161 aa, Glycine max
  Coding DNA Sequence Number=SeqID_48045
  Gene Ontology: Mol. function=unspecific monooxygenase activity
  Homolog annotation: Hit_ID=UPI00006A2901; Match level="QueryCoverage =59%, HitCoverage=62%, E-value=3e-34, Identity=79%"; Hit description =UPI00006A2901 related cluster
MIGRADIEGSKSNVAMTLGCHKPVIPVGSIGHAFTVRIRTGNQNQTSFYPFVPHEISVLVELILGHLRYLLADVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 139731 - protein, 193 aa, Glycine max
  Coding DNA Sequence Number=SeqID_48046
MRDYINYNPVLAIGKLGYPMRGVSSKETIAPFIARGFNEANVKILQRIHKAWNRVERKDKEFRGSSNGIISGYHKWLKSRTQGITWFPKLKGLSGKEAKIPEESEEVQALKGELEKTRVMKEKLKVAVTRVRKECDKLEDINIATIKALEWETRKPRKEEWSRNKFRGALWGSSNELKLRKAERDEQGWKAWC

SEQ ID NO: 139732 - protein, 64 aa, Glycine max
  Coding DNA Sequence Number=SeqID_48047
  Subcellular localization annotation: CTP_CleavageSite=45; ConfidenceScore=5.40e-01
MRTRSPPKVRACSPLKARTCSPLKVRACSPLLARTCNPSRTCSPPQGEGVYPTKEDSPLIGEGV

SEQ ID NO: 139733 - protein, 143 aa, Glycine max
  Coding DNA Sequence Number=SeqID_48048
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=3e-24, Identity=67%"; Hit description=LacZ protein
MEILIPCLSRAQIAYNYVGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 139734 - protein, 267 aa, Glycine max
  Coding DNA Sequence Number=SeqID_48049
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFDPRGLRRRVPAPPGRGLPGPRALRPHLPEPGAALLAAHPAAGSGVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139735 - protein, 109 aa, Glycine max
  Coding DNA Sequence Number=SeqID_48050
MELTSLYVIDYTTLVIDYQRPPQYSSSTSKPGSQLHPFGNRLPEAISTSCLVIDYPPLVIDYQRPYRKYHSRSIACQPPHKPPCFVVLVLLSVDCQELACLGTSQVLTD

SEQ ID NO: 139736 - protein, 103 aa, Glycine max
  Coding DNA Sequence Number=SeqID_48051
MQQRKDKELRGSSNGPINGYHRWLKAYAQDLDWLLSLRTTKGMEGETPEEDEELQALKTKLEKAQTVKEKFKSAAVRIRKENAELRDVNIATTKALKQETKRA

SEQ ID NO: 139737 - protein, 82 aa, Glycine max
  Coding DNA Sequence Number=SeqID_48052
MSWPSAVHVTSTFELGAMFQDCLSGDPQVQSSVFPFFREPHECHSLALFRCPPPWSWELCFLISEVWTLKCNPPFSPFFGAP

SEQ ID NO: 139738 - protein, 122 aa, Glycine max
  Coding DNA Sequence Number=SeqID_48053
MNRSETAKICMVYFKCMKWPRGNLPQRDPGRIKQPKELVLLPSMIVTALGSAETPAALRGHQGMVISPGATCPAQGRRVYRFPGGDSSPAGGITGHPHGQVRFRHSPRILCQCLATEEACEI

SEQ ID NO: 139739 - protein, 77 aa, Glycine max
  Coding DNA Sequence Number=SeqID_48054
MARKDKLWSFCALLSSRGGGPDDTRRQIMVIRALLLSRQIMVILRLLSLRSSKLSDKRAETNYAHSAPFVVQEQQVE

SEQ ID NO: 139740 - protein, 239 aa, Glycine max
  Coding DNA Sequence Number=SeqID_48055
  Gene Ontology: Biological process=transposition, DNA-mediated
  Homolog annotation: Hit_ID=Q6UUU1; Match level="QueryCoverage=25%, HitCoverage=40%, E-value=8e-18, Identity=78%"; Hit description =Putative uncharacterized protein
YDGVYEVLQWLLFLSAVPPVQLLTGWCVTAKAPPDISAGKCSGRVPFAIQAAQLFGRAIGAGLFAITPAGERGMCCKAIKLEIILVAGVLASASSLQIYQAYRYRRPRGGARYQLLFPLVRVNFELGVIMVIAVSFGKPVVPTALMNRPTRGERRFAYWALAECILAYYVGTDEGVSEVLHVAGEKRLHRCVSRICDTGYIPLPRSLTRYARSFDCGERKWLTIGAEISWKMPRRYLTG

SEQ ID NO: 139741 - protein, 83 aa, Glycine max
  Coding DNA Sequence Number=SeqID_48056
MAAEWRRKRERRCHFKEKMSLKEAHHHRRPWIRAWRKKEMNEGRGREEQEILCSKRALKSEFNIQMIKPTNPRSIPRFSTKCA

SEQ ID NO: 139742 - protein, 69 aa, Glycine max
  Coding DNA Sequence Number=SeqID_48057
MALIQCSFGHQIEGRAVVNEYFGHYVVHAFDGHVQSLVVSLALNRHLLVGKSRVIVCSDVVDYAPEALT

SEQ ID NO: 139743 - protein, 85 aa, Glycine max
  Coding DNA Sequence Number=SeqID_48058
MLSGMEPSSILWVSSQRSQRSDRGQVHENPRAFFSSSSSDEDMTKSKGKDPLEGLGGPMTRARARKAKESLQKVLSILFEYKPKF

SEQ ID NO: 139744 - protein, 163 aa, Glycine max
  Coding DNA Sequence Number=SeqID_48059
MQSQGLAVPPEPRVGPSGPRVSTKGSCVDPSGNDPETDDSDRCGLYIEADHARLVAMGRVYEGSTVVHNTPLLPGQVKVSTSHLPCLADTSGQIFITVAVSPAKPPPKPDPEVDDPLYLMTLTMPELFLRPYQVRWDATVFGVFNLDFPLYIKHEDLSEISHG

SEQ ID NO: 139745 - protein, 89 aa, Glycine max
  Coding DNA Sequence Number=SeqID_48060
QQKVYTDNHSGISGRQRDSKVSMTDLVSVEDDQKVYTDNHSGISARQRDSKVNMTDLVSVEDDAFRLTDNQKFIRITTPVFPAVSVTLA

SEQ ID NO: 139746 - protein, 187 aa, Glycine max
  Coding DNA Sequence Number=SeqID_48061
MASNSQQFSGRNDAIVIRGVHEVATNSAASSETKKLEGKLDALVKLVTQLAMNQKSVPVARVYGLCSSADHHTDLCPSMQQPRAIEQPEAYAANIYNRPPQPQQKSQPQQNNYDLSSNKYNPGWRNHPNLRWSSPQQQQQQPAPSFQNAAGPSRPYIPPPIQQQQRPQKQPTTTTTTSLHNLPSKNL

SEQ ID NO: 139747 - protein, 257 aa, Glycine max
  Coding DNA Sequence Number=SeqID_48062
  Gene Ontology: Mol. function=hydrolase activity, acting on carbon -nitrogen (but not peptide) bonds; Cellular component=cytoplasm
  Homolog annotation: Hit_ID=A8ADA6; Match level="QueryCoverage=100%, HitCoverage=66%, E-value=1e-101, Identity=71%"; Hit description =Putative uncharacterized protein
MLTGAYGLPSPTITGSVEKDVALIDKIIGVKCAISDHRSSAPADHQLASMAAQSRVGGLLGAKAGISVFHLGNSPKLLEPLLSILYNADVPRVKLLPTHVNRAQALFHAALNYAREGGFIDITTSISEPIDAASAIVMAREAQVPFNRLTLSSDGNGSQPKFDESGNLVGIGVAGFESLLETLQQLVNRHQLPLEEALLPFTQNVAAFLGLEHKGRIAPGCDADFLVLTDDLQIRDVWAKGRQMVREGAVCVKGTFE

SEQ ID NO: 139748 - protein, 195 aa, Glycine max
  Coding DNA Sequence Number=SeqID_48063
  Homolog annotation: Hit_ID=UPI00016621D1; Match level="QueryCoverage =93%, HitCoverage=37%, E-value=8e-08, Identity=29%"; Hit description =UPI00016621D1 related cluster
MTGPLVPIFFRGLHVLAIRGLHALAFRGLHALTFRGPPALTFIGLHDLTFRGLHVLTCRGLHVLAIRGLHALAFRGLYVLTFRGTIRTNLQRTTCPRLERDFTRPHLGGLHVLTFIGLHALTFRGLDTLIFRGLYVLPLRGLHILTFGGLHALALVGLHALTFRGLHILAFRGLHVLAFRGLHVLAFRGLHVPRL

SEQ ID NO: 139749 - protein, 174 aa, Glycine max
  Coding DNA Sequence Number=SeqID_48064
  Subcellular localization annotation: CTP_CleavageSite=57; ConfidenceScore=5.56e-01
MPKVKRFRNPQKSAPQPQCHGPLTQAPTHSVPAMNPKISSPPSDSTQALEVPTGNVPLSHVSTSEVPQEDETTRRHVGRESTQCWTVEAIDYEETIKKIKVKVRGVNSLPRELRIIVNFDDQGQAIGEAQALLAGFLGTLAANCKLFPMDYDRWSGPSGVPKAYFDDCFETILK

SEQ ID NO: 139750 - protein, 50 aa, Glycine max
  Coding DNA Sequence Number=SeqID_48065
MAQLISDVIYCLHGSRPQDAQWTRRSPTGPWGFQLWLRAFISPTGCPPPA

SEQ ID NO: 139751 - protein, 285 aa, Glycine max
  Coding DNA Sequence Number=SeqID_48066
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVGTSIGPQMSELTACSGELALIDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139752 - protein, 146 aa, Glycine max
  Coding DNA Sequence Number=SeqID_48067
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=71%, E-value=1e-24, Identity=69%"; Hit description=LacZ protein
MRASSPLHAVSSDICGPIEVPTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 139753 - protein, 259 aa, Glycine max
  Coding DNA Sequence Number=SeqID_48068
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIKDIGAFYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139754 - protein, 95 aa, Glycine max
  Coding DNA Sequence Number=SeqID_48069
MVKVGTSYVPIKVSYSPKVGPGIPGINRDTRIYLFCEVIFRHSCPSCSATDGVAAQLLGRAIGAGLFAITPAGERGMCCKAIKLGNARVFPVTTL

SEQ ID NO: 139755 - protein, 261 aa, Glycine max
  Coding DNA Sequence Number=SeqID_48070
  Homolog annotation: Hit_ID=Q6UUU1; Match level="QueryCoverage=22%, HitCoverage=40%, E-value=3e-18, Identity=78%"; Hit description =Putative uncharacterized protein
ISVTGIYSAQSASAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISILELLIAPYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139756 - protein, 62 aa, Glycine max
  Coding DNA Sequence Number=SeqID_48071
MTYSLRKTRQQVSRSPCHAQATPSHGDQPESQGSSKPSDMLPRISNMVTASLIEAVPESNKH

SEQ ID NO: 139757 - protein, 152 aa, Glycine max
  Coding DNA Sequence Number=SeqID_48072
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MKHFTDTLISANIRLARRGLIHTMQIQNLMHASPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 139758 - protein, 39 aa, Glycine max
  Coding DNA Sequence Number=SeqID_48073
  Homolog annotation: Hit_ID=A2Q5X8; Match level="QueryCoverage=100%, HitCoverage=6%, E-value=3e-11, Identity=82%"; Hit description =Protein kinase
MKLSDIMKATNNFSNTNMIGTGRTGTVYKAVLDDGTTLM

SEQ ID NO: 139759 - protein, 119 aa, Glycine max
  Coding DNA Sequence Number=SeqID_48074
MGEKANTPALKIGTGPIKRLLDTENALIRNTELTGYGFGFRFSPITKSRVRVRVWDSCIHPDPDPDPENNIKKKINRVCSLHIKKAKAKPHSDLTASYLLPPTLTLTSDLESFSSSSFR

SEQ ID NO: 139760 - protein, 185 aa, Glycine max
  Coding DNA Sequence Number=SeqID_48075
  Gene Ontology: Mol. function=tRNA dihydrouridine synthase activity; Cellular component=nucleus; Biological process=metabolic process
  Homolog annotation: Hit_ID=A4WCH7; Match level="QueryCoverage=91%, HitCoverage=54%, E-value=9e-88, Identity=93%"; Hit description =Dihydrouridine synthase, DuS
  Pfam annotation: Domain name=Dus; Domain location=1-184; Score=74.9; E_value=2.7e-19; Accession=PF01207.8; Description=Dihydrouridine synthase (Dus)
MEGVLDSLVRELLTEVNDYDLCVTEFLRVVDMLLPVKSFFRLCPELHNNSRTSSGTLVRIQLLGQYPEWLAENAARAVELGSYGVDLNCGCPSKLVNGSGGGATLLKDPELIYRGAKAMREAVPSHLPVTVKVRLGWDSDARQFEIADAVQQAGASELTVHGRTKEDGYRRIASTGRRSARSAND

SEQ ID NO: 139761 - protein, 39 aa, Glycine max
  Coding DNA Sequence Number=SeqID_48076
MSHHQRNLCLGASDGPRRRWAAAAVVEDDPFHFFDDSSI

SEQ ID NO: 139762 - protein, 183 aa, Glycine max
  Coding DNA Sequence Number=SeqID_48077
  Homolog annotation: Hit_ID=Q6WAY4; Match level="QueryCoverage=83%, HitCoverage=27%, E-value=6e-17, Identity=36%"; Hit description =Putative uncharacterized protein
MGTNQNGKRLYQVKIKGLDVTSLKELARLMGPLQRQAFRKVYGKILYLTTAEVFTEAVVSLVQYYDQPLRCFTFGDFQIVPTVEEFEEILGCPLGGRKPYLFSRFLPSLSKIAAVVGDSARELDHMKQTRNGVVGLPRKYLEGKARDMANQEEWVPFADILALLIFGVVLFSKRDGLGGPSRN

SEQ ID NO: 139763 - protein, 105 aa, Glycine max
  Coding DNA Sequence Number=SeqID_48078
  Pfam annotation: Domain name=G-patch; Domain location=1-42; Score =28.0; E_value=3.4e-05; Accession=PF01585.14; Description=G-patch domain
MVARVMLGNGYEPGMGLGKDNGGITSLISAKGNRGKFGLGYKPTQADIRKSIVGRKSGGDEGQVVAICEDDAPSGLDLVRPCPPDFQLGNWRVEERQGIYATSIM

SEQ ID NO: 139764 - protein, 87 aa, Glycine max
  Coding DNA Sequence Number=SeqID_48079
MKGLFVTKFESNEMLLSPIALKVVGPLLLDSNSSRDGTNPPFQFPIWQLTNKETKRQAIVGPCGLNNLRGIGLECRRSNNNQFNNVL

SEQ ID NO: 139765 - protein, 272 aa, Glycine max
  Coding DNA Sequence Number=SeqID_48080
  Gene Ontology: Mol. function=catalytic activity; Biological process =phospholipid biosynthetic process
  Homolog annotation: Hit_ID=Q1H161; Match level="QueryCoverage=98%, HitCoverage=77%, E-value=1e-119, Identity=78%"; Hit description =Fatty acid/phospholipid synthesis protein plsX
  Pfam annotation: Domain name=FA_synthesis; Domain location=1-256; Score=322.8; E_value=6.4e-94; Accession=PF02504.6; Description=Fatty acid synthesis protein
  Subcellular localization annotation: CTP_CleavageSite=34; ConfidenceScore=5.01e-01
MDESPQSAMKNKKDSSMRVAINMVKTGEAQACVSAGNTGALMATARFVLKTLPGIDRPAIASTLPSENGSTFMLDLGANADCTAEHLYQFAIMGAMAVSCINNKPNPTIGLLNIGSEDIKGNEVAKQAAELLRGSHLNFYGNVEGDDIFKGTTDVVVCDGFVGNVALKTTEGLAHMMGKFLTQEFKRNWLTKLMALGAFPVLKAFKKRLDPRRYNGASFLGLRGIVVKSHGGADSIGFYHAIHVAMEEAQSGMLKRIQAQLEIEHLTPSEQS

SEQ ID NO: 139766 - protein, 286 aa, Glycine max
  Coding DNA Sequence Number=SeqID_48081
  Gene Ontology: Mol. function=metabotropic glutamate, GABA-B-like receptor activity; Cellular component=outer membrane-bounded periplasmic space; Biological process=amino acid transport
  Homolog annotation: Hit_ID=A4WFN6; Match level="QueryCoverage=98%, HitCoverage=76%, E-value=1e-148, Identity=92%"; Hit description =Extracellular ligand-binding receptor precursor
  Pfam annotation: Domain name=ANF_receptor; Domain location=33-283; Score=132.7; E_value=1.1e-36; Accession=PF01094.19; Description =Receptor family ligand binding region
MVALSISHAAMAEDIKVAVVGAMSGPVAQWGDMEFNGARQAIKDINAKGGIKGDKLVGVEYDDACDPKQAVAVANKIVNDGIQYVIGHLCSSSTQPASDIYEDEGILMITPGATNPELTQRGYQHIMRTAGLDSSQGPTAAKFILENVKPQRIAIIHDKQQYGEGLARSVQDGLKKGGANIVFFDGITAGEKDFSALIARLQKENIDFVYYGGYYPEMGQMLRQARSVGLKTQFMGPEGVGNASLSNIAGDAAEGMLVTMPKRYDQDSANKAIVDALMRRKKIRAA

SEQ ID NO: 139767 - protein, 151 aa, Glycine max
  Coding DNA Sequence Number=SeqID_48082
MNFVARKPVEFTPIPVSYVDLLPYLLDNSMVAITLAKVHQPSFVREYDSNAMCACHGEAPRRSIEHCRALKHKVQVTMLNEMDKVDIFVPHPLTNASLLIQLSPECGCKPLVCLLKRPVLLSLDFQDRSIRDYSSCTLVGGRKTTSKVQNK

SEQ ID NO: 139768 - protein, 133 aa, Glycine max
  Coding DNA Sequence Number=SeqID_48083
SLRAIRLFVVQTAKKNICTDNHSGISARQRDSNVSMPDLVSAEDDTAKKNVYMDNHAGISACQRDSNVSMTDLVSAEDDTAKKNVYTDNHSGISARQRDSNVSMLDLRSAEDDVNLRVSTGLSATIDEGRRRQ

SEQ ID NO: 139769 - protein, 176 aa, Glycine max
  Coding DNA Sequence Number=SeqID_48084
MFRDARNKNKRPYWIGDHVWNNPLSHWNALGYPSNGSISLQDHAICLEEFEARLSQVRSDVASSVGESQLTPLDPAEKQKLRSRCWVAATDQSVKDAFTVLQILLIHINLEMRTSCSIRKDLPIVLNMPQRLTNRLRKELRQSKEEMRVFQLVVLRFLPPEVWNIIHQHQQPHQHH

SEQ ID NO: 139770 - protein, 101 aa, Glycine max
  Coding DNA Sequence Number=SeqID_48085
MDHFKCLKESMTMLTKLSCPVNGESNLRTNPSQEGENDEDMTKSKGKDPLEGLGGPMTRARARKAKEALQQVLSILFEYKPKFQGEKSKVVSCIMAQMEED

SEQ ID NO: 139771 - protein, 189 aa, Glycine max
  Coding DNA Sequence Number=SeqID_48086
METCSTVEELLQQMMDQGRFEISVENKEEQHMCMQSVSKENPTKPKPLVIHFTRDAASQKPRGPRPVTGSKPIPFPYGSNKAVPWRYAPQKPSEKKEEATSTDLPSAKDTKITGLSGVTRSGRIFAAPDPSVRPTNAKGKTKVVAEETNEASPTLDEDVSAGRFAEKGGDFDRKKVSMEEANEFLRIIQ

SEQ ID NO: 139772 - protein, 282 aa, Glycine max
  Coding DNA Sequence Number=SeqID_48087
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSISFAQYRVFPNTNLNEKSCHNTDQLYYCLHCGIIDVLECLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139773 - protein, 71 aa, Glycine max
  Coding DNA Sequence Number=SeqID_48088
  Subcellular localization annotation: CTP_CleavageSite=38; ConfidenceScore=5.35e-01
MLISPYGSISWDRPHKTPSGPRGVQQGLGFPALVTGLCQSYRVPVPPSKGSRSQDTLWTRRSPIGSWGFKF

SEQ ID NO: 139774 - protein, 74 aa, Glycine max
  Coding DNA Sequence Number=SeqID_48089
MGESSSDTRSIRVATYPSAGGRRVTRGMRVPRKEYARSRHQRLFEENVGKTGKDAIYKLLSERFGSCIYARGRY

SEQ ID NO: 139775 - protein, 70 aa, Glycine max
  Coding DNA Sequence Number=SeqID_48090
MSERGDCGSNVFQGYFDDAKESRVKQSFKQRFKKSSSKIQDSRFKNHDSRIIKIKIQDSRFKNQEKTQSR

SEQ ID NO: 139776 - protein, 188 aa, Glycine max
  Coding DNA Sequence Number=SeqID_48091
  Gene Ontology: Mol. function=3-deoxy-manno-octulosonate cytidylyltransferase activity; Cellular component=cytoplasm; Biological process=lipopolysaccharide biosynthetic process
  Homolog annotation: Hit_ID=Q7VVB0; Match level="QueryCoverage=100%, HitCoverage=74%, E-value=1e-84, Identity=81%"; Hit description=3 -deoxy-manno-octulosonate cytidylyltransferase
  Pfam annotation: Domain name=CTP_transf_3; Domain location=1-158; Score=23.2; E_value=2.2e-08; Accession=PF02348.10; Description =Cytidylyltransferase
MTRGDHLTGTDRLAEAVEQLGLPDDAIVVNVQGDEPLIEPELIDAVAARLADSPQADIATCACPLADAQALFNPNVVKLVCATDGRALYFSRAPIPWARDALAGGERVLAEGLPAWHHIGLYAYRVSFLRRFPTLPQGALERFESLEQLRAMEHGHVIVVHQASHPPAAGVDTPADLERVRLIYSNRI

SEQ ID NO: 139777 - protein, 135 aa, Glycine max
  Coding DNA Sequence Number=SeqID_48092
MNKKRSSTDDLIPIDLEINATCRRRNQERIRNFLQDLEVATIPEEEPQSSKASSSFPIVEHSHLDPSEDYIMAEEPRRVTLEDYSSSNVPQIFTSIAQPKVQAQTITYPPSLILLIQNNLFHGLLNEDPYAYLAD

SEQ ID NO: 139778 - protein, 51 aa, Glycine max
  Coding DNA Sequence Number=SeqID_48093
MISWFLKGENDAILPRKGPVTRTMSKRLQEDWTRAAEEGPRVLMNLRGSIV

SEQ ID NO: 139779 - protein, 50 aa, Glycine max
  Coding DNA Sequence Number=SeqID_48094
MTKARQKGVRKEKEGDACHPARPGELGCFLQKQPPSGGTSWKAQVGLVAI

SEQ ID NO: 139780 - protein, 151 aa, Glycine max
  Coding DNA Sequence Number=SeqID_48095
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=56%, HitCoverage=71%, E-value=3e-24, Identity=68%"; Hit description=LacZ protein
  Subcellular localization annotation: CTP_CleavageSite=25; ConfidenceScore=5.48e-01
MTMITPSSKLTLTKGNKSWYRAPPRGSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 139781 - protein, 78 aa, Glycine max
  Coding DNA Sequence Number=SeqID_48096
MERSMIDAAGGGALGDMMMQAPLELRNGERERERRRHFKEKMSLEEAHHHRRPWIRAWRKKEMNEGRGREEHEILCSK

SEQ ID NO: 139782 - protein, 193 aa, Glycine max
  Coding DNA Sequence Number=SeqID_48097
  Homolog annotation: Hit_ID=A0PAV3; Match level="QueryCoverage=33%, HitCoverage=31%, E-value=5e-07, Identity=52%"; Hit description =Restriction endonuclease
  Subcellular localization annotation: CTP_CleavageSite=44; ConfidenceScore=5.15e-01
MVKVGTSYVPINVSFSPKVGPGLPGINRDTRIYLFCEHRRTSALASVAVTLRVTTTPAALNAPLQGASHSPFRLRNCWKGDRCGPLRYYASCERGMCCKRLSWVTPVFSQSRRVKRRPVNCNTTHYRAIGAPRGGGRSRTSGSPARRNSIAPRINCQALFVHPPSSNVFRSPMNLLSFMHPPPLSPEPHELIA

SEQ ID NO: 139783 - protein, 265 aa, Glycine max
  Coding DNA Sequence Number=SeqID_48098
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLENQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139784 - protein, 174 aa, Glycine max
  Coding DNA Sequence Number=SeqID_48099
  Subcellular localization annotation: CTP_CleavageSite=44; ConfidenceScore=5.21e-01
MVKVGTSYVPINVSFSPKVGPGLPEYQLRDTTGLFFAEVTFPFRCSSGVSWFLSAVPSCSATDGELVPLQFGTQAYTPDISAGKWRAFHVGKPVRLRNCLRIGQRAGDRVRAFRVLRQLALKGGCVHTGDYYVGYTDARVSQSKCVHVAEKSAPVRQSEYVDTGLTIPGRIPRY

SEQ ID NO: 139785 - protein, 183 aa, Glycine max
  Coding DNA Sequence Number=SeqID_48100
  Subcellular localization annotation: CTP_CleavageSite=29; ConfidenceScore=5.07e-01
MKNVEERSKPSRNSSRKRYRNVSEAPRLRFSSRKQFFQANSKEREVPKGLNPFHFTSPPIYRKLGEKLATQLAQASRVASSRSNSLLEESSGEPKWAWLLFAPPFLLITETYEFRNDTCFLSVMLRNLVDHIIIPFLTYGMLRNLTNCATMLPFDFRCVTEPYGLCINIFFCFPACPGISQIA

SEQ ID NO: 139786 - protein, 279 aa, Glycine max
  Coding DNA Sequence Number=SeqID_48101
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDYLRRQKALGRPHQKHVIAQEATGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139787 - protein, 90 aa, Glycine max
  Coding DNA Sequence Number=SeqID_48102
  Homolog annotation: Hit_ID=A0PAV3; Match level="QueryCoverage=42%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGASHSPFRLRNCWEGRSVRASSLLRQLAKRGNVLQGD

SEQ ID NO: 139788 - protein, 197 aa, Glycine max
  Coding DNA Sequence Number=SeqID_48103
MSASDHAILRDRVHQPTKKSLLELSSHDALLAQNKLLSRQLEILTETLETRIYSRRISGFQQGPYNQQGQWRSHPGNQFNKDQGGPSNRSIQQGPNIFRRTTKLEETLTQFMQVTMSNHKSTESALKNLEVQVGQLSKQIADKSSNNFMANIEKNPKEECKAVMTRSKRFVEVKDEDSVVSKKKAAEKKGTDEMKDD

SEQ ID NO: 139789 - protein, 74 aa, Glycine max
  Coding DNA Sequence Number=SeqID_48104
MDRSWMNESHMSPEYEDGVEQFLQFASERGRSKEAFARYGWSDKSFTSLLEVVHNLLPEDNMLPKRSLCKWKDF

SEQ ID NO: 139790 - protein, 100 aa, Glycine max
  Coding DNA Sequence Number=SeqID_48105
MPTSPCRCIGWDCAHKTPNGPEKVQQGPGVSSSGCRPLSVLQGARSPSEESHPQRHPVDPQKSNRALGFPALVTGLCSPTGCPFPPARSRHHMSVCTSLN

SEQ ID NO: 139791 - protein, 56 aa, Glycine max
  Coding DNA Sequence Number=SeqID_48106
MDNESGGRRRYLMVIRTFRQLRGTNLTVLLSSSENIQARRRVRFFSARRGQSSAMA

SEQ ID NO: 139792 - protein, 144 aa, Glycine max
  Coding DNA Sequence Number=SeqID_48107
MKIVISIPFINCDFAGGEHYQDSCYFYSINKPDWRQESTMYNYHEKGRALDLESVLVDFMIYQASSKGDFYSMQQHGTQFERDYSFADYQWESEWQPYCHTLISSRDHPLLGCDPRLTTSRYLAPIVRQFVKFQDMSEAKRKAS

SEQ ID NO: 139793 - protein, 68 aa, Glycine max
  Coding DNA Sequence Number=SeqID_48108
MTHYNPYPRKQKRKEGKFPIKEKAKRKERKFPIKKWEKAKRKERKFPIKEWEKAKRKERKFPIKEWEK

SEQ ID NO: 139794 - protein, 49 aa, Glycine max
  Coding DNA Sequence Number=SeqID_48109
  Homolog annotation: Hit_ID=A5APY5; Match level="QueryCoverage=95%, HitCoverage=4%, E-value=1e-13, Identity=72%"; Hit description =Putative uncharacterized protein
MVETQSACKIQCLRSDNRKEYTSAKFNQFCEEARIEHQLTAPYTPEQNG

SEQ ID NO: 139795 - protein, 90 aa, Glycine max
  Coding DNA Sequence Number=SeqID_48110
MWVEKGWEWKFKWRRHLFDRDLEMAYCFCNDVADSCIQIHKKDEWIWKIDPTRQYSNTSIMVGIYDMGQHSWSFSAETVAALFPTRVLFA

SEQ ID NO: 139796 - protein, 253 aa, Glycine max
  Coding DNA Sequence Number=SeqID_48111
MDAGSCVGEIPVPPFPMVRTLLTWKGAAGRNGETSDAAIHNGEKLANLECYRRVLLAPIAASAPRKYVALQNCDDEDVETMIESFQQQQQMSVLELYVEKDVAGGSMFHFANSVMSCGHNLSLHESELPRNISNVHDDEDDDDDDYLASNSYIEESLDEDDSVEGISDTDDEGTDIIEPVSIVHPTEGVLGIQNPFWNDALHYNNINWSHPDEEDICGLDMPMTFNVGQELYVGMDFDSKDAVKNALKQYVMK

SEQ ID NO: 139797 - protein, 149 aa, Glycine max
  Coding DNA Sequence Number=SeqID_48112
QERIIEPVSHGPASERQFPAQEFHILQSSVETQGIGRRREVVEAEECSQQMAERGHGMHYTPQTFAQYPTQMYQYPFQGHHTDTSASQHSFGGVVLICVMNFLLRLTKKKQGGIGAEEILIAKHEDGIDHVAHPHGITDTKMNDLHVSV

SEQ ID NO: 139798 - protein, 109 aa, Glycine max
  Coding DNA Sequence Number=SeqID_48113
MRVYHSSSVRRTACHQACHLWMTKGVEDDVSLCLCCNMPFCGRARRGSRVRFPKEERCAESPPMFICGKHRKNRRKPIKMKILSSGVVFTFEEGISTSHVCLKGQQPIF

SEQ ID NO: 139799 - protein, 155 aa, Glycine max
  Coding DNA Sequence Number=SeqID_48114
  Homolog annotation: Hit_ID=Q2HTA0; Match level="QueryCoverage=87%, HitCoverage=21%, E-value=7e-17, Identity=33%"; Hit description=IMP dehydrogenase/GMP reductase, related
LAQSESYAWGAAALVHMYDQSNEASQSTRQQIVGYLTLLQAYMKGLTASPYQTCIDALTITNVCWMPYGDHRGVRAFDLISCFQGQLRWGLIVVTLRPKRMVRQFGYIQTIPPPPISATLSYKDINDRWMPYSDHLAVTGQICLVPGQVSGDYME

SEQ ID NO: 139800 - protein, 109 aa, Glycine max
  Coding DNA Sequence Number=SeqID_48115
  Subcellular localization annotation: CTP_CleavageSite=23; ConfidenceScore=5.47e-01
MVTPPRSPPQSDGNTEPQPKKTRQSTRLRRLTLRSLDQPRPTVTVDPATGRASGPEKQKFHSFLRVLAREKIPIVHSNWKNVRETLKDMVWGDILAKFDIPEAEKAKKK

SEQ ID NO: 139801 - protein, 189 aa, Glycine max
  Coding DNA Sequence Number=SeqID_48116
  Gene Ontology: Mol. function=hydrogen ion transporting ATP synthase activity, rotational mechanism; Cellular component=proton -transporting two-sector ATPase complex; Biological process =mitochondrial electron transport, NADH to ubiquinone
  Homolog annotation: Hit_ID=Q0JIM3; Match level="QueryCoverage=98%, HitCoverage=9%, E-value=3e-60, Identity=69%"; Hit description =Photosystem I P700 chlorophyll A apoprotein
  Pfam annotation: Domain name=ATP-synt_DE_N; Domain location=97-170; Score=90.3; E_value=6e-24; Accession=PF02823.7; Description=ATP synthase, DeltaEpsilon chain, beta-sandwich domain
  Pfam annotation: Domain name=ATP-synt_ab_C; Domain location=12-113; Score=160.6; E_value=4.1e-45; Accession=PF00306.18; Description=ATP synthase alphabeta chain, C terminal domain
  Pfam module annotation: Pfam domain module=ATP-synt_DE_N::ATP-synt_ab_ C; Domain location=97-170::12-113
MLQPRIVGEEHYETAQRVKQTLQRYKELQDIIAILGLDELSEEDRLTVARARKIERFLSQPFFVAEVFTGSPGKYVSLAETIRGFKLILSGELDGLPEQAFYLVVKEIILSTNSGQIGVLPNHAPIATAVDIGILRIRLLKDQWLTMALMGGFARINNNEITVLVNDAEKGSDIDPQEAQQTLEIAELI

SEQ ID NO: 139802 - protein, 98 aa, Glycine max
  Coding DNA Sequence Number=SeqID_48117
MVKKFRKFLKRSKDKRFSKPSKKTESNNNTFRCFECGKQDLMDDSSTIEEIEVNSEFEKVLEAFNEMHEKAQRLAVSNNKLRKDLKLHISNWLQHKVS

SEQ ID NO: 139803 - protein, 72 aa, Glycine max
  Coding DNA Sequence Number=SeqID_48118
MDESFSLGSWLNNYQTYQGGVYPDLSSFTGSGVYPDLSSFTGSGVYPDLSSFTGSGVIQKLYNLYQAIRSYS

SEQ ID NO: 139804 - protein, 121 aa, Glycine max
  Coding DNA Sequence Number=SeqID_48119
MEKDKGGLAWRKGCWFGGRNFDSPGQQAGGVLILCDNTTERVALLGGQLCDNTTEKAALSFNMLWSQRPYEIVMSFTRSKPGPRAVRKIGRNLSGTTHPTLPPIGGRPFYSRPKRNCSDLE

SEQ ID NO: 139805 - protein, 397 aa, Glycine max
  Coding DNA Sequence Number=SeqID_48120
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=41%, E-value=0.0, Identity=90%"; Hit description=DNA -directed RNA polymerase subunit beta
  Pfam annotation: Domain name=RNA_pol_Rpb2_6; Domain location=35-392; Score=576.2; E_value=3.3e-170; Accession=PF00562.19; Description=RNA polymerase Rpb2, domain 6
MSSNMQRQAVPLSQSEKCIVGTGLERQVALDSGVSAIAEHEGNIIYTNTDRIFLFGNGDTLSIPLTIYQRSNKNTCMHQKPQVRRGKCIKKGQILADGAATVDGELALGKNVLVAYMPWEGYNSEDAVLINERLVYEDIYTSFHIRKYEIQTHMTSYGSERITNKIPHLEAHLLRNLDKNGIVILGSWVETGDILVGKLTPQMAKESSYSPEDRLLRAILGIQKREIKVGDKVAGRHGNKGIVSKILSRQDMPYLQDGRPVDMVFNPLGVPSRMNVGQIFECSLGLAGGMLERHYRITPFDERYEQEASRKLVFSELYEASKQTSNPWIFEPEYPGKSKIFDGRTGNSFKQPAIMGKPYILKLIHQVDDKIHGRSSGHYALVTQQPLRGRAKQGGQR

SEQ ID NO: 139806 - protein, 81 aa, Glycine max
  Coding DNA Sequence Number=SeqID_48121
  Homolog annotation: Hit_ID=A5AV98; Match level="QueryCoverage=95%, HitCoverage=10%, E-value=2e-09, Identity=45%"; Hit description =Putative uncharacterized protein
MRIFETGNARFIENGEISGSTVPREVEIKEVRVQVPLAFASSSKVITTSVIATNSNEEVQYNDEPMIHNEPILWKNQQEVH

SEQ ID NO: 139807 - protein, 49 aa, Glycine max
  Coding DNA Sequence Number=SeqID_48122
MQQGQAYIPIVRFPNPNYASNGCSWWPPAVVGGGEEGVRVWVGFWRAGE

SEQ ID NO: 139808 - protein, 184 aa, Glycine max
  Coding DNA Sequence Number=SeqID_48123
DGPLRTSTLTFRGLYVLVIRGLHALTIRGLHVLTFRGLHVLAIKGLHALIFRGLHVLTFRGLHVLALRGLHTLSFSGLDTLTFKGFLLSVPGPPPDIGGRPTVRAQPEREAIAQLLCIPGQDFTRAATKRRVRVMRTNMTTLTQIWMTLLLSNIPPGDRNADLPLRKYQDSAHKTPDGPEEVQQ

SEQ ID NO: 139809 - protein, 307 aa, Glycine max
  Coding DNA Sequence Number=SeqID_48124
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIPKSRSKSRISISIESDRDPRFTYRFWESLNKELGTKLRLEYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139810 - protein, 82 aa, Glycine max
  Coding DNA Sequence Number=SeqID_48125
MKMLLIPHDVAPCGACRPWIFFINGVVCFLKINGSGMEEEESPLIQDQVQDSPLSVVRCHEAWWIHLGSTRVDAQVAPMSFL

SEQ ID NO: 139811 - protein, 57 aa, Glycine max
  Coding DNA Sequence Number=SeqID_48126
NVMNSPSEHAALSKFINTHCMQALSEELAKRAYRTKRVHPLRMNTHPLVELPVAKRG

SEQ ID NO: 139812 - protein, 57 aa, Glycine max
  Coding DNA Sequence Number=SeqID_48127
MGVQIAIRPTWALQKIPPEAEALPKRFRNVFREEFRKGFNRSSTFFIRSSSFFDLQR

SEQ ID NO: 139813 - protein, 201 aa, Glycine max
  Coding DNA Sequence Number=SeqID_48128
  Gene Ontology: Mol. function=aspartic-type endopeptidase activity; Cellular component=small subunit processome; Biological process=DNA integration
  Homolog annotation: Hit_ID=A5AGN7; Match level="QueryCoverage=84%, HitCoverage=13%, E-value=2e-25, Identity=34%"; Hit description =Putative uncharacterized protein
YHEHLEQSSEKISEDKHEQWKKLDYQLCALLWQFVEPTILTNFRAFKTCYSFRKKTQSVFANDIQQLYDATQKLTTLKQTDHDMVAYVLKAQSAVEELKLSLDKLEDIKTKLDNLYIVLVLNGMHPDFDHIRDQVLTGQVPSLENLITRLLRVPSPKIGGNSVDSIELLPWYLVEGDEVVVETEEDELEEEVTLNVLTIRK

SEQ ID NO: 139814 - protein, 93 aa, Glycine max
  Coding DNA Sequence Number=SeqID_48129
  Homolog annotation: Hit_ID=A5BMX7; Match level="QueryCoverage=47%, HitCoverage=5%, E-value=3e-10, Identity=56%"; Hit description =Putative uncharacterized protein
MEKSDKKTFKDKKGKKAYITWEDNDIDSSSDSENEIINLSLMAKDYESKEEDSLKQNWYIDSGCSKHMTGDASKFTHISHKNSGHVTYGDNNK

SEQ ID NO: 139815 - protein, 63 aa, Glycine max
  Coding DNA Sequence Number=SeqID_48130
QQDENWFHLLAPIISQWNNAAQFRVDVYPRQQGLLGFNSDYMVWYRRKTKMFVDPNNANTAAL

SEQ ID NO: 139816 - protein, 42 aa, Glycine max
  Coding DNA Sequence Number=SeqID_48131
MGHLSNHGVPMNSKRIKVIPKWRTPPSVEGKSLEFQEPWDLR

SEQ ID NO: 139817 - protein, 121 aa, Glycine max
  Coding DNA Sequence Number=SeqID_48132
MSKSCGFGMTGPLDESISCFLIRVAPWLPSPLRGLHVLALRGLHVLTIRGLHALTSRGLHVLALRGLHALTLGTSYPHRQRTTRPRLERTTRSQHQRAARPHLQRTISPRLERATRPHLGY

SEQ ID NO: 139818 - protein, 137 aa, Glycine max
  Coding DNA Sequence Number=SeqID_48133
MSRGSGDLGDIRLGKRVVQEAIRASGNRLPRGCNRLPTVRNEGLCLEFRKGGLRGMGHWGFKSELPGMCNRLPCLGVGRVFMSFEACVIRVWPLTRRRATRGWWVYAQFVDVENLLCTIARPPPSTTCDGYPIILQA

SEQ ID NO: 139819 - protein, 242 aa, Glycine max
  Coding DNA Sequence Number=SeqID_48134
  Homolog annotation: Hit_ID=Q2HW90; Match level="QueryCoverage=75%, HitCoverage=36%, E-value=3e-22, Identity=33%"; Hit description =Putative uncharacterized protein
MAEVSTESIASLAQYYDQPLRCFTFGDFQLSPMVEEFEEILGCPLGGRRPYLFSGFYPSLARISKIFQISAQELDHRKQVKNGVVGILRKCLEAKARILAGRGEWAPFIDILALLSFGGVLFPNVDGLVDLAAIDAFLAYHDHKESSVVAMLADLYDTFDRRCEKSSTRIVCCTPALYVWLVSHLFRQEVRHACPLESHRSCTEKGGANWDRLLANKEEASSAGSLDGKKGEPGFLFHAEDF

SEQ ID NO: 139820 - protein, 118 aa, Glycine max
  Coding DNA Sequence Number=SeqID_48135
  Subcellular localization annotation: CTP_CleavageSite=90; ConfidenceScore=5.14e-01
MGVDFLTRLFTRYFIFTSTRGRGRSSLLLTTINVLTPHDNGFHCGALRGNVTSPNTFKAFNVASPFLGTSLRGVFLYGLTLIFLGFRRLKAQVEKDEGPSREGQSPRVEKDEGPSGEG

SEQ ID NO: 139821 - protein, 161 aa, Glycine max
  Coding DNA Sequence Number=SeqID_48136
MWAFLTGRQIDWAHLVRYRMHKALRANAPLPYPQLITLFLRHFQIPLDDEPFVQVKRSFAIGAGVVTSFGYRKDRNGQWLKKDALPPQDERTPSPPPQHEDSALLNGVLTELRGLRSYVGERFDSLDTRFADMDIRLTQVEEDVSFIHTCFDPPPPPPSSS

SEQ ID NO: 139822 - protein, 73 aa, Glycine max
  Coding DNA Sequence Number=SeqID_48137
MDQLDFFGNGVLCGVRKSLAHRILVGNQREGTTSSRGFLSNENPETGQKQAKGSSGEGRRPKWRRTKPPSGEG

SEQ ID NO: 139823 - protein, 82 aa, Glycine max
  Coding DNA Sequence Number=SeqID_48138
MTHYNPYPRKQKRKEGKFPIKEKAKIKERKFPIKEWEKAKRKERKFPIKEWEKAKRKERKFPTKEWEKVKEREGKKVLDQRN

SEQ ID NO: 139824 - protein, 83 aa, Glycine max
  Coding DNA Sequence Number=SeqID_48139
MERGQVQIHECLYQLSLSQQSQGFAPFACPTPDQFRTEVAWPGDWPEAQAGEAPAEAPGDAEEARMDEEMTDLLGFLGGSGAT

SEQ ID NO: 139825 - protein, 130 aa, Glycine max
  Coding DNA Sequence Number=SeqID_48140
MAKFDPQVVLEFYANAWPTEEGVRDMRSWVRGQWIPFDADALSQFLGDLLVLEEGQECEFSQRRNRVDGFDKEAIAQLLWTPGQDFARTAAGRWVRIMRTSMTTLTQTWMILLLSNVLPSDHNSDLPLPK

SEQ ID NO: 139826 - protein, 181 aa, Glycine max
  Coding DNA Sequence Number=SeqID_48141
  Homolog annotation: Hit_ID=Q2HTA0; Match level="QueryCoverage=55%, HitCoverage=16%, E-value=1e-09, Identity=37%"; Hit description=IMP dehydrogenase/GMP reductase, related
CWIYEHFSSIGSALAAEDYDGRRPRTCWWTFGKALPVSTYHREFEVITLFSGHLRWGPLMVIHRPERVVRQFGYIQTISSHPATTSVSFEEMDDRWMQFSDYIAPVGQICVVPGQCSPNYMDWLCMISHPFMSPAQLGDPPRVLSVQQYDTFVEPDVHQQQVAATTLDEADADVHHVGHAM

SEQ ID NO: 139827 - protein, 87 aa, Glycine max
  Coding DNA Sequence Number=SeqID_48142
MTKVNKEPFLGQIWVLKSQILIRVFCLCPVFLAVLGRIDGDPVLRETRLWATWEYVSSVGGGQQGMVGLCALCGCGKLVVHHRPTAT

SEQ ID NO: 139828 - protein, 243 aa, Glycine max
  Coding DNA Sequence Number=SeqID_48143
  Homolog annotation: Hit_ID=A4PP05; Match level="QueryCoverage=64%, HitCoverage=39%, E-value=9e-15, Identity=32%"; Hit description=IMP dehydrogenase/GMP reductase, putative
CWIYEHFPSVHQCVTDDTYQETSPRASRWLTSKAHMKGITGAPYRARCDVLTVTDVSWLPYTEHGGQLRWGPMIVTVRPERMVRQFGYIQSIPPPPVSARLSHDQIDNRWMEFADHLLPAGQPCLVPGQVSADYIEWFFRISHPFMTPTQAADQQRDAPAVDPEDYIQPPSPQVPVAFDPPTYVDDYEGYEAIAQRLERVLNLRIVTAGTELYDIMQDCLTIARGGPSADGTVRARQRRRTDH

SEQ ID NO: 139829 - protein, 160 aa, Glycine max
  Coding DNA Sequence Number=SeqID_48144
MATSGPVFSFSAVSHCLYWAGFDLVKNPTLGHLLILLSSNFLLVFVLEVIVVLGVQSVLITLKSSPAASAAFVSGNLLFPSSSPATSFELGTPASSSVVYSVSSNVVQFSSASTPQFSFTPAAAASTSTQASNLPQFNQILYLGASTPSGGSPFQFGGAA

SEQ ID NO: 139830 - protein, 187 aa, Glycine max
  Coding DNA Sequence Number=SeqID_48145
MASIMEAMLKLQKTIEDNATAAASNTAREAESVLPPVINLGRNTTVLGRRYSPQAYPYGLPPDFTPRTAPDDLNQALTFEGKLPPYADYPLQEDDEGDAHLGPLLPLKDPAPHELPQPNIVRHVPSSPAPVKESVPFAKDKGKIDLLEERLRAVEGLGNYPFSDLVDLCLVPDIVIPPKFKVPDFDK

SEQ ID NO: 139831 - protein, 158 aa, Glycine max
  Coding DNA Sequence Number=SeqID_48146
MVKEECKEVSVSSKRLAKKERQFEIKTNIKEISLLKQPPHFLLCKKTLVRIATPLRLEFIPQVKELLDEGLVLLGTQIPKIGGMMNALGGATLICKITRAPNIFMICVHRDSLGRNNQHENTEKGVPINPKRIKVIPEWPAPPSVLREKAQSFKNLGI

SEQ ID NO: 139832 - protein, 185 aa, Glycine max
  Coding DNA Sequence Number=SeqID_48147
  Homolog annotation: Hit_ID=Q8LMF2; Match level="QueryCoverage=85%, HitCoverage=16%, E-value=7e-09, Identity=29%"; Hit description =Putative uncharacterized protein OJ1325D05.18
MSTVGTRWRQFKSSLTTRYVYAENDDEQNKDPSAKYGIDRNTWEEFAKTRHTPTWKGISKKAQEIQKFNESPHVLSCGSYDVLEKKLMAEKTKSRLNEGDNSQNADMVVDPPSPITRHEKWKKARTNKFGQMTSAATQEIADKIDELQEQTKQGAFCPTWSSRHPEHCHWLSRASPSLFVSMDMV

SEQ ID NO: 139833 - protein, 41 aa, Glycine max
  Coding DNA Sequence Number=SeqID_48148
MSHHSSSVNGEGTSHKDPLSRILDELMMQSYSARALDRKTP

SEQ ID NO: 139834 - protein, 272 aa, Glycine max
  Coding DNA Sequence Number=SeqID_48149
  Gene Ontology: Biological process=transposition, DNA-mediated
  Homolog annotation: Hit_ID=Q6UUU1; Match level="QueryCoverage=22%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLEIPFELNNLGPLIEKYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139835 - protein, 128 aa, Glycine max
  Coding DNA Sequence Number=SeqID_48150
  Homolog annotation: Hit_ID=A5C6C9; Match level="QueryCoverage=75%, HitCoverage=7%, E-value=4e-12, Identity=39%"; Hit description =Serine/threonine protein phosphatase
AVIMLDELLEVSGEELRAKAAQWLGAHSGSYAWGAAALVHMYDQLNDASQSTGQQLVGYITLLQCWIYEHFPNVHASVTDDGYDETSPRVCRWLTMKAYMKGLKASLYWTRIDALTIPDVCWMPYVDH

SEQ ID NO: 139836 - protein, 171 aa, Glycine max
  Coding DNA Sequence Number=SeqID_48151
  Subcellular localization annotation: CTP_CleavageSite=26; ConfidenceScore=5.16e-01
MASIKRSSSTCAFQIPGSTIDGVPVSSTARRHGASSDETYPPARAISSSLIPPVIGIISARGRISEYFWCATRDSSRPGIDAPDKHLSIGAAERRGGNRALTGQHAFNLYHAVPVQTAPGAKRFSADKARRSDPDLGVHVGAVEINLAAELMHYLAHFTDGLFIHAVGRRI

SEQ ID NO: 139837 - protein, 118 aa, Glycine max
  Coding DNA Sequence Number=SeqID_48152
MTKDKVGTSKPYTEAMRGTVHEPQANLGADQKYSPVDVFKQRKGDKPWDFNGLIKSQTAPLSSLQNGQVTKSNRTYTLREFQERFAKDRIRLHELSPLSKGQSICVFRNNQIKIKIIK

SEQ ID NO: 139838 - protein, 100 aa, Glycine max
  Coding DNA Sequence Number=SeqID_48153
  Subcellular localization annotation: CTP_CleavageSite=41; ConfidenceScore=5.23e-01
MILHEIIRPNSLKTVPSGVTNCRNLPFDRRARRDSRVRLPRKENARSRHQRLFEENVGKTGKGCGLRTLSVKGSGVVFMHGEGCFPCSYVFLNGRMPNLP

SEQ ID NO: 139839 - protein, 369 aa, Glycine max
  Coding DNA Sequence Number=SeqID_48154
MSHHSSSVNGKGTSHKDPLSRILDELSSLKLWKEKQERKEKGKKRVEEISQDERKKIREEERRKIMKEMKREKHAYYSSHNSCKSLSEELRDYYEGRHRSHLRPHSHRREKERKPQEANIKLSYFHGKDNVEANLDWEIRVEQQLKKKSTSKSYGSHSYPKKDQGQDILGVTPSKPKDDKGKTIEKQAPKARHITSQCPTTKTMINEGAKTFYSSQDEATTSPSSSESEEAKGEESSEEIYPQEDGQPLVVKEKCKEVSVSSKRLAKKETHFTIKTNIKETFPLRQPPHFLFCKKTLASIATPLGLEFIPQVKKLLDEGLVRKSLNPCALLVPKIGIIRHQVPKIGVMMNVLSGAILFCKITRTPNIFM

SEQ ID NO: 139840 - protein, 106 aa, Glycine max
  Coding DNA Sequence Number=SeqID_48155
MAKFDPEIVLEFYANAWPTEEGVRDMRSWVRGQWIPFDADALSQFLGDSLVLEEGNQCEFGQRRNRVDGFDKEAIAQLLCTSGQDFARTAVGTQVQIMRTSMTTLT

SEQ ID NO: 139841 - protein, 93 aa, Glycine max
  Coding DNA Sequence Number=SeqID_48156
MARSVSASCPYSRDLNGRELTRLLVIIPKVVISHLMVSRVPNGVANCRNLPFGERATRDSRVRVPRKEYARSCHQHLFEGNVGKTGKDVIYEL

SEQ ID NO: 139842 - protein, 69 aa, Glycine max
  Coding DNA Sequence Number=SeqID_48157
MQLTVYWIKLNYHENSPISFISITILCLPEAQRDILLSKHLDIPEAISRAKLDIMKKSRVPQSGTSSIA

SEQ ID NO: 139843 - protein, 185 aa, Glycine max
  Coding DNA Sequence Number=SeqID_48158
  Homolog annotation: Hit_ID=Q2XNY0; Match level="QueryCoverage=89%, HitCoverage=40%, E-value=5e-07, Identity=22%"; Hit description =Putative uncharacterized protein
MTGRLLAGSLAFESRILHYLIVRILLPRSSNLAQVSEEDLIVMWAFHKGLQIDWAHLVRYHMHKALRLNAPFPYPHLVTLFLQHFNIPLDSEPYVPIKRSFLIGASVIARHVGEEGHDGEDSSLLSKILDRFDGLQTFVGERFDTLELQVEMRFNEIESRITKVEEDVSYIHSSFDLPPPPPPSS

SEQ ID NO: 139844 - protein, 127 aa, Glycine max
  Coding DNA Sequence Number=SeqID_48159
  Pfam annotation: Domain name=Transposase_23; Domain location=37-107; Score=-3.9; E_value=0.0032; Accession=PF03017.5; Description =TNP1ENSPM transposase
MQSQGLAVPPEPLVGPSGPRVSTKGSCVDPSGNDPEMGDSDRCGLYIETDPACLVAMGRVYEGSTIVHNTPLLPGQVKVSVEEVTDANALVPVPTDEVSLVGDAILPHKGIGYKTPSRLGQRSKGRP

SEQ ID NO: 139845 - protein, 26 aa, Glycine max
  Coding DNA Sequence Number=SeqID_48160
MKIDQAYGLGIFRSGNREFEEARILK

SEQ ID NO: 139846 - protein, 229 aa, Glycine max
  Coding DNA Sequence Number=SeqID_48161
MWSSAPFPEMSAFSDGDFSSLTSYLELQAAGPMIRGDTLRLSAPFCHPEAAGPMTSRDKIWSFCTLVSSRGGGPDDTRRYLTVIRTLVSSRGGGPDDTRRYLTVIRTLVSSRGGGPDDTRGYLTVIRTLVSSRGGGPDDTRRYLTVIRTLVSSRGGGPDDTRRYLTVIRTLVSSRGGGPDDTRRYLTVIRTLVSSKGGGPNDTRKYPSCYPYKHSFAICKTERLIACRG

SEQ ID NO: 139847 - protein, 16 aa, Glycine max
  Coding DNA Sequence Number=SeqID_48162
VGRIFFDVQPAFVIEA

SEQ ID NO: 139848 - protein, 71 aa, Glycine max
  Coding DNA Sequence Number=SeqID_48163
VAWGLDVGTGCCRTSIKTLVMQAPLELVGLGSSSSMDSFASWKMNGSGMEKEEREETPLQGEDESRRSSPP

SEQ ID NO: 139849 - protein, 129 aa, Glycine max
  Coding DNA Sequence Number=SeqID_48164
  Gene Ontology: Mol. function=aspartic-type endopeptidase activity; Biological process=DNA integration
  Homolog annotation: Hit_ID=A5BQD7; Match level="QueryCoverage=93%, HitCoverage=13%, E-value=3e-11, Identity=31%"; Hit description =Putative uncharacterized protein
  Pfam annotation: Domain name=zf-CCHC; Domain location=57-74; Score =30.5; E_value=6.2e-06; Accession=PF00098.14; Description=Zinc knuckle
SSSIQEGSDKEDLNEIDEDDDFSFFVKRFNKFLRNKGNQRRSNFKSKKRAEDSSSLPKCYECNQPGHLRVDCPSFKKRIEKSEMKTFNDKKAKKAYITWEDNDTDSYEDSENEVVNLILMAKNYESDEE

SEQ ID NO: 139850 - protein, 311 aa, Glycine max
  Coding DNA Sequence Number=SeqID_48165
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMDIWASLRLSLETGFLHIMLDRRILSNFFWDVCIQIRELNLPLDRADWIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPRRYLTG

SEQ ID NO: 139851 - protein, 164 aa, Glycine max
  Coding DNA Sequence Number=SeqID_48166
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
  Subcellular localization annotation: CTP_CleavageSite=32; ConfidenceScore=5.35e-01
MTMITPSSKLTLTKGNKSWYRAPPREIPFPTKASKRPKYPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 139852 - protein, 161 aa, Glycine max
  Coding DNA Sequence Number=SeqID_48167
MDMEDVAILVTFCPTTTMPNLPCRCIGIAPTKMPSGPEEVQQDLGVSSSGYGPLSVLQGARSPSEESHPQRHPVDPEKSNRALGFPALVTGLCSPTGCPFPPARSRHHSSTEYLSPPARASGPLLIELSSRSTTLPGRRKAKHHNSLGMVGSGQQTHCHHL

SEQ ID NO: 139853 - protein, 259 aa, Glycine max
  Coding DNA Sequence Number=SeqID_48168
  Gene Ontology: Mol. function=signal transducer activity; Cellular component=membrane; Biological process=signal transduction
  Homolog annotation: Hit_ID=A4W5X4; Match level="QueryCoverage=100%, HitCoverage=49%, E-value=1e-110, Identity=82%"; Hit description =Methyl-accepting chemotaxis sensory transducer precursor
  Pfam annotation: Domain name=HAMP; Domain location=61-130; Score =40.9; E_value=4.5e-09; Accession=PF00672.16; Description=HAMP domain
  Pfam annotation: Domain name=MCPsignal; Domain location=161-259; Score=-42.7; E_value=8.1e-05; Accession=PF00015.12; Description =Methyl-accepting chemotaxis protein (MCP) signaling domain
  Pfam module annotation: Pfam domain module=HAMP::MCPsignal; Domain location=61-130::161-259
MLKALNDQSADNYYDLLENALIPVAKQFDNAMQAFQKWSEARGQAEVSAVQASKTRVLILIIVAALLTAGIIVLAWLVLRHMLLKPLSASIAQLENVAAGDLTHTLNAPASQEFNRLNAAIEEMRQSLMNSVLRVRDASAQIDTGSRELTAGNRDLAERTESTATSLEQTAASMEEITATVKLNADNAEQAHQLAKSVSDTADHGSEMVCYVIEKMRDISGSSARIADILSVIDGIAFQTNILALNASVEAARAGEQGR

SEQ ID NO: 139854 - protein, 332 aa, Glycine max
  Coding DNA Sequence Number=SeqID_48169
  Homolog annotation: Hit_ID=Q6WAY6; Match level="QueryCoverage=81%, HitCoverage=56%, E-value=1e-25, Identity=28%"; Hit description =Putative uncharacterized protein
TCGKIWDLAMVEFSVEAIASLTQYYDQPLRCFTFGDFQLVPTVEEFEEILVCLLGGRKPHLFSVFYPSMARVAKAKALANQGEWASFIDVLALLIFGVILFPNVEGLVDLAVIDAFLAYHHSKESLVIAIFVDVYDTPTCPLQGHRLCAKKGKANWEQLLASVVGASINWFPRWKEGRTRVLSSCEGFPNVPLMGTMGCINYNPILAIRQLGYPMRGVPLEESITPFITRGFSDPNARVLQGVRKAWGAVQRKDKELRGSSNGIIDGYHKWLRAAREEVVETPEESQEVQTLKVDLERAQAVKKKFKSTAIKVRKKYDELRDVNMATTEALE

SEQ ID NO: 139855 - protein, 78 aa, Glycine max
  Coding DNA Sequence Number=SeqID_48170
MRIFEGHIELLTANCRTICPLGSFNMKQLARLGEHVASELSHQLAWASWVASSSLILAMKGRGRLRGRGQHPWYSDFT

SEQ ID NO: 139856 - protein, 270 aa, Glycine max
  Coding DNA Sequence Number=SeqID_48171
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMKYFNPKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139857 - protein, 110 aa, Glycine max
  Coding DNA Sequence Number=SeqID_48172
MPLNALAHQLCDDQPGAHLFQHLLKAQALSGDAPVMDAACMPGAFQPQLARGVVGQQPLGQHAVFDDITTFGTHAFAVERCGGEAFQQVRMLFDGQPVRQDLLAQRVEQE

SEQ ID NO: 139858 - protein, 111 aa, Glycine max
  Coding DNA Sequence Number=SeqID_48173
MLGFPGIAFRQIRKRKSGGLAYRSNSYLQEQIDSHRHQEIPRPKPYPYLGSLRLPQGLLLPGKPLARILAATSLLTVNTVSVVRKRKGSAGKSLAAGISRANSGFPISRSS

SEQ ID NO: 139859 - protein, 62 aa, Glycine max
  Coding DNA Sequence Number=SeqID_48174
FVKNIFESRFIADKAIAEIEAKCGQKIEECKEEQRQQLMRIEDEHTLLVSIEKVLNLKLLAA

SEQ ID NO: 139860 - protein, 130 aa, Glycine max
  Coding DNA Sequence Number=SeqID_48175
MGDQEETQEQMKADMSALKEQMASMMEAMLGMRQLMEKNVATAAAVSLAAEADPTLLATAHHPPPNAVGREKSTQGHNNNPHLGYNRVAYPYGLPPNYTPPVMHDDVGHVSSPILERKPPQQPHEAHEDH

SEQ ID NO: 139861 - protein, 130 aa, Glycine max
  Coding DNA Sequence Number=SeqID_48176
  Homolog annotation: Hit_ID=A5BXN6; Match level="QueryCoverage=51%, HitCoverage=5%, E-value=8e-07, Identity=46%"; Hit description =Putative uncharacterized protein
MVKECIFLGHMLSHVSTKVDLAKVEVIANLPLPNCVRVVRSLFGHARFSMRHYLVLSKRHLGMCRNLPFGGKARRKAKGASSKKKTHGSRHQRLFEENVRKTKKRSMNFENKGSGVIYARGRCDEEFKPT

SEQ ID NO: 139862 - protein, 178 aa, Glycine max
  Coding DNA Sequence Number=SeqID_48177
MAPRKLASKRSRKDKAAEGTSSAPEYDSHRFRSAVHQQRFEAIKGWSFLRERRVQLRDDEYTDFQEEIGRRRWASLVTPMAKFDPEIILEFYANAWPTEEGVRDMRSWVRGQWIPFDADAIGQLLGYPLVLEEGQECEYGQRRNRSDGEASANHAHQHDHPDPDMDDVAPQQHPAHRS

SEQ ID NO: 139863 - protein, 88 aa, Glycine max
  Coding DNA Sequence Number=SeqID_48178
LQDVPFVGELMNLNVVSLLKNNPLMKSITWKINPETILMKEDFLDSNMASNTINNKDNGGTTLEINSIEIKVDHPQGHNNKDLVFMIA

SEQ ID NO: 139864 - protein, 200 aa, Glycine max
  Coding DNA Sequence Number=SeqID_48179
  Gene Ontology: Mol. function=transporter activity; Cellular component= integral to membrane; Biological process=transport
  Homolog annotation: Hit_ID=Q4IU98; Match level="QueryCoverage=93%, HitCoverage=45%, E-value=3e-35, Identity=43%"; Hit description =General substrate transporter
MEELAAFNQLQIWLVLLIGVFGFAGMFTVFSYMAPVLVNVTKVSESYMPWLVVAFGIGSIIGMLSGGKIADAMKFKGACLLIVWSIFVLAMIPFISDTLPGIIIAAVAVGTMMALPVTLQTHLMEIAGDAQVLSAAAIQAALNTANALGPWLGGLAIDHGLGYNVFGTIGAATSVLGLLLWVISYKLTQANIQRIRKYKP

SEQ ID NO: 139865 - protein, 132 aa, Glycine max
  Coding DNA Sequence Number=SeqID_48180
MGTISKIVMDNHSWCYPACIQCHRKNDIQTGPFTCGCGKDNDQPVMRYRVEVMDGDLDLNASPQALDKLLGYVLAFKVRIQSKFKNVIVLRYSNELDLINDVLEMLADSETCSKIDASNVDCNNATHPECVT

SEQ ID NO: 139866 - protein, 345 aa, Glycine max
  Coding DNA Sequence Number=SeqID_48181
MAPRKLASKRSRKDKTTKGTSSAPEYDSHRFRSVEHQQRFEAIKGWSFLRERRVQLRDDEYTDFQEEIGRRRWASLVTPMAKFDPDIVLEFYANAWPTEEGVRDMRSWVRGQWIPFDANAMGQLLGYPLVLEEGQECEYGQRRNRSDGFDEEAIAQLLCIPGQDFARTAAGRRVRIMRTNMTTLTQISMTLLLSNILPSDHNSDLPLPKCQLVYAILTRMSIHVAQLIADAIYTFAGMAPTRHPLDPDKSNRALGFPALITGLCQSFGVPVTPSKVIRSPITRAFIKKYCTQRQVQGDAPQAADAPPPHQAGPAGLFDTEQYLRHLVRQRAANHRAHVQTHDCLY

SEQ ID NO: 139867 - protein, 198 aa, Glycine max
  Coding DNA Sequence Number=SeqID_48182
  Homolog annotation: Hit_ID=A5AZ88; Match level="QueryCoverage=75%, HitCoverage=15%, E-value=3e-12, Identity=32%"; Hit description =Putative uncharacterized protein
MTNAAARKEEERVEIEIHQESIRQVTSIHHQLTNEEEKPEVSSTPEYLYLATIGYVGGKDKGRLELSMEDQKISFDLFEAMKHSDMGDACFKEKEVEQEIALLASTMVLQSPMEKEPGCGRDCLACDEELDDSKDSCVDQVVFEELEKLRPIEKPKAKLKTLPTHLKYVFLEEDETKLVIISNSLKKEEEDQLVQILK

SEQ ID NO: 139868 - protein, 127 aa, Glycine max
  Coding DNA Sequence Number=SeqID_48183
  Subcellular localization annotation: CTP_CleavageSite=57; ConfidenceScore=5.60e-01
MVKVGTSYVPINVSFSPKVGPGLPGAPVAIMFLSAVPSCSATDGVVPSQFGTKHTSRTSAGKCSGQPGDRCGLSLLGAKGGVYTGVTMLAVTQEYVNTTHYMASSLTDSYARSRAAAEMAYNGAEFG

SEQ ID NO: 139869 - protein, 223 aa, Glycine max
  Coding DNA Sequence Number=SeqID_48184
MVAKKVAGYVICGGAHDSGCCIPTEDRTHEVNYMGNQPRPTFNVGGYSGFQHGQQYNPQQGQWRTHPGNQFNKDQGGPSNRPQQQGPSLYEKMTKLEETLAQFMQVSMSNQKSIESAIKNLEVQVGQLAKQLVDRSSSSFGANIEKNPKEECKAVMTRSKMVSMNEGEKRIGEEKQQLVTEPEIDLVVEPLSKIGEEVEAEDDQQKEIPIIVSEKEISEKEKK

SEQ ID NO: 139870 - protein, 369 aa, Glycine max
  Coding DNA Sequence Number=SeqID_48185
  Homolog annotation: Hit_ID=Q6WAY6; Match level="QueryCoverage=72%, HitCoverage=47%, E-value=4e-14, Identity=26%"; Hit description =Putative uncharacterized protein
SHLFCQEVRHACPLESHRSCTEKGGANWDQLLASKEGASVNWFPRWKEGRTGVLISCGGFPNVPLMGTRGCISYNPVLAIRQLGYPMRRAPLEDELAPEVLQKKDKELRGSNNGPIDGYRKWLKAHVQGLDWLPSLRTAKREEVEALEEDEEVQALRAELEHAQTVKERFKSTALKIRKENTKLRDVNVATTKALERETKRARREEHGRNKFRGALWGSNSELKLRREERDQSQVDSLILKDELKACSRSKRSLSQRLCETETNMLAIISKYQEELNLATAPEHRVADEYAQVYTEKEARGRVIDSLHQEATMWMDRFALTLNGNQELPRLLAKAKAMVDTYSTPEEIHGLLSYCQHMIDLMAHIIRNH

SEQ ID NO: 139871 - protein, 54 aa, Glycine max
  Coding DNA Sequence Number=SeqID_48186
MAEWLIAPVLKTGSHVSIRGVLMERTGSKSRSIPFYEILRQDLGEGLSRVFDLT

SEQ ID NO: 139872 - protein, 35 aa, Glycine max
  Coding DNA Sequence Number=SeqID_48187
YTYPHHRQKPIHCIMTFDRTVSHRLPSPHGLLTSA

SEQ ID NO: 139873 - protein, 123 aa, Glycine max
  Coding DNA Sequence Number=SeqID_48188
MPISPADVSVGLCRHDIGKDRAHKTPSGPEDVQQGPGVSSSGYGPLLVLQGARSPNEVDEDMTKSKGKDPLEGLGGPMTRARARKAKEALQQVLSILFEYKPKFQGGKSKVVSCIMAQWRRTK

SEQ ID NO: 139874 - protein, 179 aa, Glycine max
  Coding DNA Sequence Number=SeqID_48189
  Homolog annotation: Hit_ID=Q84VI1; Match level="QueryCoverage=100%, HitCoverage=26%, E-value=1e-58, Identity=69%"; Hit description =Envelope-like protein
MATSPKETSASGSPAVRSSPHQEQPEFNIQPIQIIPGQASVPEKLVPRRQQGVKIAENPSLATSPREVDTEMDKKIRGIVSSILKDASVPDAEKDVPTSSTPDVSVPDVNKDVPTSSAPNAEALPSPSEEESTEEEDQASEETPAPRAPEPAPGNLIDLEEVESDEEPIANRLAPGIAK

SEQ ID NO: 139875 - protein, 153 aa, Glycine max
  Coding DNA Sequence Number=SeqID_48190
MTPVNRKAGTGERTREPPGGNAWGAEPMEKRLCRGLSFPTDIEFRPVGVTTVLRCRSDDRALARSLFYNASTGKHPGVTANIVIARRGPHRSPFPTVGRSLEWRMGRAADSGALSAAAIKWWLRAALAPATLASADVRLVACVRWTDHHPVSS

SEQ ID NO: 139876 - protein, 68 aa, Glycine max
  Coding DNA Sequence Number=SeqID_48191
  Subcellular localization annotation: CTP_CleavageSite=56; ConfidenceScore=5.22e-01
MSTARAGGGTRSSGFSRAAGGAPGHHATCGALPAAGPYLRLSRFQGILTRFPFGVRAQSAIRRASPVP

SEQ ID NO: 139877 - protein, 50 aa, Glycine max
  Coding DNA Sequence Number=SeqID_48192
MKMLLIPHDVSSIGASEGRRRRVERRCHFKEKMSQEEAHYYRKPWIRAWR

SEQ ID NO: 139878 - protein, 193 aa, Glycine max
  Coding DNA Sequence Number=SeqID_48193
  Gene Ontology: Mol. function=oxidoreductase activity; Cellular component=cytosol; Biological process=metabolic process
  Homolog annotation: Hit_ID=Q9SXZ7; Match level="QueryCoverage=99%, HitCoverage=40%, E-value=1e-77, Identity=73%"; Hit description=NADPH oxidoreductase homolog
  Pfam annotation: Domain name=ADH_zinc_N; Domain location=5-156; Score= 84.4; E_value=3.6e-22; Accession=PF00107.17; Description=Zinc-binding dehydrogenase
MEIKPGLSALITGGASGIGNTVVATCGGGAKAKLLKELGVDRVIDYHSEDVKTVLREEFPKGIDIIYESVGGDMLNLCLNALAVHGRLIVIGMISQSDRRVYEAGLEIAYQGEKGWTPSKYPGLLEKLLAKSQTVSGFFLVQYGHLWQEHLDGLFNLYSTGKLKVAVDPKKFIGLHSAADAVEYLHSGKSVGK

SEQ ID NO: 139879 - protein, 364 aa, Glycine max
  Coding DNA Sequence Number=SeqID_48194
  Gene Ontology: Mol. function=carboxylesterase activity; Biological process=metabolic process
  Homolog annotation: Hit_ID=Q0ZPW0; Match level="QueryCoverage=86%, HitCoverage=91%, E-value=9e-61, Identity=40%"; Hit description=CXE carboxylesterase
  Pfam annotation: Domain name=Abhydrolase_3; Domain location=148-342; Score=43.2; E_value=3.1e-10; Accession=PF07859.4; Description =alphabeta hydrolase fold
  Subcellular localization annotation: CTP_CleavageSite=69; ConfidenceScore=5.53e-01
MIRSSSSFSGHQPLALKYLNIPTKSNFPFVNLTSYSFLPSLPLKAHNHLPIPSQKLPKPLNSTPPSSTMASTTTDDSEEVTYDLSPVLKVYKSGRIERLAGTAVLPPGLDPETNVESKDIVISEEHGISARLFIPKNTYTYPQKLPLLFYTHGGAFCIETPFSPNYHNLLNKFPRLMLSLSLSTTGGHQSTRFPLAMKTRGVHSNGLLLTWRRRNIASYLGIRVGTKGLLGVKLKGVVLVHPFFWGEEPFGSETNRPDQAKKIHDLWRFACPSESGSDDPIINPIKDPKLGKLACERLLLCVAEKDLVRDRGLYYKELLEKNGWFGVAEVVETKDEDHVFHLFKPNCENALVLIDQIVSFLKQD

SEQ ID NO: 139880 - protein, 242 aa, Glycine max
  Coding DNA Sequence Number=SeqID_48195
MLHNISSIGSREGDILKSPCKASIMRWIGIWCVGISTELWFPVNQSEGAGSGMGKGYCCGDCRLGVDGSDGGVGWVASFGLGKTCWAGCFGPNEEVEWWTTSLISGDGGGDGIKVAPTLTSHEMTLLVPRWMSSMSKVEEPEASMSPSGAPIAAGRIAAVSHYCNHHHLTSGLAPVMLAQPGGSSDALSEFILAEHIIDNSYTSKIFYALSHELLRSADGSLSQRIGLTSGSKSALPPNLPN

SEQ ID NO: 139881 - protein, 118 aa, Glycine max
  Coding DNA Sequence Number=SeqID_48196
MSSKNIAVNLRKNGWRREFIVPWKDNHTVERSLGRLKDGGQYGGLFVRVVDGGGEKLAVVEHKAVANHNAQRRCLLSGEAGEGIKADVGKVGVGLSSNLGLKGSGGEEIGEGSGSSWQ

SEQ ID NO: 139882 - protein, 66 aa, Glycine max
  Coding DNA Sequence Number=SeqID_48197
MKKLRKSGQALSLLNDDRCLQEGIQLWGVGATASTPTPQETHCTGCRLLKNVPEVNVVLVAMLGDL

SEQ ID NO: 139883 - protein, 304 aa, Glycine max
  Coding DNA Sequence Number=SeqID_48198
  Gene Ontology: Mol. function=receptor activity
  Homolog annotation: Hit_ID=A5BH42; Match level="QueryCoverage=98%, HitCoverage=99%, E-value=2e-70, Identity=47%"; Hit description =Putative uncharacterized protein
  Pfam annotation: Domain name=DUF1645; Domain location=79-275; Score =145.1; E_value=2e-40; Accession=PF07816.2; Description=Protein of unknown function (DUF1645)
  Subcellular localization annotation: CTP_CleavageSite=78; ConfidenceScore=5.45e-01
MEVEVMVPPVDFNFDSNCSSPFITAPSSPQFFAASNKPNFFFFSAPTSPTRATSSSFHEEEQDFQFNFSGHLDRPSLSAAELFDGGKIRPLKPPPLLQSPVTSPRSKLSPRNKKKDLDPFALAMKETLRSEEKTRGRERVSVSFSGRKGSRSLSPLRISVVCDSEDKNVSSSTSNINNSKASFLSSIPFTRKWRFKDFLLFRSASEGRATDKDPLRRKYAVLSKNNEDVRDCSFRSTESSSGSISKRHGPVSAHELHYTLNRAASEEMKKKTFLPYKQGLLGCLGFNPGMHHHFSKRVGSLTRS

SEQ ID NO: 139884 - protein, 118 aa, Glycine max
  Coding DNA Sequence Number=SeqID_48199
MDGSITVQPLDFALHKRIVEGPLKPSLWSRSSLALGSFYVQPALLLGHPANSEVIFFGNFPENFFPEIIRKNLLPEEEFVISGSAQELLPGERHPECFQKKLLPKDFHFLPEEGSSGS

SEQ ID NO: 139885 - protein, 63 aa, Glycine max
  Coding DNA Sequence Number=SeqID_48200
MNGHVPGNLLVLHGKNWSKWSVQMRALFGFQDVYEVVQNGIEEPTASTPDAQRQVWKDLKKKD

SEQ ID NO: 139886 - protein, 62 aa, Glycine max
  Coding DNA Sequence Number=SeqID_48201
  Subcellular localization annotation: CTP_CleavageSite=31; ConfidenceScore=5.11e-01
MRRLSLPALSVPSSLSGYSLTHAKRENGAKRAFENRKPFLRLKLEKSRKRLSLTRHPRTRFN

SEQ ID NO: 139887 - protein, 342 aa, Glycine max
  Coding DNA Sequence Number=SeqID_48202
  Gene Ontology: Mol. function=oxidoreductase activity; Cellular component=extracellular region; Biological process=hydrogen peroxide catabolic process
  Homolog annotation: Hit_ID=A5BS04; Match level="QueryCoverage=34%, HitCoverage=12%, E-value=1e-27, Identity=51%"; Hit description =Putative uncharacterized protein
MMCLFPSGAHTIGYARCLTFKRRLFDSQGSGRPDPMIDFSLFLRLQNRRPNNDASNSNLAPLDAATILTFDSVYYRNLLSETGLLESDQALIRDSRTASMAYFYSTDQSSLYNDFAASMVKLSNQNLNNIIEEANVSYLEHKCYPAVYYVKSIIFVGVGGSSWSAPLKFWKIPSESASSMAACLGGACASHGRAQRRVGRRSPSIEHSEDAVALELASEERRSRHLVVTSLPKPELQFPPRHPVRRGLEVPAAMDCFRALPPLWLQWLWWCVLDKGDGEFSGEVGCNLKLTLNLKLFLKRKRLSLGERGEFGFGFDLKFRTNSVIVEERGIRKHYLVEEVDK

SEQ ID NO: 139888 - protein, 102 aa, Glycine max
  Coding DNA Sequence Number=SeqID_48203
  Gene Ontology: Mol. function=nucleic acid binding; Cellular component= ribonucleoprotein complex; Biological process=RNA processing
  Homolog annotation: Hit_ID=A7P9E2; Match level="QueryCoverage=89%, HitCoverage=25%, E-value=3e-26, Identity=60%"; Hit description =Chromosome chr3 scaffold_8, whole genome shotgun sequence
  Pfam annotation: Domain name=PAM2; Domain location=23-40; Score=23.7; E_value=0.00067; Accession=PF07145.6; Description=Ataxin-2 C-terminal region
MAQAQPEERIHENPEKETQETGNSSFKFNAQAPEFVPRSQIQMPVSGYFYPYFQILGGSGESDWFFVGDQDPSCLIPTANAALPNSSKNILTPDLQQKIVKQ

SEQ ID NO: 139889 - protein, 204 aa, Glycine max
  Coding DNA Sequence Number=SeqID_48204
MQIMDRTRGLDWTLGKVIGRTLGREVSGDADESPRRRRPTTSAHRQREVASFVEDVEHVDHVVDEVHKQLEKATAEDVDADAQDFPDRPHDTSILMDYIHHVAVTVWNREERPELKLSSHGRKEEKFGRPVSDIEGLVAATGLSPLIACSLDTSNRGLISAFAESFKALHVDEVVDLLVDLLEFSSEEARDETLQCHEAHVRLS

SEQ ID NO: 139890 - protein, 115 aa, Glycine max
  Coding DNA Sequence Number=SeqID_48205
  Homolog annotation: Hit_ID=UPI0000ECBAF8; Match level="QueryCoverage =35%, HitCoverage=48%, E-value=1e-16, Identity=100%"; Hit description= UPI0000ECBAF8 related cluster
MTFLVPCHVVVYRSKAIAVTCKLKINGTIVIANPINEGGTQQIGKQFLKSDTCNIIYWSRPAGMQAWHWPSFYNVVTGKTLALPNLIALQHIPLSPAGVIAKRPAPIALPNSCAA

SEQ ID NO: 139891 - protein, 61 aa, Glycine max
  Coding DNA Sequence Number=SeqID_48206
MVGETMDMVNWRKKKREMGRKKRGEEKKRNKLLKAMQGSRLRSLNIKSENSSTIVELRPPE

SEQ ID NO: 139892 - protein, 170 aa, Glycine max
  Coding DNA Sequence Number=SeqID_48207
MGNPVMAPPMPMSAHLGLVQARHEVRREHPRLAGPLEWPHEVPPVVTEAPRLRKPHLPPKEKAGLLARPLENGGAKVEGAGVGEGVGAEEAGAGVAEEDRPSDPRARALRVPRNTIVGSSKFQQFFFMYAKLIAGSRDLKVRESETTPRPTQSVEIKAGKPSRKELDWAI

SEQ ID NO: 139893 - protein, 92 aa, Glycine max
  Coding DNA Sequence Number=SeqID_48208
MSHVLGEKMKKKKVAATGVSLSKAYALSEQHSLSEALSSLSELGESGRESAKHAHAQRAISSPSESFVSPGAKRAWLAKSKFTNSRLARKWR

SEQ ID NO: 139894 - protein, 256 aa, Glycine max
  Coding DNA Sequence Number=SeqID_48209
  Gene Ontology: Mol. function=sequence-specific DNA binding; Cellular component=endoplasmic reticulum membrane; Biological process=lipid biosynthetic process
  Homolog annotation: Hit_ID=A7P9K0; Match level="QueryCoverage=92%, HitCoverage=82%, E-value=1e-101, Identity=71%"; Hit description =Chromosome chr3 scaffold_8, whole genome shotgun sequence
  Pfam annotation: Domain name=LAG1; Domain location=40-241; Score =311.3; E_value=1.9e-90; Accession=PF03798.7; Description=Longevity -assurance protein (LAG1)
MLTKGRAPSRITKEMQVKIGKCSESMWKLTYYAAVEAFVLKITYHEPWFTNTKLYFNDWPNHELKSPLVLYYMCQCGFYIYSIAAILTWETRRKDFSVMFTHHVITVLLIGISYLTSFFRVGSIILALHDASDVFMEAAKVFKYSGREFGASVCFGFFAVSWLILRLIFFPFWVIKATSIDLQQVLSLSEGFHMFLYYVFNTMLIMLLIFHIYWWKLICAMILRQLKNRGKVGEDIRSGTTAVRICSTEFIHTILH

SEQ ID NO: 139895 - protein, 2778 aa, Glycine max
  Coding DNA Sequence Number=SeqID_48210
  Gene Ontology: Mol. function=microtubule motor activity; Cellular component=microtubule associated complex; Biological process =microtubule-based movement
  Homolog annotation: Hit_ID=A7P9D5; Match level="QueryCoverage=98%, HitCoverage=99%, E-value=0.0, Identity=52%"; Hit description =Chromosome chr3 scaffold_8, whole genome shotgun sequence
  Pfam annotation: Domain name=Kinesin; Domain location=212-519; Score =446.1; E_value=4.7e-131; Accession=PF00225.14; Description=Kinesin motor domain
  Pfam annotation: Domain name=Kinesin-related; Domain location=400 -923; Score=-318.7; E_value=0.045; Accession=PF06548.2; Description =Kinesin-related
  Pfam annotation: Domain name=Pox_A_type_inc; Domain location=1298 -1320; Score=5.0; E_value=16; Accession=PF04508.3; Description=Viral A-type inclusion protein repeat
  Pfam annotation: Domain name=Pox_A_type_inc; Domain location=1507 -1529; Score=1.4; E_value=53; Accession=PF04508.3; Description=Viral A-type inclusion protein repeat
  Pfam annotation: Domain name=Pox_A_type_inc; Domain location=1796 -1816; Score=0.6; E_value=70; Accession=PF04508.3; Description=Viral A-type inclusion protein repeat
  Pfam annotation: Domain name=Pox_A_type_inc; Domain location=1921 -1943; Score=4.0; E_value=22; Accession=PF04508.3; Description=Viral A-type inclusion protein repeat
  Pfam annotation: Domain name=Pox_A_type_inc; Domain location=2288 -2310; Score=2.2; E_value=41; Accession=PF04508.3; Description=Viral A-type inclusion protein repeat
  Pfam annotation: Domain name=Pox_A_type_inc; Domain location=2441 -2462; Score=4.5; E_value=19; Accession=PF04508.3; Description=Viral A-type inclusion protein repeat
  Pfam annotation: Domain name=Pox_A_type_inc; Domain location=2542 -2564; Score=0.2; E_value=78; Accession=PF04508.3; Description=Viral A-type inclusion protein repeat
  Pfam annotation: Domain name=Pox_A_type_inc; Domain location=2710 -2732; Score=0.3; E_value=77; Accession=PF04508.3; Description=Viral A-type inclusion protein repeat
  Pfam module annotation: Pfam domain module=Kinesin::Kinesin -related::Pox_A_type_inc::Pox_A_type_inc::Pox_A_type_inc::Pox_A_type _inc::Pox_A_type_inc::Pox_A_type_inc::Pox_A_type_inc::Pox_A_type_inc; Domain location=...
  Pfam module annotation: Domain location=212-519::400-923::1298 -1320::1507-1529::1796-1816::1921-1943::2288-2310::2441-2462::2542 -2564::2710-2732
MLRDFKLPRRNASKHEEPENVDPYDSSTTIQRHAEGSRHPLNTIQEPDAHCESKIDKTPSKRGRGGAELRTPDKHGGGSMLVKHRFGWNHKHEGVSSFGDDRRASGVGNVTPRVPRTVGRASSSVAACSESNSTQSTPNKSVTKPPPSSSVRSKADGGGFSARLGNYAALYKGVPSSACSMPTVVNTVEVPHFDLKEDSSFWINHNVQVIIRVRPLNSMERCTQGYNRCLKQEGSQSITWIGQPENRFTFDHVACETIDQEMIFRLAGLPMVENCLSGYNSCMFAYGQTGSGKTYTMLGDIEDLDVMPSPHRGMTPRIFEFLFARIQAEEESRRDENLKYNCKCSFLEIYNEQITDLLDPSSTNLLLREDVKKGVYVENLSEFEVQSVSDIIRLLIQGSANRKVAATNMNRESSRSHSVFTCVIESTWEKDSTTNYRFARLNLVDLAGSESHVIMILVDVANGKQRHVPYRDSRLTFLLQDSLGGNSKTMIIANVSPSICCAAETLNTLKFAQRAKLIQNNAVVNEDSTGDVIALQHQIRLLKVEELSTLKRRQNVSRSLSFSLSSIRDIKQSLELEDCCLENATDVVDQHEENMPDYESKGIRMSHKQLLWEVSLSAMLKSLETTLAGALRREQIAEISIKQLEAEIEQLNCLVRQREEDTRSCKMMLRFRDDKIHRLESRLAGSIPMDTFLQEENKALSDEIRILQSKLDRNPEVTRFAVENIRLLDQLRRYQEFYEEGEREILLTEVSSLREQLLQYHGRNSIQANSNCDIQPQEAQCCNKENNPTDLELINTLDELEECRRNLNYCLEENAKLNREIDSLHSMLSSTNATKVSTKGPFCEAQAVSQMGVKLETHMLQHTDDILNLQLELDIIKVILKEERSFRGILEEQKTYLNQDFLMAKDKIEQTSKQLEDAKSIIEALESQQILSIKEIEEMRNKNSHYMELMGKQEHEIMTLKNQLASKEFRDNLLSNYTEFENKSPLQAKFRRMHESLEKAKQLNMSYQSDRAFQISTEEERDEIRRQAEAETVEVIVCMQEELALLQHQVNDSRLKETEMKESMLHLETELKELQKKLLTTIDDNQSLREELGQKDVELISLAEEWELLTSEIEEVLLDGCEAIVDASEELGNIRNSFPQKRIWISEQVGMIVRKISEKELLIDELRRCLEDASNKGSDMECMLKSLRSAALVITKSHQRECAEKEKEILLLTSQLSEKTSSEAQLKEHLIMAEDHIRKASNCATVAFVVVNRLSEVNLGYLDDLKHKDILLSELAETGNRKDILLSDQSTSFVQAERQITELQERCNELWQKLSEEQEHSCALEQKLEDIEKNSISKTREQLVTLQDGVSSIRSCMASFADHSGSLDNRNSLDACTSDYDDIGEPRQTSSETHQNSDSDPLSVEEPIVDLADLHLVKSGYDTKDLKSKNVGKDVRERDATIRLLRKEIECALESLKEVQYEMARLHEEKKEMSMSEKKNQQSIECLTNQILFLQEAMNDFEEQSKVKIDVLCHRVRDLEKLLKEASSHWYKRKESLELEVGEAKIIQAQKAQEASCILAKFEEAQDMMREADIMINGLVIANESMKIDIERLKDRETTLLNEKVTLVSNIESLQTVVDLKHKEIEDLVESSLVETRDLIVTLDDVIKDIQLMMTENFKSLACDLECLKSQCLYSTKLIQPWLEKIWSEIVFKDCAMSVLHLCHMGILLETVTGMHAENGLLSHGLCESNSVISDLKEHNYRTKQELDMCRILKGKLLADIKNSFDCINKKEVEAGEITIKLNTFSKNISDLQLQEEIMLLRSNEMGSQLAKLMRELDVSNTDIVTSLLDQEKLVKQKVEAIESEAEFFMADWYAKDFESLIHASELKNMSCNIANMEEHYVNYSLLIEQLKKETIFSQVENELAEQILIDKEVEVSLLEREVQQAKVERKDLVTELNRNVLRITEMGEVNKVLEQNIEFLKDVTCSNNALKGELIEANKEKKRLLDRILDLEADCDKLLGDVIEKDVTSEFSFQQVYFLEHQKTELKKVNYMLENSSCGLKNELNLKDSELTRMQSFLEVELSRKDDVIKGLLYDLSLLQESASNNKDQKDENEKIVATMEALETELAVKSGELADVVANCQSLEAQLQDKTVIVTALELDLSKEREALKLQVSENKKLATHIEGALAARQLADNEITERMKLTESLENAMLEMNSVISQMNSDLDELTNERDQLQGQVICLKNRLEKAEAQAEANEAIAQEAQKVAESRQIYAEDREEEVKLLARSVEELESTVNVLENQVDILKGEAERQRLQREDLELELHALKDQMQNVRNVDGDMRRFLDEKEKSLNEALNHIQVLKRELAGKDAEIQQMKAHISELNLHSEAQAMEYKQKFKALEAMAEQVKPEGLSSHSTSANSHNALSNKSEKNATKSRGSSSPFKCIGLGLSQQVKYEKVEELSAARLHIEELEAQAACRQREIFALNAKLASAESMTHDVIRDLLGVKLDMTSYASLIDDEKAEEITEKVKFLTLEPQDKEVIKLKKQLNEFIEERQGWLQEMDRKQAELVAVQIELENLRQRDQLLKTENEMLKMENASKKNKVVELEEEIKKLSGQQNLQQRIHHHAKIKEENNKLKIQNEELSAKLRKSEIFQSRVKEDLARLRASAGVKTSINFDEEQRLMIKLKEIEEEKVQLAQQLLRLSTNVLKVAGIVRPISDVNPSMAEEALQDLKNRITTLEMEQEDLKFKNKIIKEKIRLSELMPQASSPLNPRSEENRMTPPRASLAPFLSSFDR

SEQ ID NO: 139896 - protein, 90 aa, Glycine max
  Coding DNA Sequence Number=SeqID_48211
  Subcellular localization annotation: CTP_CleavageSite=53; ConfidenceScore=5.34e-01
MKNEFARMDDKVHCLSQSNQTFTCRCDFKLLTAMPSSPSPHQTNSLSPTATTPASYSTTMAPPCLSPPITRLTRRIAPSPIQGKRKNWIF

SEQ ID NO: 139897 - protein, 38 aa, Glycine max
  Coding DNA Sequence Number=SeqID_48212
MKNLINFGMEGALVMSDIYWDRVMTKSMEAPNDEDRGL

SEQ ID NO: 139898 - protein, 232 aa, Glycine max
  Coding DNA Sequence Number=SeqID_48213
  Homolog annotation: Hit_ID=A9PAX6; Match level="QueryCoverage=82%, HitCoverage=95%, E-value=4e-59, Identity=61%"; Hit description =Putative uncharacterized protein
  Subcellular localization annotation: CTP_CleavageSite=34; ConfidenceScore=5.28e-01
MKATLLCPCSSAPLILDTHSNRTSATRHASTVVCCSSRNQPYIPKLEPFSRTKFERAVKDPPLIEKSEREILDYCSTLEGDQSYSCWQAYFELKDLEKESPKADIERLILETGGVKSLIGCLHGISIMHKLKKGDMNLSKDVKSEEGERLCPIPDGLPKSADELREEEQARMPDSPYTKLLRTMGRHPACFLKKYNSSIYASMYHLSLMIGMRALGRGNEKRNGTEFIMETR

SEQ ID NO: 139899 - protein, 281 aa, Glycine max
  Coding DNA Sequence Number=SeqID_48214
  Gene Ontology: Mol. function=phosphoinositide binding; Cellular component=intracellular; Biological process=intracellular signaling cascade
  Homolog annotation: Hit_ID=A5AN73; Match level="QueryCoverage=76%, HitCoverage=24%, E-value=3e-72, Identity=59%"; Hit description =Putative uncharacterized protein
  Pfam annotation: Domain name=PXA; Domain location=63-236; Score= -12.2; E_value=0.00077; Accession=PF02194.6; Description=PXA domain
MESVNDLIQEAKLRTLWVEFRWKVPQPRLQTYLSHLEKKQLSLNDPRLTSLPPPAKWKRKIDSPAVEAAMSDFIDKILKDFVVDLWYSEITPDKEFPEQIRAIIMDVLAEISGRVKEINLVDLLTRDLVDLIGVHIELFRRNQATIGVDVMKTLSSEERDDRLKFHLLNSKELHPALISPESECKVLQRLMSAVLATVLRQREAQCPVKESLKRRNNAKVVGPYGIPTEVYNKSSLTSMRVYGKDLGKKGVCMTYIHAILDMYNGITTSMKTSRDKTKDFL

SEQ ID NO: 139900 - protein, 148 aa, Glycine max
  Coding DNA Sequence Number=SeqID_48215
MSHSNHNQVSDEIPLLQALLWTGATETVAGEDKDTSAVVTSTLDDASEETEDTVAGGVLGNSEFPCGKGEELDVDKVGVVASGELTDATAVCEAVADRHGTRAGQGVPEPYPVPRSRPRSRGGGIFCPVSIPRLPVGTPFYIKKCKKL

SEQ ID NO: 139901 - protein, 287 aa, Glycine max
  Coding DNA Sequence Number=SeqID_48216
  Gene Ontology: Mol. function=phosphoinositide binding; Biological process=intracellular signaling cascade
  Homolog annotation: Hit_ID=Q9XIM1; Match level="QueryCoverage=100%, HitCoverage=29%, E-value=2e-64, Identity=47%"; Hit description =Putative uncharacterized protein At2g15900
  Pfam annotation: Domain name=Nexin_C; Domain location=176-284; Score=- 0.0; E_value=0.005; Accession=PF08628.3; Description=Sorting nexin C terminal
MDDIVRQFKGVSDGLRRKVVGSSSLINEGSATSNTTWNLSWNADEIDKSIPRQSTAESVFSSDNEEGEKNNFDRENIDRAVAQDSGLHSDNALISKGNSSRINNCDEESSNLEFDRKHDMVVEARVGNDIPATNFILVHGNLEDPVGVPPEWAPPNVSVPILDLVDNIFQLNKRGWIRRQVYWISKQILQLVMEDAIDDWLLRQIHWLRREETVSQGIRWVQDVLWPGGTFFLRVGTPQIISDSDKKPSPTMSRSGGSNITKSESGSFEQELEAARRASDIKKLLFG

SEQ ID NO: 139902 - protein, 433 aa, Glycine max
  Coding DNA Sequence Number=SeqID_48217
  Gene Ontology: Mol. function=translation initiation factor activity; Cellular component=cytoplasm; Biological process=proteolysis
  Homolog annotation: Hit_ID=A5C6I1; Match level="QueryCoverage=91%, HitCoverage=78%, E-value=1e-150, Identity=62%"; Hit description =Putative uncharacterized protein
  Pfam annotation: Domain name=eIF2A; Domain location=187-329; Score =130.7; E_value=4.3e-36; Accession=PF08662.2; Description=Eukaryotic translation initiation factor
MASNSHSPSLEILGPEDFSLWTGPPFANDQPSVKLEKVNCINAKFSDDGSNLMVTKSNSLISVYDCSTAKEIRVFEVPNVVAAALSPKGTYLQTFQKPSGPQEKNVTLWSIETGAAVYQQSQKNMTKANWPAIQFSSDEATGVAAAELSSLPGSHVAAFVPESKGIPASVQIFACGNASQSQPVARRSFFRCSTTQLKWNHGSTGLLVVVQSDVDKTNQSYYGESKLCYLTTDGMHEGLVPLRMFLLLLKELIIGYIMSIRRVFWDYIDKKQLGATKAEWSVTSEWSPDGCYFMTATTAPRLQVDNGIKIFHYNGSLYFKKMFDKLYQADWKPESPSKFGDIAELIKSLNLVQLEDKKPSGPPKSTQTSTKASSTNPPTQKPAAYRPPHAKNASAIQAEFFVMESMFFLMHSKLLFDYCTRAPENLRLQVLLY

SEQ ID NO: 139903 - protein, 83 aa, Glycine max
  Coding DNA Sequence Number=SeqID_48218
  Homolog annotation: Hit_ID=A5B5G3; Match level="QueryCoverage=71%, HitCoverage=4%, E-value=4e-09, Identity=49%"; Hit description =Putative uncharacterized protein
  Pfam annotation: Domain name=DUF1723; Domain location=47-83; Score =21.8; E_value=0.0014; Accession=PF08330.1; Description=Protein of unknown function (DUF1723)
MASTTAPFLWKQHLHRFGEAMPSPDPRIEPLLVKVRFSDVAKLQQVKIDNALVVALVERWRHDSYKFYLPDGECTITLEDVTI

SEQ ID NO: 139904 - protein, 203 aa, Glycine max
  Coding DNA Sequence Number=SeqID_48219
  Gene Ontology: Mol. function=transcription regulator activity; Cellular component=nucleus; Biological process=regulation of transcription
  Homolog annotation: Hit_ID=A5BSP9; Match level="QueryCoverage=78%, HitCoverage=100%, E-value=7e-48, Identity=64%"; Hit description =Putative uncharacterized protein
  Pfam annotation: Domain name=HLH; Domain location=88-132; Score=1.9; E_value=0.098; Accession=PF00010.17; Description=Helix-loop-helix DNA-binding domain
MEPVGPTHIDSNLHSILPQFVAFDFSKREEGIDVRKMMEHKRSPCSVDQSSYTSIASKRQKADLSISTKYPLMYFIDIQALLFEIFLEKHDKERKEKIGKRIVALQQLVSPYGKTDTSSVLKEAMEYIGFLHKQVKLLSAPYLESSPAAKMQGMEPCSLRSRGLCLVPVSFTIGVAETNGADIWAPIKTTTSPKFEKDVSQFH

SEQ ID NO: 139905 - protein, 66 aa, Glycine max
  Coding DNA Sequence Number=SeqID_48220
  Homolog annotation: Hit_ID=A5BD56; Match level="QueryCoverage=95%, HitCoverage=5%, E-value=3e-18, Identity=70%"; Hit description =Putative uncharacterized protein
MALEEGKVKIEKFDGRDFSFWKMQIEDYLYQKKLYQPLSGVKPEDMKQEEWNLLDRQALGVIRGIL

SEQ ID NO: 139906 - protein, 152 aa, Glycine max
  Coding DNA Sequence Number=SeqID_48221
  Gene Ontology: Mol. function=aspartic-type endopeptidase activity; Cellular component=small subunit processome; Biological process=DNA integration
  Homolog annotation: Hit_ID=A5C4L9; Match level="QueryCoverage=92%, HitCoverage=11%, E-value=1e-17, Identity=33%"; Hit description =Putative uncharacterized protein
  Pfam annotation: Domain name=zf-CCHC; Domain location=126-143; Score =12.0; E_value=0.023; Accession=PF00098.14; Description=Zinc knuckle
MKVTALKQTNHDMIAHVGKARAAVEELRKFLVAVSLEEVNKKLDKFYMVLILRSLHSDFDHVHDQVLAGDQVPSMDSLITRLLRVPHVLKDENPSDVVETSAMVAPRGRGGGRNNKGGCSGRGERPHCTYCKRMGHTQENCYSLHGFPDKVA

SEQ ID NO: 139907 - protein, 147 aa, Glycine max
  Coding DNA Sequence Number=SeqID_48222
MDFQPPLEQQACGRPLLASRMHVWTLELTQALLGDPEPLRLPPLAAIHFPSCDFHMTILRSYNNPSRCTLYLYHKGCILQCVKTKNSQAEGETKDISGKGKNQKNSQVVSLLNSLGKGEGRHKIIQAVSPSILLEKGEERHKKNSGD

SEQ ID NO: 139908 - protein, 381 aa, Glycine max
  Coding DNA Sequence Number=SeqID_48223
  Gene Ontology: Mol. function=nucleotide binding; Cellular component =cytoplasm; Biological process=response to stress
  Homolog annotation: Hit_ID=P27322; Match level="QueryCoverage=30%, HitCoverage=18%, E-value=6e-40, Identity=68%"; Hit description=Heat shock cognate 70 kDa protein 2
  Pfam annotation: Domain name=Dynamin_N; Domain location=184-359; Score=47.0; E_value=6.8e-11; Accession=PF00350.14; Description =Dynamin family
MTDPHLCRWQPIRPAIHHHPHLHLFYPPQVPSLPFHHPSPFSLLEPLPSTMPAHNSHETTMDCLEEALSHLTQNISTMTAKSLEMAAKLDVILDWLSALQPTPSSPKSLAPPDAPMPNLPPMVGINSGTTYSCVKVWQHHHVEIIATDQRNRSSASYFAFTERLIGDAAKYYVTINPINTIFNAKRLCGRRFSAASIRSDRQLWLYKVFPGPPDKPMIVVNYKGEDKKFAAEEMSSMTISIDEAHISQAISAATAATEELACHGKGISNNPLTLLEKKNGVPDLYPVDLPCIIQVPVHGQPKNIYDQIKDMIMEYIKPEASILLTVLSASVDFTTCESIGMSQSVEKTELRTLAVVTKTDKSPESLLKRHSGWFNCCQWPI

SEQ ID NO: 139909 - protein, 156 aa, Glycine max
  Coding DNA Sequence Number=SeqID_48224
MADDIRGHGHGSHVRKMASKNHKHVYYSRGIIKEEKWSWDVDEMSYIDMKKHLIDVPMLDDRLPTKRCKAFTEIEEVEVVVIFYRINEEEHINVGGVLGDGEVHDDGKMLGDGEVLGDVEVHVNGEVPSDVKVHANGEVVDNGDSEDLDYEGEKAA

SEQ ID NO: 139910 - protein, 565 aa, Glycine max
  Coding DNA Sequence Number=SeqID_48225
  Gene Ontology: Mol. function=calmodulin binding; Cellular component =nucleus; Biological process=glucosinolate biosynthetic process
  Homolog annotation: Hit_ID=A7QAS6; Match level="QueryCoverage=75%, HitCoverage=72%, E-value=1e-121, Identity=57%"; Hit description =Chromosome chr5 scaffold_72, whole genome shotgun sequence
  Pfam annotation: Domain name=IQ; Domain location=152-172; Score=32.1; E_value=2.1e-06; Accession=PF00612.18; Description=IQ calmodulin -binding motif
MGKKGSWFSAIKRVFTHHSKGKDSDNNKGTKEKKKSLGKLKHGEANSFIPLFREPSSIEKIFGDFEREQQLLGLRPATPPERPKTPPYAPPRAPSPRPPSPRVPSPRPPSPRAASPRAASPRVTSPKATSSRIAHHHKEVGHRPEPTLRQQQASATKIQSVYRGYMARRSFRALKGLVRLQGVVKGQNVKRQTVNAMKHMQLLVRVQCQIQSRRIQMLENQARYQADFKNDKDAASILGKLTECTITNHIFSAIDGHAFLVASILLDVKLVTYYDFSHGNEEWDDSLLTKEEVEARLQRKVEAIIKRERAMAFAYSHQLWKATPKSTHTPVTDTRSGGFPWWWNWLERQTPAATPQERQSLKNFQITPPRPYSEQKTSPRPGSSTQRQPQQQQPHFAFDNMDTPTPKSTKSTIVTSSKPARTPPFRTPQANGSGSGSRYPRPRGVGSNSPFDVPLKDDDSLTSCPPFSVPNYMAPTLSARAKVRASSNPRERLGGTPTSTDSKRRLSFPLSQGIGSFKWSKGFSNKDQRVPDKFQSLESIGNVSVDSTVSLPARVVGRKPFTRFV

SEQ ID NO: 139911 - protein, 21 aa, Glycine max
  Coding DNA Sequence Number=SeqID_48226
MRKRGDLRLGIWGREKLKHED

SEQ ID NO: 139912 - protein, 93 aa, Glycine max
  Coding DNA Sequence Number=SeqID_48227
LKEIWELWGGFKMIDVGSGFYIVKFDLSHDPEKYIASSSDGGGYSDESGYEDGGCNTREVCDLNMPSKSAPRNPSTKSSNQGKGAIHVETNQY

SEQ ID NO: 139913 - protein, 43 aa, Glycine max
  Coding DNA Sequence Number=SeqID_48228
MVNNIPIGFATIAVGQNIGNFLGTFLDYDDKHNSSPWMSYMRI

SEQ ID NO: 139914 - protein, 106 aa, Glycine max
  Coding DNA Sequence Number=SeqID_48229
MYVGVDVGVQPKVDIGLEVSDHEEVCDETRVDDGVKAGVGASVEERVGVSLNTFVNGSDESFQGTCLKVFDTEMDLDTEDTFEEVVDDLRNVVNSRIPFDILDVII

SEQ ID NO: 139915 - protein, 510 aa, Glycine max
  Coding DNA Sequence Number=SeqID_48230
  Gene Ontology: Mol. function=receptor activity; Cellular component =plasma membrane; Biological process=protein amino acid phosphorylation
  Homolog annotation: Hit_ID=Q9LJK6; Match level="QueryCoverage=85%, HitCoverage=87%, E-value=1e-162, Identity=60%"; Hit description =Similarity to receptor protein kinase
  Pfam annotation: Domain name=LRRNT_2; Domain location=341-380; Score =17.8; E_value=0.012; Accession=PF08263.3; Description=Leucine rich repeat N-terminal domain
  Pfam annotation: Domain name=LRR_1; Domain location=386-408; Score =9.4; E_value=5.6; Accession=PF00560.24; Description=Leucine Rich Repeat
  Pfam annotation: Domain name=LRR_1; Domain location=410-431; Score =13.9; E_value=0.62; Accession=PF00560.24; Description=Leucine Rich Repeat
  Pfam annotation: Domain name=LRR_1; Domain location=433-455; Score =12.1; E_value=1.8; Accession=PF00560.24; Description=Leucine Rich Repeat
  Pfam module annotation: Pfam domain module=LRRNT_2::LRR_1::LRR_1::LRR_ 1; Domain location=341-380::386-408::410-431::433-455
MENLRMHAAYFLDCGGTKEVTVDNLTYIPDESYIKVGKTTTINKPDLLPILSTLRYFPDTSAKKYCYSLPVIKGSKYLVKTMYYYGGFDGRNKQPPVFDQIIEGTRWSVVNTTEDYAKGLSSYFDIVVVPSGKTLSVCLARNAHTGGASPFISALEVKRLDASFYNPTDFNKYALLTVARHAFGAEDIISFPDDKLNRMWQPYKDQNLVVESHSNVTSSDFWNQPPVKAFSSAMTTSRGKTLEIQWPPMSLPSTYYYISLYFQDNRNPSPYSWRIFDVSINGHTFFSSLNATTKGVTVYAAKWPLSGQTKITLTPGSGIPVGPVINAGEIYQVLPLGGRTHTRDVIAMEDLARSIQNPPADWHGDPCLPKGNSWTGVTCSNGFHARVTTLNLTNAGVSGSLPPTLGRLSALEHLWLGENKLSGTIPDLSGLKELETLHLEKNNFEGPLPPSTKKLPKLRIIESDFENKSPNTNLKQSEVKVEQRFIRENEHKPLQIRQVLYVTEEALIQS

SEQ ID NO: 139916 - protein, 160 aa, Glycine max
  Coding DNA Sequence Number=SeqID_48231
  Homolog annotation: Hit_ID=A7PBC6; Match level="QueryCoverage=74%, HitCoverage=31%, E-value=3e-20, Identity=46%"; Hit description =Chromosome chr16 scaffold_10, whole genome shotgun sequence
MIDLIQRKLLQPRYAHCYINMKAARVSVPSPGLKSYFNFNGLEKDKLLEHEEYMATLGFVHTKLQDQDLDASNFVQLRKALMQYFRPSSFVREHTKNKPEEHVSSSLVHGSQMDSNMIKFYDKNPRAQHESYVSALWKLRDQVLSLHKQMPHKHYCAGFV

SEQ ID NO: 139917 - protein, 101 aa, Glycine max
  Coding DNA Sequence Number=SeqID_48232
MPHGLFPYKSHALMPLRHFTEHLVGARLGVNSKRTGTMWHSTKRRSKYTNEKLESLGMEHLLVGDEQKRKTESKNAKNDDTGAANSSISWVGLLKGGKRSF

SEQ ID NO: 139918 - protein, 177 aa, Glycine max
  Coding DNA Sequence Number=SeqID_48233
  Homolog annotation: Hit_ID=Q2HW90; Match level="QueryCoverage=63%, HitCoverage=31%, E-value=3e-14, Identity=34%"; Hit description =Putative uncharacterized protein
MASQEEWVLFADILALLIFGVVLFPNMDGLVDLTAIDAFLAYHHSKESPVVAILADLFDTFDRRQHNQLVSSMEGRKEGVLFSCGDYPNVSLIGMRGCINYNPALAIRQLGYPMRGAPTEESLSPFLVRDFELRGIRNGIIGGYHEWLRVHTRGLDWLSKLKIINEENFEAPEEDEE

SEQ ID NO: 139919 - protein, 141 aa, Glycine max
  Coding DNA Sequence Number=SeqID_48234
  Pfam annotation: Domain name=G-patch; Domain location=1-42; Score =27.6; E_value=4.7e-05; Accession=PF01585.14; Description=G-patch domain
MVARVMLKHGYEPGMGLGKDGLGNADVVDIRGNPYKYGLGYELGMPGRRNAPSRLKADRAWPGHVSQCFTSARIMFEEEVAAIGEEFPQDPPNFVRPCHPDSQVGNWRVISQSEDPNNEELERLITQEEREMKPHQEETEL

SEQ ID NO: 139920 - protein, 104 aa, Glycine max
  Coding DNA Sequence Number=SeqID_48235
MGHLSDQGVPMNPKRIKVIPEWLIPPTPLIELVRNHVPSWEDAQEMGFQTLPYFNIPNTPNTYVFVLFTSVEEKSPKFQEPRDLRSNPFQRGGNDAILPYKGIG

SEQ ID NO: 139921 - protein, 199 aa, Glycine max
  Coding DNA Sequence Number=SeqID_48236
MVTFQEAHTNVRTNPLAINHCFSGAINAVESDRPRSVNLYTRMWQPLSVSLRPYKREIPVCCIPVSCMTWKRVLRVEANCVVRPKPLVIYIHQGSSFEKPGPSSLFAGERIEVGLKRGKFNYVSSTSANAKRIGTTGAKRKEGDAHAVSSTPAWVKPPQPPHGTHQYAQHHPSFSAHTGNASSSAPVQAKAPTQREAPQ

SEQ ID NO: 139922 - protein, 162 aa, Glycine max
  Coding DNA Sequence Number=SeqID_48237
  Gene Ontology: Mol. function=RNA-directed DNA polymerase activity; Biological process=RNA-dependent DNA replication
  Homolog annotation: Hit_ID=A5ACJ6; Match level="QueryCoverage=53%, HitCoverage=6%, E-value=3e-09, Identity=34%"; Hit description =Putative uncharacterized protein
MIMRGQDIYSSQDEATTSPSSNENEEAIGEESREEIYPQEERQPLMVKEECKEVSVSSKSGQGVPADPMRIKVIPDWPTPPSIREIWGCHDLTNFYKRFVPYFSILVAPLIELVRNNVPSWEDVHERGVKGRSPKYQEPQDLRSNPFQGGGDDAIQPRKGIG

SEQ ID NO: 139923 - protein, 87 aa, Glycine max
  Coding DNA Sequence Number=SeqID_48238
MVRTRGLGQRVAVTADHVDEPVIPAPDVQDDPIEAPAAVEDIPTDIPVDTGAKPAEDAHEGFSGGPSDPSMLTLYADHVACSVWTGE

SEQ ID NO: 139924 - protein, 156 aa, Glycine max
  Coding DNA Sequence Number=SeqID_48239
  Gene Ontology: Mol. function=transporter activity; Cellular component= membrane; Biological process=transport
  Homolog annotation: Hit_ID=P30296; Match level="QueryCoverage=35%, HitCoverage=12%, E-value=3e-21, Identity=90%"; Hit description=High -affinity branched-chain amino acid transport system permease protein livM
MALLSAAMFFVLAGVFMGVQLELNGTKLVVDTAADIRWQWVFIGTAVVFLFQLLQAVPRGAAGGRGGVAVRGLPRHGGYRHPDHDLRDTRSGSERGGGAFRPAGAGLRRLLRHRCLHVCAAEPLLRPRLLDLSAAGGAGLCRRRFPAWLPGAAPAW

SEQ ID NO: 139925 - protein, 240 aa, Glycine max
  Coding DNA Sequence Number=SeqID_48240
  Gene Ontology: Mol. function=ion channel activity; Cellular component= integral to membrane; Biological process=dicarboxylic acid transport
  Homolog annotation: Hit_ID=A6TGG5; Match level="QueryCoverage=100%, HitCoverage=100%, E-value=1e-109, Identity=83%"; Hit description =Putative transport protein
  Pfam annotation: Domain name=DUF554; Domain location=2-238; Score =234.6; E_value=2.2e-67; Accession=PF04474.3; Description=Protein of unknown function (DUF554)
  Pfam annotation: Domain name=TraQ; Domain location=28-104; Score= -18.2; E_value=0.1; Accession=PF09679.1; Description=Type-F conjugative transfer system pi
  Pfam module annotation: Pfam domain module=DUF554::TraQ; Domain location=2-238::28-104
MPVGIFVCSGSLLVGAIAGASLNRFIPDHFKKTLPLISGLISISMGVFFLNKLINLPPIALAVIIGTIIGGLLNIEKWIERAGTQLRTPIERIFPGQNNAGVEAEDFMNQFIAVLILFCASGTGIFGALTEGMTGDPTILLTKSILDFFTAAIFASTLGYIITAIFIPQLIIFVILFFAATFIMTLISPSMIADFTACGGIIMLATGFRLCGIRHFPTANMLPSLLLVMPFSTAWQQFVA

SEQ ID NO: 139926 - protein, 98 aa, Glycine max
  Coding DNA Sequence Number=SeqID_48241
  Subcellular localization annotation: CTP_CleavageSite=39; ConfidenceScore=5.34e-01
MSSPSRGPSPGTSYLALRDTRPHHQRAARPHLQRTTCPRLERATRPHLGVLVTLTVERTTRPRLERTTRPHHQRAARPHLQRTTCPRLERATRPHLGY

SEQ ID NO: 139927 - protein, 153 aa, Glycine max
  Coding DNA Sequence Number=SeqID_48242
LFILQIAKKNVYTDNHSGISARQRDSKVSMIDPVSAEDDIPKKNVYTDNHSGISARQRDSKVSMTDLVSAEDDANLRVLSVLQIAKKNVYTDNHSGISARQRDSKVSMTDLVSAEDDVNLRVSTGLSAAIDEGRRDDRDSKVSMTDPMSAEDD

SEQ ID NO: 139928 - protein, 62 aa, Glycine max
  Coding DNA Sequence Number=SeqID_48243
ESIDEEDPRPTSSNGACINNGQMQERYVHYDAMKRCLCDECMLEIKCGSDLIRTDLWSKNVR

SEQ ID NO: 139929 - protein, 151 aa, Glycine max
  Coding DNA Sequence Number=SeqID_48244
MAPRKLASKRSRKDKAAEGTSSAPEYDSHRFRSAEHQQHFEAIKGWSFLRERRVQLRDDEYTDFQEEIGRRRWASLVTPMAKFDLDIVLEFYANAWPTGLEGVRDRVLGWGSVDPVLDADACQLRDPHPLVQGIRPPGAFIAKYWPEEEPG

SEQ ID NO: 139930 - protein, 151 aa, Glycine max
  Coding DNA Sequence Number=SeqID_48245
  Homolog annotation: Hit_ID=UPI00006A2939; Match level="QueryCoverage =80%, HitCoverage=75%, E-value=3e-08, Identity=31%"; Hit description =UPI00006A2939 related cluster
MIGTSKPYTGAMRGTVHEPQVNIGADQKGLHVLANRGLHALTLRGLCVLTFRGLHVLTFRGLHALAIRGLRVLTFRGLHALTIRGLHVLTFRGLHALAIRGLHVLTFVGLHALTFRGLQVLANRGLHALTLRGLHVLANVGLHALTFRGLH

SEQ ID NO: 139931 - protein, 183 aa, Glycine max
  Coding DNA Sequence Number=SeqID_48246
  Gene Ontology: Mol. function=chitin binding; Cellular component =extracellular region; Biological process=chitin metabolic process
  Homolog annotation: Hit_ID=UPI00006A17C9; Match level="QueryCoverage =65%, HitCoverage=100%, E-value=4e-10, Identity=32%"; Hit description= UPI00006A17C9 related cluster
  Subcellular localization annotation: CTP_CleavageSite=59; ConfidenceScore=5.68e-01
MARACSPLKVRTCSPLMARACSPLKVRTCGPLKVRACSPTKVRTCSPLKVRTCGPLKVRACSPTKVRTCSPLMARACSPLKVHDPLKARTCSPLKVRVLVPKGFTRNSPQISASPHQLDLAPYASEPYNAQWNAPGLLRDKHTLRSSRILGEMEVDEPWLGLWLPLNYQVDMGASQHRTLELG

SEQ ID NO: 139932 - protein, 188 aa, Glycine max
  Coding DNA Sequence Number=SeqID_48247
MVEASGNRLPACVIDYTEEWVTGCVIDYQRWKALKYPFYLHVVIVMAAQLTRDRVEMECLEGAWETLEGNMRCRFRGTIRFTATSLVHPDEPARTLQRTVEWILPTPTPYRLVEPVQVIEVTSSEEDPEEDLEELLPEPAVDALDFLEGDEDPLLEVDSPEEVMSASEADSTEDSGPREMAISGGSSS

SEQ ID NO: 139933 - protein, 106 aa, Glycine max
  Coding DNA Sequence Number=SeqID_48248
MPLWWEFNPWVREDRVLHCRPMDNFLQHSSIVASKVSNKRRKIWWTIAARSIWKLRNDIIFHNQPFHISKLVDYKNFLTWSWLRGREKDFNVPFHQWSSAMSMAFN

SEQ ID NO: 139934 - protein, 47 aa, Glycine max
  Coding DNA Sequence Number=SeqID_48249
PLIEVVRNHVPSWEEPKKCPEYEEPWDLRSNPFQGGGNDAILPRKGI

SEQ ID NO: 139935 - protein, 67 aa, Glycine max
  Coding DNA Sequence Number=SeqID_48250
MNDEERLKIFAKSPTETLRKCLGLDFLHGNNFPHKIGEELATQLAQASQVASSRSNRLLEEESGKAQ

SEQ ID NO: 139936 - protein, 434 aa, Glycine max
  Coding DNA Sequence Number=SeqID_48251
  Homolog annotation: Hit_ID=Q2HW90; Match level="QueryCoverage=82%, HitCoverage=70%, E-value=1e-42, Identity=32%"; Hit description =Putative uncharacterized protein
MGTNQNGKRFYQVKVKSLDVTSLKELGRLMGPLQRQAFRKVYGKILDLTAAEVFTEAVVSLAQYYDQPLRCFTFGDIQMVPTIEEFEEILGCPLGGRKPYLFSGFFPSLSKVAAVVGDSARELDRMKQTRNGVVGLPRNYLEDKARDMASQEKWGPFADILALLIFGVVLFPNVDGLVDLAAIDAFLAYHHSKESPVVAILADLFDTFDRRCEKNSARIVCCLPALFVWIVSHLFQQGTRHPCPLQSYRSCAEKGRVDWGQHLAGIGGNAINWFPRWKEGKEGVLFSCGDYPNVPLIGTTGCINYNPALAIRQLGYPMRGAPTKESLSPFLMRDLGAKSLKVIQRVHKAWRSPLKKDKELRGIRNGVIGGYHGWLRVHTRGLDWLSKLKVINEENFEAPEEDEEVQALKLELGKARLAKEKFKSAATHIRKECT

SEQ ID NO: 139937 - protein, 93 aa, Glycine max
  Coding DNA Sequence Number=SeqID_48252
  Subcellular localization annotation: CTP_CleavageSite=29; ConfidenceScore=5.78e-01
MGSPPASTPPPPTSPPPHPPPSEASASPSAVKRTRKASRLRSLSTRPPSAERPVVHVDPATGKDDGPHRKKLRTYLGIVARDKVDVTYENWKK

SEQ ID NO: 139938 - protein, 15 aa, Glycine max
  Coding DNA Sequence Number=SeqID_48253
MRIKRSFKVMMGPRT

SEQ ID NO: 139939 - protein, 168 aa, Glycine max
  Coding DNA Sequence Number=SeqID_48254
MVQFALSQGAPFEGTIVDDWKFDYSSHDARRMVCNDQADMTGRLLAESLTFDCCIMHYIIVRILLLCSSNLAQVSKEDLILMWAFLTGRQNDWAHFLRYRMNKALGANAPLPYPQLVTLFLSHFQIPLDDEPFVQVKRSFAIGAGAVTSFGYRKDRDGQWLKKDTQPP

SEQ ID NO: 139940 - protein, 123 aa, Glycine max
  Coding DNA Sequence Number=SeqID_48255
MDKSLKVWENEWKERGHEIYASNKGVASKCSVVAFRGLHVLASRGLHVLVFRGLHALTFIGLHVLAFRGLHTITFRGPHVLALRGLHALTFRGLHVLAFKGLHVLNFRGLYALALMLDQVASE

SEQ ID NO: 139941 - protein, 291 aa, Glycine max
  Coding DNA Sequence Number=SeqID_48256
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSILSVHHPSVEAIVGGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139942 - protein, 95 aa, Glycine max
  Coding DNA Sequence Number=SeqID_48257
TYQGNPCGVYPDLSSFIGSGVYPDLSSLTGSGVYPDLSSLTGSGVYPDLSSFTGSGVYHDLSSFTGSGVIQISVTCIKRSIPSQVHIIWYQSFGS

SEQ ID NO: 139943 - protein, 66 aa, Glycine max
  Coding DNA Sequence Number=SeqID_48258
  Subcellular localization annotation: CTP_CleavageSite=21; ConfidenceScore=5.20e-01
MAKGCGMTKFCLRMSHDLRVSADNRKVSPRVTNSWVMATKSGVVDKSEAFAPTYPPMRNSDLRSSG

SEQ ID NO: 139944 - protein, 72 aa, Glycine max
  Coding DNA Sequence Number=SeqID_48259
MVNPDKGADPTLVQMAQAKEMALAQVEWALRPLECHPADLAEAPGLQRPHPLPKEKAGLLARPPSEETPRCS

SEQ ID NO: 139945 - protein, 194 aa, Glycine max
  Coding DNA Sequence Number=SeqID_48260
  Gene Ontology: Mol. function=aspartic-type endopeptidase activity; Cellular component=small subunit processome; Biological process=DNA integration
  Homolog annotation: Hit_ID=A5C163; Match level="QueryCoverage=93%, HitCoverage=14%, E-value=4e-24, Identity=32%"; Hit description =Putative uncharacterized protein
  Pfam annotation: Domain name=zf-CCHC; Domain location=155-172; Score =13.8; E_value=0.012; Accession=PF00098.14; Description=Zinc knuckle
MLFQNDKKPEWEKAQEIFANDIQSLFDATVKVTALKQSNHDMITHMGKARAAVEELRRFLVADSLEEVNRKLDKFYMVLILRSLHSDFDHVRDQVLAGDQVPSMDSLITRLLRVPHALKDENLTDAVETSAMVAPRGRGGGRNSRGCRNGRSGCPQCTYCKRMGHTQENCYSLHGFPDKVAQVSKSEKPESKFF

SEQ ID NO: 139946 - protein, 72 aa, Glycine max
  Coding DNA Sequence Number=SeqID_48261
MKTPDEAIDLIESMAASDIAIWRDRAHIPTRKSLLELTSQDALLAQNKLLSKQLETLIETLSCRMYNLWWSS

SEQ ID NO: 139947 - protein, 71 aa, Glycine max
  Coding DNA Sequence Number=SeqID_48262
  Homolog annotation: Hit_ID=Q5U697; Match level="QueryCoverage=47%, HitCoverage=7%, E-value=3e-08, Identity=79%"; Hit description =Cytochrome c biogenesis
MVRLRSTNTKKIQFTQRLPLGSELHMGKERCCFREFFGNVLYSGLETCLLTEQGSLIQTLTSWLLRYSHHG

SEQ ID NO: 139948 - protein, 360 aa, Glycine max
  Coding DNA Sequence Number=SeqID_48263
  Homolog annotation: Hit_ID=Q6WAY6; Match level="QueryCoverage=58%, HitCoverage=44%, E-value=2e-28, Identity=31%"; Hit description =Putative uncharacterized protein
QRYPHEAVVSLTQYYDQPLRCFTFGDFQLVPTIEEFEEILGCPLGGRKPYLFSGFLPSLSKIAVVVRDSTRELDRVKQTRNGVVDLPWKYLEGKARDMANQEEWVPFMDVLALLIFGVVLFPNMDGLVDLAAIDAFLAYHHSKESPVEAILADLFDTFDQRRQNNQLVSSMEGKEGVLFSCGEYPNIPLIGTRDCINYNPALAIRQLGYPMRGAPTEESLSPFLVRDFDLRGIRNGIIGGYHESMKVHTRGLDWLSKLKIIDEENFEAPEEDEEVRALKIELGKARLAKEKFKLVATDVQKECAGLREENAAAARALEQETKSARKEEHGRDKFRGALWGSNNELKLQREERDQSRAHSM

SEQ ID NO: 139949 - protein, 111 aa, Glycine max
  Coding DNA Sequence Number=SeqID_48264
  Gene Ontology: Mol. function=RNA-directed DNA polymerase activity; Cellular component=intracellular; Biological process=RNA-dependent DNA replication
  Homolog annotation: Hit_ID=Q1S5K3; Match level="QueryCoverage=39%, HitCoverage=9%, E-value=8e-07, Identity=56%"; Hit description =Ribonuclease H
VEEERDGKPSYFDIKRYVESKEYPPETSDNDKRTLRRLAASFFMSGSILVATYPSAGGRRVTRGMRVPRKEYARSRHQRLFEENVGKTVKDAIYELLSERFGSCIYAQGRY

SEQ ID NO: 139950 - protein, 295 aa, Glycine max
  Coding DNA Sequence Number=SeqID_48265
  Pfam annotation: Domain name=zf-CCHC; Domain location=101-118; Score =21.5; E_value=0.00084; Accession=PF00098.14; Description=Zinc knuckle
MKREIHASYSSHNSCKSLSEELRDYYEGRHRSHLRPHSHRREKERNPQEANINLPNFHGKDNKDQGQGILGVRPSKPKDDKGKIIEKQPLKASMQEKTSSMKCFKCLGRGHITSQCPTKKTMIMRGQDIYSSQDEATTSPSSSKSEEAKGEESSEEIYPQEEGQPLMVKEECKEVSVSSKRLAKKERHFEIKTNIKEISLLRQPPHFLLCKKTLVSIATSLRLEFIPQVKELLDEGLVRKRLNPCALLVPKIGIIRHQIPKIGGVMNALGGATLVCKITHAPNIFMICVHRDSLG

SEQ ID NO: 139951 - protein, 191 aa, Glycine max
  Coding DNA Sequence Number=SeqID_48266
  Gene Ontology: Mol. function=RNA-directed DNA polymerase activity; Biological process=RNA-dependent DNA replication
  Homolog annotation: Hit_ID=Q0ZCD0; Match level="QueryCoverage=96%, HitCoverage=16%, E-value=8e-13, Identity=26%"; Hit description =Integrase
MERSMIDAASGGALGDMTPAEARNLIEKMASNSQQFSARSDAIVIRGVHEVATNLLSLFETKKLEGKLDSLVNLVTQLAMNKKCAPVARLCGLCSSADHHTDLCPSVQQSEAIEQPEAYAANIYNRPPQPQQQNQPQQNNYDLSSNRYNPGWRNHPNLRWSNPSQQQQQQQQPYFQNAVGPSRPYVPPPIQ

SEQ ID NO: 139952 - protein, 236 aa, Glycine max
  Coding DNA Sequence Number=SeqID_48267
MAPRKISAKRSRKDIVVEGTSSAPEFDSHRFRSAEHQQRFEAIKGWSFHRERRVQLRDDEYTDFQEEIARRCWTLLVTPMAKFDPEIVLEFYANAWPTEEGVRDMRSWVRGQWIPFDADALSQFLGDPLVLEEGQECEYSQRRNRADGFDEEAIAQLLCIPGQDFARTPAGRRVRIMRTSMTTLTQTWMTLLLSNILPSDHNSDLPLSKCQLVYAILTRMTIHVAQLIADAIYLFA

SEQ ID NO: 139953 - protein, 71 aa, Glycine max
  Coding DNA Sequence Number=SeqID_48268
MLPFDFRSQVVPCVVKLMRQANAFPLTITLKKFISWGISRGKGTLKEDFQASSKVLIISMDSGGHTLATSS

SEQ ID NO: 139954 - protein, 63 aa, Glycine max
  Coding DNA Sequence Number=SeqID_48269
IPGGLNIFVLPFPPSPTYREKKEKLATQLAQANSARPGELSSPRRARLLPPEGTAFRRTSRKA

SEQ ID NO: 139955 - protein, 68 aa, Glycine max
  Coding DNA Sequence Number=SeqID_48270
MTNANCPRESLHSVSNGNLRLWKSIHYCFKSEGPSKIDNICARAKGQEDEDNLWTLCSGKRHISFESS

SEQ ID NO: 139956 - protein, 55 aa, Glycine max
  Coding DNA Sequence Number=SeqID_48271
SRDLAKMTLATLFGKLPEHEVELMRLNKHEENYKKKKGIALKASSSIQEKVIKRT

SEQ ID NO: 139957 - protein, 140 aa, Glycine max
  Coding DNA Sequence Number=SeqID_48272
  Subcellular localization annotation: CTP_CleavageSite=18; ConfidenceScore=5.15e-01
MASNSQQFSARNDAIVIRGVHKVATNSFASSKTKNLEGKLEALTFALQCSNLEQLNSLKLMLQTSTIDLLNLSSKINYNRTIMTSPATDTIPDGGITLISNDLALNKNNSSLLLPSKMLLVQVDHTFLLQCNNNNSNSNI

SEQ ID NO: 139958 - protein, 114 aa, Glycine max
  Coding DNA Sequence Number=SeqID_48273
NLYASSKLEGGGHKNENAIRRAPKRLRMENCTKQSLRIAPNSKNWTIALSNHYAWLQTRRWRTHERKRNSWGSEKKGGGHMNENAIHGAPKRLRMENCTKQSLRMAPNSKVEDM

SEQ ID NO: 139959 - protein, 204 aa, Glycine max
  Coding DNA Sequence Number=SeqID_48274
  Gene Ontology: Mol. function=motor activity; Cellular component=cell projection
  Homolog annotation: Hit_ID=UPI00016621D1; Match level="QueryCoverage =85%, HitCoverage=40%, E-value=7e-16, Identity=33%"; Hit description =UPI00016621D1 related cluster
MRCPLKESTSCFLVRLKSFGTYTYWLAFRGLHVLTFRGLHALAIRGLHVLTFRGLHALAIRGLHVLTIRGLHALTFRGSHVLTFRGLHALAIRELHVLTFRGLHALAIRGLHVLTFVGLHALTFGGLHVLANRGLHALTFRGLHVLAFRGLHVLAFKGSCTFTFVGLHVFTFKGLHVLAFRGLHILTIRGLHVPHFQRGTCPHL

SEQ ID NO: 139960 - protein, 77 aa, Glycine max
  Coding DNA Sequence Number=SeqID_48275
MNLHGQVIEVTSSEEDPEEDPEELPPEPAVDALDFLEGDEDPLLEVDSPEEAMSASEADSTEDSGPGEMAISGGSSS

SEQ ID NO: 139961 - protein, 50 aa, Glycine max
  Coding DNA Sequence Number=SeqID_48276
MAQKKASTATTKTMDRRRKGARERRGLVFVKPMSFCDFKKGFEKIVIKKL

SEQ ID NO: 139962 - protein, 78 aa, Glycine max
  Coding DNA Sequence Number=SeqID_48277
  Subcellular localization annotation: CTP_CleavageSite=45; ConfidenceScore=5.48e-01
MNSLPSAFHVSSTIESGAPRIDYLALFASSPFSTFIRRPMNSLPSAVHVSFTNESGAPRIHCLALFANSPFSILFRDP

SEQ ID NO: 139963 - protein, 63 aa, Glycine max
  Coding DNA Sequence Number=SeqID_48278
GQGFTAFACPTPDQFRVEVAWPRDWPEDQTEEAPTGAPKDAEDARMDEEMTDLLSFLGRSGAT

SEQ ID NO: 139964 - protein, 97 aa, Glycine max
  Coding DNA Sequence Number=SeqID_48279
MRSNSVRGEPIDNLKRGLLGGSMNPPVVGKSLHEEDTHPKTYEKRSLVPSLAHKVFQKWLRNLASLSDTMVLGKPWSLTTSLKKSFEMWEASSTLWH

SEQ ID NO: 139965 - protein, 108 aa, Glycine max
  Coding DNA Sequence Number=SeqID_48280
MGETHEIPHHNLADFEPCLGYATEGQAVGGIPMPNTLEGPQFRPQPQPQPLHFAVGRAPPAMAEKGELDHIEERLKDIEGGEDYAFANLEELFLVPEHGHSQVQGAKL

SEQ ID NO: 139966 - protein, 94 aa, Glycine max
  Coding DNA Sequence Number=SeqID_48281
MERRVHEVATNSSSSAETKKLEGKLDALVNLVTQLALNQKSVPIARVCGLCSSVDHHTNLCPSMQQPGAIEQPEAYAANIYNRPPQPQQQNQPQ

SEQ ID NO: 139967 - protein, 238 aa, Glycine max
  Coding DNA Sequence Number=SeqID_48282
  Homolog annotation: Hit_ID=Q6WAY6; Match level="QueryCoverage=31%, HitCoverage=13%, E-value=2e-09, Identity=43%"; Hit description =Putative uncharacterized protein
AEESEPQGLDWLPNLKTVRDDEVKASKESDEVQALKAELERAWVVEEKFKAAIVSSSSEEVKGINTGQRHDLEGRAKGNMWAIIDKCKEKLNLAATHEQRLEDEYAKISAEREARERAKAVGGHGMTFSPSTRKSTDFVSYLSMWGWFHTFFSKKVGPSIRYKEGRIKILSSCEGCPNVTLMGTRGCINYNPVLAIRQLGYPMRGAPLDESITPFIARGFSDHNARVLQGVRKAWDAA

SEQ ID NO: 139968 - protein, 146 aa, Glycine max
  Coding DNA Sequence Number=SeqID_48283
CLALKSKVQGLIEAGWLTFQEDEPNIKTNHLANHGGGAVNAIEVSRYAPLGGRKEEATDIGSLSAKVTHITELSGITRSGCVFTPPSLPMQPANAKGKTKVTEGQNVKVIPASDEDVPTKEFVVGREGCGKKEVSLEEASEFLRII

SEQ ID NO: 139969 - protein, 73 aa, Glycine max
  Coding DNA Sequence Number=SeqID_48284
MSLPSGVHVFSLIKCEASGAGKHKKKKEEVEMRVDIAKRAGRTKSVSYLCFPLISDERLACSVKFGNVAEVEK

SEQ ID NO: 139970 - protein, 69 aa, Glycine max
  Coding DNA Sequence Number=SeqID_48285
  Subcellular localization annotation: CTP_CleavageSite=31; ConfidenceScore=5.23e-01
MSSTLSLSAARSTWTTGLSAPSSLVANDHSRVALRVCFKVDGDCDGTARGRGGGEGGGGRGGEAVSIMS

SEQ ID NO: 139971 - protein, 201 aa, Glycine max
  Coding DNA Sequence Number=SeqID_48286
  Pfam annotation: Domain name=Transposase_23; Domain location=47-117; Score=-9.7; E_value=0.014; Accession=PF03017.5; Description =TNP1ENSPM transposase
  Subcellular localization annotation: CTP_CleavageSite=30; ConfidenceScore=5.06e-01
MASFSQLQLQMQSQGLAVPPEPLVGPSGPRVSTKGSCVDPSGNDLETGDSDRWGLYIEADLARLVAMGRVYEGSTVVHNTPLLPGQVKMSVEEVTDADALVPVPTDEVSLVGQALHTFLAWPTHLVKSLSQQPNPEVDDPLYLMTLTIPELFLRPYQAIWDATVFGVVNPDFPLYIKHEDLSEIAHGGQCLSISVLQLWIL

SEQ ID NO: 139972 - protein, 199 aa, Glycine max
  Coding DNA Sequence Number=SeqID_48287
DLTVSIRGARRARARPIEAPSTSAAPPPAHTLVAPSTLSSTDFQHLEAMLQSIHQGQIVLLQSLQLVAPPDSIPSVEQFNEWVAWPETQPPLHREDEGLTAQDESSDTSTPEPLIRWKRIVETQEVAATSEKSLEATSEPSERVVDTTSIQQAVDPSTLEDQNTPVLSPNTSPLATPVLHLTDEEDVQTLDTQDRSQDF

SEQ ID NO: 139973 - protein, 37 aa, Glycine max
  Coding DNA Sequence Number=SeqID_48288
MLYLECDPIPEVVENEDDLDDVPVAGHEEDVGGGERE

SEQ ID NO: 139974 - protein, 48 aa, Glycine max
  Coding DNA Sequence Number=SeqID_48289
MAINSWDSKLDGGGCMNGNQFMGFDGGGCMNNTRLSICVAPDSMVEDA

SEQ ID NO: 139975 - protein, 213 aa, Glycine max
  Coding DNA Sequence Number=SeqID_48290
TLTVERTTRPRLERTTRPRLERTTRPHHQRAARPYLQRTTCPRLERATRPHLGGLHALTSRGLHVLALRGLHALTLGTSYPHRQRTTRPRLERTTRPHHQRAARPYRQRATRPHLERTTRPHHQRAAQGHALTLRGLHVLTIRGLHALTSRGLHVLALRVLHALTLGTSYPHHQRAARPHLQRTTRPRLQRVMCLHLCRATRPHLQRTTRPHL

SEQ ID NO: 139976 - protein, 127 aa, Glycine max
  Coding DNA Sequence Number=SeqID_48291
MGTNQTGKRFYQVKVKSLDTTSIKELGRLMEPLQMQAFRKTYGKILELTTAEVSIEAIASLTQYYDQPLRCFTFGDFQLGKKTIPFLRVSPLFEQNCNCGQGFSKRFGPHKTDSKRHSGPTTEVPRR

SEQ ID NO: 139977 - protein, 211 aa, Glycine max
  Coding DNA Sequence Number=SeqID_48292
MKKKDTGHQSVSLENKIGDSTVLKIENSAKVVIKQDMKGRIHKYGFNNTKREKAEKVRVVDDETGDKHQLDEVLRMPCGTLGVLYVMSTVPLIMGSTPASTPPPPPPSDASASPSIVKRTRKASCGRHLQEHIWEDIQAEFDILEASDSRTKRKLLQTVGERWRQFKSDLTRKWALAVDQDGVEDTVYEKYDINKEKWAQFCQTRRDPSWE

SEQ ID NO: 139978 - protein, 45 aa, Glycine max
  Coding DNA Sequence Number=SeqID_48293
MFPHGKMPKKGCRGKKPRVSRTSGFEVKSFQGGGDDAILPPKGIG

SEQ ID NO: 139979 - protein, 152 aa, Glycine max
  Coding DNA Sequence Number=SeqID_48294
MKNTKTKTKRETKEYSVTGRRRNWWLRRGSCGLAQRAPTTKYLKHLVFGEKGTKNMKHLVYGSASCGGDRPSSLVVELGVPVMVWEEPSSGFLARRNGTVERMYLRRHCLMQFAAAVVGWKWWCLRLHHFKNPRGAEESKKENERATIRERK

SEQ ID NO: 139980 - protein, 190 aa, Glycine max
  Coding DNA Sequence Number=SeqID_48295
  Gene Ontology: Mol. function=phosphoribosylaminoimidazolesuccinocarbox amide synthase activity; Cellular component=phosphoribosylaminoimidazo le carboxylase complex; Biological process=purine nucleotide biosynthetic process
  Homolog annotation: Hit_ID=A7ZPS1; Match level="QueryCoverage=100%, HitCoverage=80%, E-value=1e-100, Identity=94%"; Hit description =Phosphoribosylaminoimidazole-succinocarboxamide synthase
  Pfam annotation: Domain name=SAICAR_synt; Domain location=1-189; Score=260.9; E_value=2.8e-75; Accession=PF01259.9; Description =SAICAR synthetase
MVNNKFNHFIMTKLAEAGIPTQMEALLSDTECLVKKLDMVPVECVIRNRAAGSLVKRLGIEEGIELNPPLFDLFLKNDAMHDPMVNDSYCETFGWVNKENLARMKELTYKANDVLKKLFDDAGLILVDFKLEFGLFKGEVVLGDEFSPDGSRLWDKETLDKMDKDRFRQSLGGLIEAYEAVAHRLGVKLD

SEQ ID NO: 139981 - protein, 152 aa, Glycine max
  Coding DNA Sequence Number=SeqID_48296
  Homolog annotation: Hit_ID=A2Q1D6; Match level="QueryCoverage=76%, HitCoverage=18%, E-value=4e-13, Identity=39%"; Hit description =Ovarian tumour, otubain, related
  Pfam annotation: Domain name=AFT; Domain location=45-141; Score= -35.4; E_value=0.0052; Accession=PF08731.2; Description=Transcription factor AFT
  Pfam annotation: Domain name=FAR1; Domain location=59-143; Score= -23.3; E_value=0.019; Accession=PF03101.6; Description=FAR1 family
  Pfam module annotation: Pfam domain module=AFT::FAR1; Domain location= 45-141::59-143
MDEDQWTYDYTMSQEVHMDYDNEEECGVDQPHVDCSNAFNTCQVFGTRDNVLQWAQTVAHEKGFVAVIMRSDIDTGSRGRSSFVLIGCERSGLHKCRNNEFVRRDTWSKKCGCPFRLREKPVHGREGWMVKLICRIHNHELAKSLVGHPYVG

SEQ ID NO: 139982 - protein, 65 aa, Glycine max
  Coding DNA Sequence Number=SeqID_48297
PLIELVRNHVPSWEDAQEMGVEGRSPEYEDPRDLRSNPFQGGELSYYRGNLLKEASQGGELSYER

SEQ ID NO: 139983 - protein, 110 aa, Glycine max
  Coding DNA Sequence Number=SeqID_48298
  Pfam annotation: Domain name=zf-CCHC; Domain location=80-97; Score =14.7; E_value=0.009; Accession=PF00098.14; Description=Zinc knuckle
MELQRLNQHEENDKKKKGIALKASPSIQEESDIEDSIDLDEDEDLSLFVKRFNKFIRIRGNQRRQNFKPKRRTEESSQIPKFFECNQPGHLRADCPIFKRKIEKSEKEDY

SEQ ID NO: 139984 - protein, 377 aa, Glycine max
  Coding DNA Sequence Number=SeqID_48299
  Homolog annotation: Hit_ID=Q84VH5; Match level="QueryCoverage=100%, HitCoverage=57%, E-value=1e-166, Identity=78%"; Hit description =Envelope-like protein
MIPGSAPVPEKLVPKRQHGVKTSENPSLATSPREVDTEMDKKIRSIVSSILKDASVPDADKDVPTSSTPNVSVPDADKDVPTSSTPNAEVPSSSSKEESTEEEDQATEETPAPRAPEPAPGDLIDLEEVESDEEPIANKSGRIKTMAQKKSTPITPTTSRWSKVAIPSKKRKEISSSDSDDDVELDVLDIKRAKKSGKKVPGNVPDAPLDNISFHSIGNVERWKFVYQRRLAVERELGRDALDCKEIMDLTKAAGLLKTVTKLGDCYESLVREFIVNIPSDITNRKSDDYQKVFVRGKCVRFSPAVINKYLGRPTEGVVDIAVSEHQIAKEITAKQVQHWPKKGKLSAGKLSVKYAILHRIGAANWVPTNHTSTVAT

SEQ ID NO: 139985 - protein, 156 aa, Glycine max
  Coding DNA Sequence Number=SeqID_48300
  Subcellular localization annotation: CTP_CleavageSite=27; ConfidenceScore=5.10e-01
MLLSSNVIYICVRVVMLVRMIRTRLFAAARVKSCPGMHSSRVIASLSGCARTVGPPPKAVPQGQRARYSLKVRTCGVTSEDEDPSEDAGQCSPRKVRACSPLMARTCSPLKVRACSPTKVKVHDLLTARTCSPLKLKVHDPLKVRVQPLRGGRVVL

SEQ ID NO: 139986 - protein, 161 aa, Glycine max
  Coding DNA Sequence Number=SeqID_48301
  Pfam annotation: Domain name=G-patch; Domain location=2-41; Score =31.4; E_value=3.3e-06; Accession=PF01585.14; Description=G-patch domain
MARVMLGNGYEPGMGLGKDNNGITSLINAKGNRGKYGLGYKPTQADIKRSIAGRKSGSQSSRLRQESEGSSPCHISRSFISAGLGDEGQVVAIHEDDVPSTLDLVRPCPPDFQLGNWRVEERPDIYATSIISDDESPEGTNTWDPPINFEQETNQTEDERE

SEQ ID NO: 139987 - protein, 35 aa, Glycine max
  Coding DNA Sequence Number=SeqID_48302
MPTSSRRLGDSSPESYSPYPAAVILLPRTMFVIIT

SEQ ID NO: 139988 - protein, 316 aa, Glycine max
  Coding DNA Sequence Number=SeqID_48303
  Gene Ontology: Mol. function=aminoacyl-tRNA ligase activity; Cellular component=cytoplasm; Biological process=tRNA aminoacylation for protein translation
  Homolog annotation: Hit_ID=A9C1G8; Match level="QueryCoverage=16%, HitCoverage=5%, E-value=9e-22, Identity=98%"; Hit description=Leucyl- tRNA synthetase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDGLLPVGTDIDYEGVGTMSKSKNNGIDPQELIEKYGADTARLYTMFTAPPDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 139989 - protein, 167 aa, Glycine max
  Coding DNA Sequence Number=SeqID_48304
MSEIEEAQEHMMADMEAMKEKMTTMMEAMMSMRRMMGVNAATIVPTSTTTEVDPTHPLGFNQVQNKHSFPLDGLPSNYAPPNVAHTLDENVDNFVPIPIESQQPQSDHAHVSQPMGETHKAPRDHNLADFEPHLGYAIEGQTVGGVPLPNTLESPQFRPQPQPLHFV

SEQ ID NO: 139990 - protein, 295 aa, Glycine max
  Coding DNA Sequence Number=SeqID_48305
  Gene Ontology: Mol. function=iron ion transmembrane transporter activity; Biological process=high-affinity iron ion transport
  Homolog annotation: Hit_ID=A8GBI6; Match level="QueryCoverage=16%, HitCoverage=14%, E-value=1e-14, Identity=78%"; Hit description =Periplasmic binding protein precursor
ERYPEVVKQILTSPQWQPIDAVKNKRVYLMPEYAKAWGYPNAGSDGVGVLPISICSSGSTLTINVITAPPAARAGNEAGLAGIVDAVLRAVFARRWPLSGANNAQPDDFAGAVHRAALCRHRCYPTPGDPGCARAASAVGDGRRRSAGPVRRGFARRLSQPAGRPAYHRRVVRRGLWRHAGYPAQPAIGGAAAVGFCFRHGGAAADFHSHQRHCAAQYSLFGTGGSDPQRLLLSLRQPDAISGGYRRETAEHRVLAARQLCHRRSAKAADAVCAFAVGRRLAVGAALAHQSAVVG

SEQ ID NO: 139991 - protein, 91 aa, Glycine max
  Coding DNA Sequence Number=SeqID_48306
MAFFLSYLDYKAQNAQVSNGLRNGNVAHITDIFSKIPTGTSFIITRAQNSTAHHNAYFRKKALEAARGSAFAEIPRFYKLIIVRVFSVMTS

SEQ ID NO: 139992 - protein, 142 aa, Glycine max
  Coding DNA Sequence Number=SeqID_48307
MAVVLEAGKIFSKNTLLRSSQLVMDLGASSGGLHGGEQYEIPSNVVDLHLQAMKLWKQEGAESGCSHFLAARGEEDCCMEGQMSVWWSAEEHKPQNPCDRSHVSKGYTTGSIYHTSLHIAESFIKILEKKLLRNLMVRATGT

SEQ ID NO: 139993 - protein, 139 aa, Glycine max
  Coding DNA Sequence Number=SeqID_48308
MKNKRRMLKNGRESSRNYSRKRYGSASAWIFFTEQTRGGACHPARPGEQGCFLQKQQPLGGRIWMAQLSKKLRKLTDWAKTPLFDFRHITEFHGSLTGGSALDNGGYMNNARQSIDGAPNRTVEDTRTALGNQFVGLRT

SEQ ID NO: 139994 - protein, 342 aa, Glycine max
  Coding DNA Sequence Number=SeqID_48309
  Gene Ontology: Biological process=transposition, DNA-mediated
  Homolog annotation: Hit_ID=Q6UUU1; Match level="QueryCoverage=17%, HitCoverage=40%, E-value=5e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSISKHNDGLCRHKINAYSVSPVAPVNQKDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIPLLWPRLSHSTPDTQFR

SEQ ID NO: 139995 - protein, 76 aa, Glycine max
  Coding DNA Sequence Number=SeqID_48310
MSRGSEDLGDVRWGAMPKTKLDQSRPNPGIVNQLENEIRKLGGLLVIDYQAQKWDWNVEGASGNRLPGCVIDYTEE

SEQ ID NO: 139996 - protein, 71 aa, Glycine max
  Coding DNA Sequence Number=SeqID_48311
MLGYSVCKVGLAGEPAKPKLIGSLSSADAARNFAWRRRPWLSARPINQKNLLSYLGLANQPRLATDTVPGG

SEQ ID NO: 139997 - protein, 146 aa, Glycine max
  Coding DNA Sequence Number=SeqID_48312
MPYVEAVEESLETTFQSFEVVSNASVDSLPRQPRLSGAAMMVARVMLGHDYEPEMGLGKDNGGRADLERKNKGQGPRSEQQAKEVPPCHISRSFVSAGLKHEGQVAAICDEDSLRRSNLIQLCPLGFQLGNWRVEECPEVYTRSIM

SEQ ID NO: 139998 - protein, 231 aa, Glycine max
  Coding DNA Sequence Number=SeqID_48313
  Gene Ontology: Mol. function=RNA-directed DNA polymerase activity; Biological process=RNA-dependent DNA replication
  Homolog annotation: Hit_ID=Q0ZCD0; Match level="QueryCoverage=78%, HitCoverage=16%, E-value=1e-08, Identity=24%"; Hit description =Integrase
MERSMIDAASGGALGDMTPAEARNLIEKMASNSQQLSARNDAIVLRGVHEVATDSSSSTENKKLEGKLDALVNLVTQLAMNHNSTPVPKVCGLCSSADHHIDLCPSLQQSRVNEQPEAYAANIYNRPPQQQNQQLQNNYDLSSNRYNPGWRNHLNLRWTSPPQQQQPVPPFQNVAGPSKPYVPPPIQQQSQQRQATEAPPQPSLEELVRQMTIQNMQFQQETRASIQSLTN

SEQ ID NO: 139999 - protein, 209 aa, Glycine max
  Coding DNA Sequence Number=SeqID_48314
  Gene Ontology: Biological process=transposition, DNA-mediated
  Homolog annotation: Hit_ID=Q6UUU1; Match level="QueryCoverage=28%, HitCoverage=40%, E-value=2e-18, Identity=78%"; Hit description =Putative uncharacterized protein
VLQWLLFLSAVPPVQLLTGWCVTAKAPPDISAGKCSGHAARRVPFAIQAAQLLGRAIGAGLFAITPAGERGMCCKAIKLGNARVFPVTTLIHIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140000 - protein, 131 aa, Glycine max
  Coding DNA Sequence Number=SeqID_48315
  Pfam annotation: Domain name=Transposase_23; Domain location=2-65; Score=-11.3; E_value=0.021; Accession=PF03017.5; Description =TNP1ENSPM transposase
VRLVHRSRSCPLVAIGRVYEGSTIVHNTPLLLSQVKVSVEEVRDVDAPVPVPTDEVSLVVQALHTFLAWPTHLVKSLSQQDSFEEQATQGSFIPHGRQDVLAAAIGRPEHPGCVRAAGVGVTIKQYFGSAP

SEQ ID NO: 140001 - protein, 284 aa, Glycine max
  Coding DNA Sequence Number=SeqID_48316
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIFGLQRDGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140002 - protein, 179 aa, Glycine max
  Coding DNA Sequence Number=SeqID_48317
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=29%, HitCoverage=50%, E-value=7e-24, Identity=100%"; Hit description=LacZ protein
MADVVVARGQGLHAQAQLGIDLDGLRIDFFVLKDAQVGIKAQTGQRQDLRASHLGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 140003 - protein, 59 aa, Glycine max
  Coding DNA Sequence Number=SeqID_48318
HLTETCMRAGNSDIYGFLEPQSIQSGHWQMVIILPKEHLVVWFCSLHNRPDNYLKGIIN

SEQ ID NO: 140004 - protein, 63 aa, Glycine max
  Coding DNA Sequence Number=SeqID_48319
MQKLQEKAKLSSKICACLSRSADGLKQRTLLDDPLLSANAQLIILPDSSSRSTEECCAQRMVR

SEQ ID NO: 140005 - protein, 64 aa, Glycine max
  Coding DNA Sequence Number=SeqID_48320
MEEEFSLQEKNITMKIIHMVIYYMLKIQIQNLFQQLFLNPASGNRLHFLVIDYQSLACLESTLF

SEQ ID NO: 140006 - protein, 27 aa, Glycine max
  Coding DNA Sequence Number=SeqID_48321
LLGPSRMFQQKAVPSGGSNSARQGELC

SEQ ID NO: 140007 - protein, 106 aa, Glycine max
  Coding DNA Sequence Number=SeqID_48322
MGRVGDNGGVYHQLDGSQRLLLDAMTTQMQRLLNRNNEELYRRIAKSSLFILKPLSPREEFKISYPRRFLMDCLSNIRHQVIKILRSSLPKSAICYPNHNLKSNLQ

SEQ ID NO: 140008 - protein, 120 aa, Glycine max
  Coding DNA Sequence Number=SeqID_48323
MGCTHGPKIYPKAHKNPRAFSCISGPIYLEFSIQCPCGEDRSNWGKKEGRRYPNHRRPLMVPISTHNITQASQLTPGTRPTRHPYKLGCLCPSRGRPLKLRLQPQLARLAMPTLGPVPTR

SEQ ID NO: 140009 - protein, 121 aa, Glycine max
  Coding DNA Sequence Number=SeqID_48324
MKILKELKIEKHASYSSHNSCKSLSEELHDYYEGRHRSHLRPHYHRRENERKPQEANINLPYFHGKDDVEANLDWEIRVEQKLKRKSTLKPYDSHSYPKKDQGLGILGQHLLSPKMIRGRQ

SEQ ID NO: 140010 - protein, 144 aa, Glycine max
  Coding DNA Sequence Number=SeqID_48325
MATMMEAMMSMKKIMEANAVAIAATRVVAKVNPMPPSDLNQMNHPTSDMVGKDLGSTNDPMMCKFKISMPSCHMACLPTIHHPIWRTLPMRMSITPLPHSLRADKPKLIMHMSLKPWRRHMKFPTAIQPTPSLALDMPLKGKQL

SEQ ID NO: 140011 - protein, 183 aa, Glycine max
  Coding DNA Sequence Number=SeqID_48326
  Homolog annotation: Hit_ID=A5BIA8; Match level="QueryCoverage=81%, HitCoverage=61%, E-value=4e-14, Identity=37%"; Hit description =Putative uncharacterized protein
MEEGTQLVFECSKIRWLHFVTRACYKDMLQEQTGPLIRAISALRWIFLTLIRVAFTFSSTKQEQFSLDKQLKRKKGYLLSARSLTVFWGEGDTPRHSEVTEIVSVSWLKILGRIKTGMLSPNTLYGAYLVFKESSDGAYGFKNMPFEVFIGVIGEVTDSRIMNLLVGSSESNTRRRVTMVDGC

SEQ ID NO: 140012 - protein, 143 aa, Glycine max
  Coding DNA Sequence Number=SeqID_48327
MSPFLVRDFGTQNFKAIQRIHKAWETLLRKDKELRGIHNGIIGGYHEWLKVHTRGLDWLPKLKVVSEESFEAPEEDEEVQALKNELGKARLAKEKFKLAATDIRKECAGLREENATTARALEQETKRARKEEYGRNKFRRALW

SEQ ID NO: 140013 - protein, 82 aa, Glycine max
  Coding DNA Sequence Number=SeqID_48328
  Gene Ontology: Mol. function=hydroxymethyl-, formyl- and related transferase activity; Cellular component=cytoplasm; Biological process='de novo' IMP biosynthetic process
  Homolog annotation: Hit_ID=Q6D4Q7; Match level="QueryCoverage=100%, HitCoverage=29%, E-value=3e-40, Identity=95%"; Hit description =Formyltetrahydrofolate deformylase
  Pfam annotation: Domain name=Formyl_trans_N; Domain location=1-82; Score=10.2; E_value=1.8e-07; Accession=PF00551.10; Description =Formyl transferase
MTAKIDQYQPDYVVLAKYMRVLTPAFVQHYPNQVINIHHSFLPAFIGARPYHQAYERGVKIIGATAHYVNDNLDESPIIMQD

SEQ ID NO: 140014 - protein, 143 aa, Glycine max
  Coding DNA Sequence Number=SeqID_48329
  Subcellular localization annotation: CTP_CleavageSite=26; ConfidenceScore=5.19e-01
MPRALENLALPLLFVTVKSLFSFSSRLKTAGNRSLDNHIVLAQTHRTPYTTGKPTFSSLEPTEPPTLFLEVWLKENPTYTVATRVLKQSWVLKAQSFLCEVRRSTSSMLSFHGCSCFIYDNNNNNNTSSVAVLLIEVRGKLKV

SEQ ID NO: 140015 - protein, 141 aa, Glycine max
  Coding DNA Sequence Number=SeqID_48330
DIELVEEEETQIGVDRSSATSNKFEIYKEEAGNAAQKHKAKRVENVNADAKAFVEALEHMKKRDTNHQSVSLENKTGDSTVLKIGDSAKVVIKQDMKGRKHKYGFNNNKREKPEKVRVVDDEAGDKHELYEVLRMPSKTKY

SEQ ID NO: 140016 - protein, 100 aa, Glycine max
  Coding DNA Sequence Number=SeqID_48331
MTCGDKIWSFCTPLPFRHSRVRWHAETKFGHSAPFCHPEAAGPMTCGDKISVIPHPFAIQTQSVDTAETKFGHSALLSSRGGGPDGIMDKIWSFCTPLPY

SEQ ID NO: 140017 - protein, 70 aa, Glycine max
  Coding DNA Sequence Number=SeqID_48332
MERDAALSATQLTGGGGYAHVCTPATLARMFRLLNRRTADDHEAKHLEINPHKGTISWLPGPPPRGRRYR

SEQ ID NO: 140018 - protein, 43 aa, Glycine max
  Coding DNA Sequence Number=SeqID_48333
MGTGAERNEDKGYVGVRVRRPWGRQVGCYCPKPSLTNPDPTRA

SEQ ID NO: 140019 - protein, 73 aa, Glycine max
  Coding DNA Sequence Number=SeqID_48334
MNHGPRRMRRKAIKKEDPRRRILLGMTITHPMVRRRRSTFYPRTMKVMRTSLKKFKVIFLSQNMKLIINLNGW

SEQ ID NO: 140020 - protein, 83 aa, Glycine max
  Coding DNA Sequence Number=SeqID_48335
MAPPLTSFPLSSAASPCLHSPVHLRLIGGGVMMLDFEILAHFPHHCVIQIGAIIGNDLPRESVPTNQLPLYESDYHAPRDIGV

SEQ ID NO: 140021 - protein, 315 aa, Glycine max
  Coding DNA Sequence Number=SeqID_48336
  Gene Ontology: Mol. function=diaminohydroxyphosphoribosylaminopyrimidi ne deaminase activity; Biological process=riboflavin biosynthetic process
  Homolog annotation: Hit_ID=Q88QH9; Match level="QueryCoverage=16%, HitCoverage=14%, E-value=2e-23, Identity=96%"; Hit description =Riboflavin biosynthesis protein RibD
  Pfam annotation: Domain name=dCMP_cyt_deam_1; Domain location=125 -211; Score=9.6; E_value=6.9e-05; Accession=PF00383.13; Description =Cytidine and deoxycytidylate deaminas
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDQTAILDAHYMARALELARKGVYTTHPNPRVGCVIVRDGEVVGEGWHVRAGEPHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140022 - protein, 101 aa, Glycine max
  Coding DNA Sequence Number=SeqID_48337
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=97%, HitCoverage=75%, E-value=2e-21, Identity=59%"; Hit description=LacZ protein
  Subcellular localization annotation: CTP_CleavageSite=32; ConfidenceScore=5.11e-01
MTMITPSSKLTLTKGNKSCPGDPLVLERPPPRWSSNSPYSESYYNSMAVVLQRRDWENPGVTQLNRLASHPPFASWRNIEEARTDSPSQQLHTPNGEWDAP

SEQ ID NO: 140023 - protein, 304 aa, Glycine max
  Coding DNA Sequence Number=SeqID_48338
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDPRMVPCDILLSTRLVSDMPIIDSSPEFISFKFQCLPSEFRVDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140024 - protein, 195 aa, Glycine max
  Coding DNA Sequence Number=SeqID_48339
  Gene Ontology: Cellular component=mitochondrion
  Homolog annotation: Hit_ID=Q6R9L5; Match level="QueryCoverage=51%, HitCoverage=80%, E-value=7e-28, Identity=69%"; Hit description =Putative uncharacterized protein orf121-a-ct
MSAVSSPLISTRELSRKLYDSTSIFPIRQFDLCYDLSFMDVDKILPSSSTLGWHSLKVKGEVQTKKGLWWIPRHPETRKGVVSDEMLRGVENKRRSGDSRYRGKESKSDSRSSGERNGSSLNRENGVVGELYKCRAARRSSRECCTLDGESPVAESITSLRSDPSSMGHVESRVNQQGPPCKAKYSWVTDSEVVP

SEQ ID NO: 140025 - protein, 296 aa, Glycine max
  Coding DNA Sequence Number=SeqID_48340
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSFPCIPLGMIDSIPFHSISFRCNPFQSIPFHSIPLELISFHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140026 - protein, 190 aa, Glycine max
  Coding DNA Sequence Number=SeqID_48341
  Homolog annotation: Hit_ID=UPI00006A2D9E; Match level="QueryCoverage =82%, HitCoverage=82%, E-value=7e-07, Identity=16%"; Hit description =UPI00006A2D9E related cluster
RTRRLTFRGLHALTSKGLHAPRLHRTTPPRFRGIHALAFRGLDGSLTIRGLHALTFRGLHVLAFHRAHCPRLQRTTHRRFRGLHALAFRGLHVLTFRGLLALTIRGLHVLIGLHVLAFIGLHALALRGLHVHAFRGLRLIAFRGLHVLPIRELHVLAIRGLHALAYRGLHVLTFIGLHTLALKGLHVLAF

SEQ ID NO: 140027 - protein, 69 aa, Glycine max
  Coding DNA Sequence Number=SeqID_48342
KGNLQVRNSTSEVLGTGRRHKGVNHIKRVFQRKFRSFKKKRPQQFLIQKGILSIDLQSLMESILENPNA

SEQ ID NO: 140028 - protein, 46 aa, Glycine max
  Coding DNA Sequence Number=SeqID_48343
MTKARQKGYGKKIGEELATQLAQASQVASSKSKHLLEEYPGRPKWA

SEQ ID NO: 140029 - protein, 139 aa, Glycine max
  Coding DNA Sequence Number=SeqID_48344
  Homolog annotation: Hit_ID=Q84VH5; Match level="QueryCoverage=68%, HitCoverage=13%, E-value=2e-35, Identity=81%"; Hit description =Envelope-like protein
MLSQHPNILNYTDSVMKRESPLSLHYKLFEGTHVPDIVSTSGKAAASGAVSKDALIAELKDTCKVLEATIKATTEKKMELERLINRLSESGINDGEAAEQEDEAAEEEVEAAEEEEEAAEEEEDAAEDTESDDDSEATP

SEQ ID NO: 140030 - protein, 92 aa, Glycine max
  Coding DNA Sequence Number=SeqID_48345
MRILKLAKNRLKDQVEKDEGPSGEGQSPRVEKDEGPRQGWAFSPRVKVYGELGFWLKACRTVGHDICQGVGLASGSGIKGMSHIISMTHMQR

SEQ ID NO: 140031 - protein, 179 aa, Glycine max
  Coding DNA Sequence Number=SeqID_48346
MSHHSSSVNGEGTSHKDPLSRILDELSSLKLWKEKQERKEKGKKRVEEISQDERKKIREEERRKIMKEMKREKHPSYGSHNSCKSLSEELRDHYEGRHRSHLRPHSHRKEKERKPQEANINLPYFHGKDNVEANLDWEIRVEQQLKKKSTSKSLWLSLLSKRKDQGQGILGLTPSKPQR

SEQ ID NO: 140032 - protein, 183 aa, Glycine max
  Coding DNA Sequence Number=SeqID_48347
MTTLTQMWMTLLLSNVLPSDHNSNLPLSKCQLVYAILTRMSVHVAQLIADAIYLFAGMPPTRHPLDPDKSNRALGFLALITGLCQSFGVLITPSKVIRPPITRAFIEKYCKPRQAQGDAPQAAHTLPPPHQADPARTEVAWLGDWPEAQVEEASAGAPGDAEEARMDEEMTDLLGFLGGSGAA

SEQ ID NO: 140033 - protein, 57 aa, Glycine max
  Coding DNA Sequence Number=SeqID_48348
MPKDRGTCLDFRYCHHQKGGDCRQRIKLKAECFDDAKGSHESHASQRFIQNKDIQDE

SEQ ID NO: 140034 - protein, 156 aa, Glycine max
  Coding DNA Sequence Number=SeqID_48349
  Subcellular localization annotation: CTP_CleavageSite=59; ConfidenceScore=5.46e-01
HRRTSALASVAVTLRVTTTPAALNAPLQGASHSPFRLRNCWEGRSGFPSHDVVKRRPVNCNTTHYRANWSSTAVAAALELVDPPGCRNSILAPDEQSVRVLARAAGLGGPLVDPGVSHGSTHRDSPPLCLGAPTTPSVSGRARLIDAPDVDPPGPR

SEQ ID NO: 140035 - protein, 66 aa, Glycine max
  Coding DNA Sequence Number=SeqID_48350
MILRGSSIILLLLMMIDESDRAAQCTRQDKMSNEELKLQDPRCQIQCPGHPARKYWTHKSVISLTD

SEQ ID NO: 140036 - protein, 149 aa, Glycine max
  Coding DNA Sequence Number=SeqID_48351
ADDHKISLHATGSLSLDDKGTKFVYVRLPPNLLLLNDKGKNAGPTGFRMSSGPPPLDDKSMTEIVCAEDDVNLHVSTCLLAVIDKGYLRMSRDSSVSMTEIVCAKDDVNLRVSTGLLAAIDKGPETSQKSKGSRLARSVKFRTVVEVEK

SEQ ID NO: 140037 - protein, 30 aa, Glycine max
  Coding DNA Sequence Number=SeqID_48352
MEEIHGEDDKDQGRNGEGEKVIGDATSSRK

SEQ ID NO: 140038 - protein, 231 aa, Glycine max
  Coding DNA Sequence Number=SeqID_48353
  Homolog annotation: Hit_ID=UPI000065F7CF; Match level="QueryCoverage =87%, HitCoverage=23%, E-value=6e-12, Identity=29%"; Hit description =Homolog of Homo sapiens "Leucine-rich repeats and IQ motif containing 1
  Subcellular localization annotation: CTP_CleavageSite=46; ConfidenceScore=5.44e-01
RTTRPHLQRTASPHFQRTTRPHLQRTACPHFQRTTRPHLQRASRPRLQRVACPHHQRMSRPHLQRATPLHLQRMSRPHLQRATPPHLQRTTRPRQQRAARPHLQRITSPHFQRTTRPHLQRTACPHFQRTTRPHLQRTACPHFQRTTCPHLQRDTRPRLRRLHVLILRGLHVLAVRGLHALTFRGLHVLIFRGLHVLTFRGLHALGSEDYMSSSSEDYMSSPSEGYTPSPS

SEQ ID NO: 140039 - protein, 95 aa, Glycine max
  Coding DNA Sequence Number=SeqID_48354
MRAGNSVLYGFLEPQSIQRSGQSQFEAESYIKSSKRDVYLGAYLNGPDNYLKGIINSALKGLDGPHPKSKAPARWIVVKCNRQKGSIEFGYYVMQ

SEQ ID NO: 140040 - protein, 68 aa, Glycine max
  Coding DNA Sequence Number=SeqID_48355
  Homolog annotation: Hit_ID=A4EB57; Match level="QueryCoverage=80%, HitCoverage=34%, E-value=4e-16, Identity=70%"; Hit description =Putative uncharacterized protein
VDSRGSPVQHLVWNPEQTAGDKPEEGEDDVKSSCPLCPGRHTCYNGRDKGSRSREGELTPKTRPQFGL

SEQ ID NO: 140041 - protein, 194 aa, Glycine max
  Coding DNA Sequence Number=SeqID_48356
MTRGDTLRLSAPFCHPEAAGPKTRRDKIWSFYTLVSSRGGGPDDTRRYLTVIRTLVSYRGGGPDDTRSTLRLSAPFCHPEAAGPMTRRDKLWLFCTLVSSRGGGPNDTQRPMWSFLHPLSSRGGGPDDMQRYQITVILHPFVNRGGRPVDTRRFTSSSALTRFVILTCDHADGRKYPSGYPYKHSFAICKTERA

SEQ ID NO: 140042 - protein, 46 aa, Glycine max
  Coding DNA Sequence Number=SeqID_48357
MGAANSTQAHLGPPKSNHYASSKLEGGGHMNENAIHAAPKKVDVIP

SEQ ID NO: 140043 - protein, 325 aa, Glycine max
  Coding DNA Sequence Number=SeqID_48358
  Homolog annotation: Hit_ID=Q6WAY6; Match level="QueryCoverage=69%, HitCoverage=36%, E-value=1e-26, Identity=34%"; Hit description =Putative uncharacterized protein
MKQTHNGVVGLPRKYLEGKARDMASQEKWGPFADILALLIFGVVLFPNVDGLVDLASIDAFLAYHHSKESLVVAILANLFDTFDRRCEKNSARIVCCLPALCVWLVSHLFQQDTRYPCPLQSYRSCAEKGRVDWDQHLAGIGGNAINWFPRWKEGKEGVLFSCGDYPNVPLIGTRGCINYNPALAIRQLGYPMRGAPIEESLSPFLVRDLGAQGLKVIQRVHKAWRSPLRKDKELRVIRNGVIGGVATYPSAGGRRVTRGMRVPRKEYARSRHQRLFEENVGKTGKDAIYELLSERFGSCIYARGRVFPFAPTYSSICDEEIRPT

SEQ ID NO: 140044 - protein, 137 aa, Glycine max
  Coding DNA Sequence Number=SeqID_48359
  Subcellular localization annotation: CTP_CleavageSite=70; ConfidenceScore=5.70e-01
KSKPRRFRNLSVTFSVRNFAKVSTVLRRSSFVLHRSSIFNGLSSLGTDVWGANTFPVRKYNSRTFHLKVRRSRLFRFFRRFPQINVGGDSARIPFVEHASRESRVALPPKGRLRQLATPLGTVFRELGHLILCNVLP

SEQ ID NO: 140045 - protein, 225 aa, Glycine max
  Coding DNA Sequence Number=SeqID_48360
MLRRQVVDHGVILDVFTLAGQHAAQRLGEAAAGGILLGHRVDKVLRLKALADPARDALHDFAPVALAVQALFHPDAQLRGAAAQVMRAADADELPVFAPAGDEDHFFAFAHQRQPALPDVGEIFRRRLRLKGHKARQSGGDRLVNIVGVCCGKGGNQQTVGVHAALRKVIMIHLIFPRFSGQNGKKSALINQGGSSILRALAAEATYFSPLGQDGKIGVGDNVTL

SEQ ID NO: 140046 - protein, 146 aa, Glycine max
  Coding DNA Sequence Number=SeqID_48361
  Homolog annotation: Hit_ID=Q6UUU1; Match level="QueryCoverage=41%, HitCoverage=40%, E-value=1e-18, Identity=78%"; Hit description =Putative uncharacterized protein
MPGQSASNTLTRLTGYEVFPWQFQMRGQGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140047 - protein, 28 aa, Glycine max
  Coding DNA Sequence Number=SeqID_48362
MCPPPLSAEPPVTGKCEKEKGETGVAID

SEQ ID NO: 140048 - protein, 145 aa, Glycine max
  Coding DNA Sequence Number=SeqID_48363
  Homolog annotation: Hit_ID=Q1RSH0; Match level="QueryCoverage=88%, HitCoverage=67%, E-value=2e-11, Identity=34%"; Hit description=H+ -transporting two-sector ATPase, alpha/beta subunit, central region, related
MESFGEAGWEWEFSWRRNLFDNELGRASAFIDQATALSPNAALKDYWVWGADPKGIFSTSTAYLCIKGDQPIDYLNCGFSQLWEIKVPPRALSFAWRLLWDRLPTKENLIRRQVVIENDLCPFCQSQVESASHLFFTYKKVMPMW

SEQ ID NO: 140049 - protein, 105 aa, Glycine max
  Coding DNA Sequence Number=SeqID_48364
  Homolog annotation: Hit_ID=A5B939; Match level="QueryCoverage=49%, HitCoverage=33%, E-value=2e-15, Identity=76%"; Hit description =Putative uncharacterized protein
VGGRGGCCRTQGASPGGAVVGADLGGSSKYSNENFEGRRGERFQVNGTAHGLPTLETAQPEVGSSGWKSTARRVVSGAPPAALENPEDRVPPTPGRTHNRIRSPR

SEQ ID NO: 140050 - protein, 144 aa, Glycine max
  Coding DNA Sequence Number=SeqID_48365
  Gene Ontology: Mol. function=transferase activity, transferring glycosyl groups; Biological process=glutathione biosynthetic process
  Homolog annotation: Hit_ID=Q1H4C5; Match level="QueryCoverage=94%, HitCoverage=28%, E-value=1e-52, Identity=74%"; Hit description =Putative uncharacterized protein
  Pfam annotation: Domain name=DUF404; Domain location=4-144; Score= -5.0; E_value=6.2e-15; Accession=PF04169.4; Description=Domain of unknown function (DUF404)
MTQSAKQFFDEMQGYGGNVRAIYQAYKHWLSDVPTQQLAAKRAEAEVLFRRVGITFNVYGEEDGAERLIPFDVIPRMISASEWAHLSKGAVQRVRALNMFLHDIYHDQEIIKAGIVPHSILSNAQYRPEMVGVNVPNQVYAHVA

SEQ ID NO: 140051 - protein, 130 aa, Glycine max
  Coding DNA Sequence Number=SeqID_48366
RDSNFSMTDLVSAEDDVNLRVSTGLSATIDEGRRRRCQSLRAIRLFVLQTAKKNVYTDNHSGISAGQRDSNVSMTDLVSAEDDTAKKNVYTENHSGISARQRDSNVSMTDLVSAEDDDKSPRVNGLVGRD

SEQ ID NO: 140052 - protein, 81 aa, Glycine max
  Coding DNA Sequence Number=SeqID_48367
GKPVVPAALMNPPTRGERRFAYCALAECILAYYVVSDEDTGYIPLPRSLTRYPRSFDCGKRKWLNNGAEISWKMPGRYLTG

SEQ ID NO: 140053 - protein, 130 aa, Glycine max
  Coding DNA Sequence Number=SeqID_48368
  Homolog annotation: Hit_ID=Q6L477; Match level="QueryCoverage=40%, HitCoverage=8%, E-value=8e-07, Identity=37%"; Hit description =Putative uncharacterized protein OSJNBa0009L15.8
  Subcellular localization annotation: CTP_CleavageSite=53; ConfidenceScore=5.86e-01
MGSPPASTPPHPPSPPSPPPPPPPPPSDASASPSSMKQTRKVARLRSLSTRPPGAERPVVHLDPATGKADGPHMKKLRTYLGIVARDKVDITYENWKEVPTTQKDLIWEDIRAEFDIPEASNSRTKRKLL

SEQ ID NO: 140054 - protein, 67 aa, Glycine max
  Coding DNA Sequence Number=SeqID_48369
MWAWERCTTLAPKRTPPVIENTCSSFNFPCGVDVIHANDVRTELLIFLSFFDHRECFRGRIYHLSIL

SEQ ID NO: 140055 - protein, 57 aa, Glycine max
  Coding DNA Sequence Number=SeqID_48370
MTVYVFSMTDYLIKCGGKWDKWADTTGKDSSLDNRYCNCVINSPGIHSNSSKKEWIP

SEQ ID NO: 140056 - protein, 80 aa, Glycine max
  Coding DNA Sequence Number=SeqID_48371
  Subcellular localization annotation: CTP_CleavageSite=29; ConfidenceScore=5.07e-01
MYHDPSFAPNFCKMVTSTPQLDSMNLFVKARAWFNPITQGMAILIANTSSTIHRDARLGNMHAIHGKFEGENARVTHEQT

SEQ ID NO: 140057 - protein, 166 aa, Glycine max
  Coding DNA Sequence Number=SeqID_48372
MGEAEEVQEKMKADMEAMKEQMATMMEAMMSMKKIMEANAVIVAATSAVAKGEPDAPIWPQANESSNLKYETHEIPHHNLDDFEPWLGYTTEGQAVGGIPLQNPLEGPQYHPQLHLLHSTAVKNPHDYGMGKLDHLEERLRAIEGGEDYAFANLEELFLIPKHGHS

SEQ ID NO: 140058 - protein, 195 aa, Glycine max
  Coding DNA Sequence Number=SeqID_48373
  Subcellular localization annotation: CTP_CleavageSite=23; ConfidenceScore=5.13e-01
MYYPGHHQHQSYAEPNVPPVNVLGFMSQHHPSQAQYQSTSFSGHASQGCQQSFQPLGFSSVYTSILIQVPSTSNVFYGSSQMFVITFNTPPSAYNLAPSSSYYRPSLPTQIRDISHEDEDEDEDNNNNNDDDDDDDNGGHHVPQQQRTITRKHPRTRGGRGRRPRGQQAQTNLVQQDERPRRVSRRTRCGTSSHY

SEQ ID NO: 140059 - protein, 275 aa, Glycine max
  Coding DNA Sequence Number=SeqID_48374
  Homolog annotation: Hit_ID=Q2HTA0; Match level="QueryCoverage=72%, HitCoverage=30%, E-value=7e-19, Identity=31%"; Hit description=IMP dehydrogenase/GMP reductase, related
  Pfam annotation: Domain name=DUF1723; Domain location=168-217; Score =52.5; E_value=1.4e-12; Accession=PF08330.1; Description=Protein of unknown function (DUF1723)
MVRTRGLGRALGAGRGRGISEDAHEADVPRRRRPTASARRQRVLLREDVTERPEDVPQLHEDVSHVSDATPEMTGAADAVQTERVATDGSLGSPAADEGFPSGLRDPSILIDFAEHVAHNIWSGQEQPDLKLVSHGRKVDKIGRPAPEIEGLIAGTGLSPLIRCSVITTDPGLISAFVERWHCETSMFHLPVGELTITVDDVASLLHVPITGALHTFEPLVTSDAIGLLTELLEVHHEEATFETRQAGGPHVQLGWLRDLYESQCRARRWVVAAH

SEQ ID NO: 140060 - protein, 64 aa, Glycine max
  Coding DNA Sequence Number=SeqID_48375
MPFRVCFMRSKPLAESLTTVAILLKEGRHPEERLAFGEVPVNRPNSLMSLTVVSRPFQPCTWCK

SEQ ID NO: 140061 - protein, 166 aa, Glycine max
  Coding DNA Sequence Number=SeqID_48376
MDERPRGPGMPPTRHPLDLDKSNKALGFLALITGLYQSFGVPVTPNKVIQPPITRAFIEKYCTPREADGDAPQAADAPPPPHQDGSLGMEHYLQHLVRQQAANHRGQVQIHECLYRFSLSQQGQGFTPFACPTLEQFGDEVAWPGDWPEAQAGEEPAGSPSEAKEA

SEQ ID NO: 140062 - protein, 117 aa, Glycine max
  Coding DNA Sequence Number=SeqID_48377
MIKSRAMLSIIFGMTSICGSCAVTRLLGDAFETMRSTRSCNFVILPHQVAILAYRGQLARCLTAVSISPPSSRMHGESIALVSLVREQVAHFHGGSKCLNNLVGQVASDILKKGELN

SEQ ID NO: 140063 - protein, 37 aa, Glycine max
  Coding DNA Sequence Number=SeqID_48378
MGKVVIIKKGEIVEAKLHDESTMIQRCFDDNNDDNKR

SEQ ID NO: 140064 - protein, 118 aa, Glycine max
  Coding DNA Sequence Number=SeqID_48379
MAKIHHGTAYQQNMLSNEQLNPHTYSQNNLTKAPKFLKDYGDIMVFHLRLGSELQNKERETRLKRAIKGINSRKSIWLEAYENKLASIISKYACELGSINKNLAKAIVQAINGAKHTK

SEQ ID NO: 140065 - protein, 163 aa, Glycine max
  Coding DNA Sequence Number=SeqID_48380
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=31%, HitCoverage=50%, E-value=5e-24, Identity=100%"; Hit description=LacZ protein
MEKTKLFQAPTEPEAPFVSKFQRGEDGLFTFHLMVRGELKAKLCPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 140066 - protein, 112 aa, Glycine max
  Coding DNA Sequence Number=SeqID_48381
EFRNEGLSQATSWIDRELQSIAIEYGRLGYESYEKDFVDMANTHDNNLLSECINSFRRMSTIPMTAFGQINYVDSGHGIWHTCGTTFTDKNGICLISDRHASIKSVVANEAL

SEQ ID NO: 140067 - protein, 31 aa, Glycine max
  Coding DNA Sequence Number=SeqID_48382
MGSSLAYDNGIWGEPYRVVFVIGSAVDRLCG

SEQ ID NO: 140068 - protein, 47 aa, Glycine max
  Coding DNA Sequence Number=SeqID_48383
MASYGGELLLDSKESIDEEDPRPTSSSGAYIMWYQEHFHLGSIIFHS

SEQ ID NO: 140069 - protein, 204 aa, Glycine max
  Coding DNA Sequence Number=SeqID_48384
MTFLGETSSQTIVNSRLGFIFPNESIIHNDSGVYFQTSTPVPIRVPNSCDFASLKTIIHNTLQLTNRQFLDEIHYRQPFTHTGNQIRFQCMQLRNDDDVNTMLMCNDQFSCVGPIELLCTVGRTPDGVINLLERTTTPTHDALLYYNRRWNMPPQNKFVGCAFTGKNPKKFEIPLGCTLDELKDLIKQVALKGIPSHGIHDSQV

SEQ ID NO: 140070 - protein, 72 aa, Glycine max
  Coding DNA Sequence Number=SeqID_48385
GSVFQTHIDPSWEDLRIKTQAIQKQNTAPHVLSRGGYDYLKQKLLDEKTKKKLHSQEVLMASSTLYPQSDAM

SEQ ID NO: 140071 - protein, 72 aa, Glycine max
  Coding DNA Sequence Number=SeqID_48386
  Subcellular localization annotation: CTP_CleavageSite=38; ConfidenceScore=5.19e-01
MDSGRFQISIPGDGCPRPPKVFGRGTPPNACPLVAYPRQGSESARVWSRGTSCVPPWVERHVPNQIGVVGSQ

SEQ ID NO: 140072 - protein, 84 aa, Glycine max
  Coding DNA Sequence Number=SeqID_48387
MHEVATNVYLRKTLEKPKKTKWAKRASIAKRNFSALRAIEESGRASISRSCAKHKISVLSTAVVFSQPQRTIGAKLNVTNSEPI

SEQ ID NO: 140073 - protein, 181 aa, Glycine max
  Coding DNA Sequence Number=SeqID_48388
MATRMVAMMSMKKIMEANTVVVAATSVVAKVNLMPPSDLNQMNHPTSDMVGKDLGSMGDFKPCLGYATEGKAVGGIPLQNTLEGPQYHPQAHLLHSTTSKNPYAMAELGKLDHLEEMLRAIEGGEDYTFANLEELFLVPNIITPPKFKVPDFDKYKEATCPKNHLKIIVRRWGHTQKMRNC

SEQ ID NO: 140074 - protein, 78 aa, Glycine max
  Coding DNA Sequence Number=SeqID_48389
MADALATLASMFQLAPHGDLPYIEFISQGRPAYCCAIEEEWDRKPWYFDIKQYVENKEIGYWFLCKWYHPVQTKPRHD

SEQ ID NO: 140075 - protein, 105 aa, Glycine max
  Coding DNA Sequence Number=SeqID_48390
  Homolog annotation: Hit_ID=Q9M197; Match level="QueryCoverage=76%, HitCoverage=5%, E-value=2e-07, Identity=42%"; Hit description=Copia -type reverse transcriptase-like protein
TIEHPSRKQSDMCGRSPNKAWIVQRDNEAAYLSDVSFAKHDSRTVKKSKGKFFGEAGSHVQFILTNCSPTRSVHEKTPQEAWSGRKPGISHLKVSDYVPNMQENI

SEQ ID NO: 140076 - protein, 224 aa, Glycine max
  Coding DNA Sequence Number=SeqID_48391
  Homolog annotation: Hit_ID=Q6WAY6; Match level="QueryCoverage=97%, HitCoverage=41%, E-value=1e-21, Identity=30%"; Hit description =Putative uncharacterized protein
MTEAKARNLAGKGEWAPFIDIPSLLVFGGVLFPNVDGLVDLAAIDAFLAYHNHKESPVVAMLADLYDTFDRRCEKNNTRIKGWANWDQLLSSKEGASVNWFPRWKEGRTGVLISCGGFPNVPLMGTRGCISYNPVLAIRQLGYPMRGAPLEDELTPVISRGFNKTNMETLQKVRKAWEVFQNKDKELRGSNNGPSMAIEVEALEEDEEVQTLRIELEQAQAIKE

SEQ ID NO: 140077 - protein, 280 aa, Glycine max
  Coding DNA Sequence Number=SeqID_48392
MERSMTNAASGGALGDMTPAEARNLIEKMASNSQQFSAKSDVIVIRGVHEVTTNSSSSAETKKLEGKLNALVNLVTQLAVNQKSAPVDRLYGLCSSAYHHTDLCPFVQQSEAIQQPKAYAANIYNRPPQPQQQNQPQQNNYDLSSNRYNTGWRNHPNLRWSNPSQQQQQQQQQPYFPNVAGPKTRASIQSLTNQMGQLATQLNQQQSQNSDRLPSQSFQNSKNMSAIALMSGKQCQGPQPATSSSSANEPTQLHSTPEKDDDKNLKSKLPNNFYAGESST

SEQ ID NO: 140078 - protein, 150 aa, Glycine max
  Coding DNA Sequence Number=SeqID_48393
MIPGARCRTGCHEHHASEHAVYVCPYEQIKQVITQENCLPSSVQPHLHLGATKPGRKSTLNSVSSRSNNPCFTTFFHLTTIRAESLAAKFRREPSHAHSSCSNVWHTPIVVTIYVKDSTRINSDKDLSNQLHNRDQSLHTQVRQALGNVQ

SEQ ID NO: 140079 - protein, 93 aa, Glycine max
  Coding DNA Sequence Number=SeqID_48394
  Subcellular localization annotation: CTP_CleavageSite=25; ConfidenceScore=5.03e-01
MQKLQEKVQTPLQNLILGLNRWLFRACALSAILNRLVITSGFRLSACFSCSANGLKRCASLDDPLLRVNAQLILLPDSSSRSVEECCAQQMAR

SEQ ID NO: 140080 - protein, 140 aa, Glycine max
  Coding DNA Sequence Number=SeqID_48395
  Subcellular localization annotation: CTP_CleavageSite=33; ConfidenceScore=5.27e-01
SLFSFSSRLKSARNRSLDTHIVPHCFQYCRKPLARTYRTPYTALGSVARRNFTYTLGTRVLKHSWVLKAQSFLREVLLLIEVRGKLQVSCHFVRSHCHCHCLGSRLLGAPVAITSDKDPVIVHNKLLTLLVIILKFGALV

SEQ ID NO: 140081 - protein, 84 aa, Glycine max
  Coding DNA Sequence Number=SeqID_48396
VFVLYRNRKPSWKIPLRLKGSSRCGFSMENNDGLWWLMVALQTKFREDPTVNEGWTTFLPRQLHVAFSRSFIKRLPPEASSWLL

SEQ ID NO: 140082 - protein, 85 aa, Glycine max
  Coding DNA Sequence Number=SeqID_48397
MAQFENSFDSSHSLIQNLRSLSQHIGGYILCGTSRGYIYLGLTENKRGYISCGSVLVEGTSTRFKENKGGYIPCGSLLVNGFLQG

SEQ ID NO: 140083 - protein, 90 aa, Glycine max
  Coding DNA Sequence Number=SeqID_48398
MACHISSEVTATPDYTLSPQLAKRIITCTYLQGPTLSRWNAPGLLRDKHTLRSSCILGEMEVDEPWLGLWLPLNYQVDMGASQHRTLELG

SEQ ID NO: 140084 - protein, 195 aa, Glycine max
  Coding DNA Sequence Number=SeqID_48399
  Subcellular localization annotation: CTP_CleavageSite=46; ConfidenceScore=5.62e-01
MWSSAPFPEMSASSGGDFFKSHKIRRSKSLAFVGRPTRSVILTLRSCDMRRQNLVIPHPFAIQTQSCPMVRRDKNWSFGTLLSSRGGGPDDTRKKKIWSFRTPFANSDTVVVRWHAEDKNLVHSAPFCHPEAADPDDTRRHLTVIPHPFCHPEAAGPMTSRGQCGHSAPFVNYRPTSPLTRGELHHLSHLQDLSY

SEQ ID NO: 140085 - protein, 31 aa, Glycine max
  Coding DNA Sequence Number=SeqID_48400
MSDMNNSGMEKEEREEMPLQGEDESRRSSPP

SEQ ID NO: 140086 - protein, 168 aa, Glycine max
  Coding DNA Sequence Number=SeqID_48401
  Gene Ontology: Mol. function=protein dimerization activity; Biological process=protein amino acid phosphorylation
  Homolog annotation: Hit_ID=A5BND0; Match level="QueryCoverage=72%, HitCoverage=11%, E-value=6e-10, Identity=26%"; Hit description =Putative uncharacterized protein
  Pfam annotation: Domain name=zf-BED; Domain location=45-93; Score =23.2; E_value=0.001; Accession=PF02892.6; Description=BED zinc finger
MDSFEVNVDENDNGSIDVDLHGNVIHEDEPIESKMSKKRARNYSSHMWNFFEKPVMHSDGKVMSKCKYCLKDYVGGDNKNGTSTLQRRMGKCDHDLPFSFIERRRFKELLQYLHPDVKLPSRRVATMNVNNLYESQKKKMKCMLSKVPSRISLTSDVWTSCTSEVIFH

SEQ ID NO: 140087 - protein, 293 aa, Glycine max
  Coding DNA Sequence Number=SeqID_48402
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSIMGKIYNNPIVFIVFIVLSSMNTAQSYPSFKLHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140088 - protein, 141 aa, Glycine max
  Coding DNA Sequence Number=SeqID_48403
  Gene Ontology: Mol. function=3-beta-hydroxy-delta5-steroid dehydrogenase activity; Cellular component=endoplasmic reticulum; Biological process=steroid biosynthetic process
  Homolog annotation: Hit_ID=A7P4W1; Match level="QueryCoverage=62%, HitCoverage=15%, E-value=7e-36, Identity=75%"; Hit description =Chromosome chr4 scaffold_6, whole genome shotgun sequence
MEPMKFWEFVSLVVEGLGYERPRVKIPTFVIMPIAHLVEWIYKLLGPYGMKLPQLIPSRIRLISCSKTFDCSKAKDRLGYAPIITPQEIKYEMLLLNGDISVHQGSYIYSSEHTLIVLLSWCFTHNNEIVIFLARGSAEDN

SEQ ID NO: 140089 - protein, 93 aa, Glycine max
  Coding DNA Sequence Number=SeqID_48404
MWAYVLKTSSKIFELIQRLMNRNEGIVTGVFKVFCLCSVLLGCDSLCCLNVVLLGCCGRMGGLMGTRVVPGDMSRGSGDLGDVRWGAIAQNQA

SEQ ID NO: 140090 - protein, 356 aa, Glycine max
  Coding DNA Sequence Number=SeqID_48405
GLHALTFRGLHVLALRGLHALAFKGLHALAFGGLYALAFRGLHVFAFKGLDVLTFRGLHALTFRGLYVLPLRGLHVPALRGMHALTFRGLHVLTFRGLHALAIRGLHVLVFKGQHVLDFRGLHALSPLEGYVSFLLSAPGPPPDPGIGPTMRAQSEEEAIAQLLCIPGQDFTQTAVGRRIWMTLLLINVLPSDHNSDLPPPKCQLVYAILTRMSVHVAQLIDDAIYLFARLAPTRHPLDLEKSKRALGFSALIRGLCQSYGVPVTPSKVIRPPITRAFIGKYCTPRQVQGDAHQATGASPPPRQADPAGPLGVERYLQHLVRQQAANHRGQQFGAEVTWPGDWPDAQAGEDPTGSP

SEQ ID NO: 140091 - protein, 276 aa, Glycine max
  Coding DNA Sequence Number=SeqID_48406
  Gene Ontology: Mol. function=fumarate hydratase activity; Cellular component=tricarboxylic acid cycle enzyme complex; Biological process=fumarate metabolic process
  Homolog annotation: Hit_ID=A6T8M7; Match level="QueryCoverage=100%, HitCoverage=59%, E-value=1e-127, Identity=83%"; Hit description =Fumarate hydratase
  Pfam annotation: Domain name=Lyase_1; Domain location=1-152; Score =67.8; E_value=3.6e-17; Accession=PF00206.11; Description=Lyase
DATPLTLGQEISGWVAMLEHNLRHIEHSLPHLAELALGGTAVGTGLNTHPEYAVRVATEQASLSGLPFVTAPNKFEALATVDALVHAHGALKGLAASLMKIANDVRWLASGPRCGIGEIAIPENEPGSSIMPGKVNPTQCEALTMLCCQVMGNDVAVNIGGASGNFELNVYRPMVIHNFLQSVRLLADGMESFNEHCAVGIEPNRERIDQLLNESLMLVTALNTHIGYDKAAEIAKKAHHEGLTLKAAALSLGYLTEAEFDSWVRPQDMVGSLATR

SEQ ID NO: 140092 - protein, 136 aa, Glycine max
  Coding DNA Sequence Number=SeqID_48407
VAVSLEKPPPKPNPEVDDPLYLMTLTIPELFLRPYQVTWDATVFEVFNPDFPLYIKHKDLSEIAQGGQCLSISVLQLWILHLTETSMRVGNSDIYGFLEPQSIQRSGQSQFEYESCIKTWMQSSKRDVYLGAYLNG

SEQ ID NO: 140093 - protein, 214 aa, Glycine max
  Coding DNA Sequence Number=SeqID_48408
  Homolog annotation: Hit_ID=A7Q2G2; Match level="QueryCoverage=77%, HitCoverage=60%, E-value=5e-13, Identity=24%"; Hit description =Chromosome chr1 scaffold_46, whole genome shotgun sequence
  Pfam annotation: Domain name=zf-CCHC; Domain location=23-40; Score =29.8; E_value=1e-05; Accession=PF00098.14; Description=Zinc knuckle
MRGNQRRQNFKPKRRTEESSQIPKCFECNQPGHLRADCPIFKRKIEKSEKKTIGDKKAKKAYITWDDNDLETSDDSEKEMVNLCLMGKNYESDEEVTSSNKSISFDELQDAFAELHSESIKLAKLVSSSKKTISELEKEISKFNKEIDILKTEVSISKSSDKDYVSTMTNEKNKCTFMDKILKEEVKSNDELPKEWKASKDHPLDNIIGDISKG

SEQ ID NO: 140094 - protein, 70 aa, Glycine max
  Coding DNA Sequence Number=SeqID_48409
MKSCIRLLRRAAKRTPPWRPTGRCSCNAGWASKCDRRLPKQVVAAAVAGQARAVGGRRADQGAALLVQAR

SEQ ID NO: 140095 - protein, 254 aa, Glycine max
  Coding DNA Sequence Number=SeqID_48410
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPHCVLNFMTKFTDLLVAGMIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140096 - protein, 225 aa, Glycine max
  Coding DNA Sequence Number=SeqID_48411
  Gene Ontology: Mol. function=motor activity; Cellular component=cell projection
  Homolog annotation: Hit_ID=UPI00016621D1; Match level="QueryCoverage =96%, HitCoverage=40%, E-value=4e-18, Identity=32%"; Hit description =UPI00016621D1 related cluster
  Subcellular localization annotation: CTP_CleavageSite=49; ConfidenceScore=5.09e-01
MSSPFSAVHVLTFRGLHILAFRGLHVLTFRGLHTVTFRGVHVLTSRGLHAVTFRGLHVLAFKGLHVLAIGGLHVLTFRGLHSLTFRGLHALTLNGLHVLGFRGLQTLAFRGVHALAFIGLHTLTFRVLLVLTFKGLHVLAFRGLHVPAFRELHVLSFSGLHVLSFKRLHVLAFTGLDALTLRVLNVLAFLGLHALAFVGLHALPIRGLHVLTFRGLHALTLSGLH

SEQ ID NO: 140097 - protein, 97 aa, Glycine max
  Coding DNA Sequence Number=SeqID_48412
MQSREEATDISSLSAQVTNITGLSGVTRSGRVFPPPDLPTQPANVKGKAKVVEEQNDNTTLTPNKDIPVKGLPEKRDGCGKKEVSLEEASEFLRIIQ

SEQ ID NO: 140098 - protein, 47 aa, Glycine max
  Coding DNA Sequence Number=SeqID_48413
MEDIHGEYDEEQGIKIMAVEWRRKKDDWRHHFKEKMSQEEAHHHRMP

SEQ ID NO: 140099 - protein, 78 aa, Glycine max
  Coding DNA Sequence Number=SeqID_48414
MAFSRGALVLTNMDGEELPLPVNSNVVKVQDKNQEEFKTQEESLETRIKIQGSRSQESRSRFKTQDSRLKRRLNQDKY

SEQ ID NO: 140100 - protein, 196 aa, Glycine max
  Coding DNA Sequence Number=SeqID_48415
MASIQHMVIVNRNIRPIIYRIKPDLNRTSKETTKATKKNTEASIKHLEVQVGQLATQLSKHGNGSFSANTQVNPKEQCNSITTRIKELKKKKEKNDEVVTNEKVEEKGLSKEEKQKSKKQATNKGISNKITTPPCTYTTYIITMHFQHHQHFISMSLSTSALSHLNVILNINIISSQYHSQHQHHFISMTLSMITT

SEQ ID NO: 140101 - protein, 120 aa, Glycine max
  Coding DNA Sequence Number=SeqID_48416
MTLSTTTTSLRINIITYEFKVINSNINRVQQQATAAYGSHWWSWVVKNERNPLCVRAGLAYPWVLSATSSLVGIGLSAPQSAQRNFLSVGIVLSAPFAFSKEQNLCFSKSQRSGCGNMAC

SEQ ID NO: 140102 - protein, 163 aa, Glycine max
  Coding DNA Sequence Number=SeqID_48417
  Subcellular localization annotation: CTP_CleavageSite=41; ConfidenceScore=5.63e-01
MAESSKKRKGSSSTTTAVGHRRHGPSGAPTTPIHPSLSSPRSSTLFSSDDQRQRYSSQFCNRVILNPKYLDIDFFYGETFDCYQADMTDRLLAGSLTFDCRIMHYIIVQILLPHSSNLAQASEEDLILMWAFLIGRQIDWAHLIRYRMRKALRTNAPLPYPHL

SEQ ID NO: 140103 - protein, 157 aa, Glycine max
  Coding DNA Sequence Number=SeqID_48418
  Homolog annotation: Hit_ID=Q69F85; Match level="QueryCoverage=50%, HitCoverage=4%, E-value=2e-08, Identity=41%"; Hit description=Gag -pol polyprotein
MSLKGATLTWYERLTLWSLGSFDTLVECFSSQQVRGHQEDHQKVETLIEGGTEQRIDGERQAQQEQDDEPAQQIRGVINTIRGGFSHGGLSSQSQKRYLHAIKDIDVNCVDMQSPRSLPPITFTYKDFKGINTINQDNPIVVSIVIANFMGSRVLID

SEQ ID NO: 140104 - protein, 236 aa, Glycine max
  Coding DNA Sequence Number=SeqID_48419
  Gene Ontology: Mol. function=protein domain specific binding; Cellular component=cytoplasm; Biological process=response to stress
  Homolog annotation: Hit_ID=A9NKY2; Match level="QueryCoverage=29%, HitCoverage=26%, E-value=2e-23, Identity=75%"; Hit description =Putative uncharacterized protein
  Pfam annotation: Domain name=14-3-3; Domain location=1-180; Score =1.3; E_value=0.0017; Accession=PF00244.11; Description=14-3-3 protein
MLARARPIGSPGRCRSSGNKDQVTVIRDYRSKIEAELSNIYNGILKLLDTRLIPSATSNDSKVFYLKMKGDYHRYLAEFKTGADHKEAAESSAYKAAQVCFCFLSVFSILFFIFEVHYLFRMRSSLEAFVRRLLVVRKDLFLEDVGDSPKSENVECASNVDDEESIVPLGIGFSDTAFENCEAPSPNYILCLLSALLTSIGKQAGISSEAATAAALKVGKRPENAGKLIGDLEGWE

SEQ ID NO: 140105 - protein, 43 aa, Glycine max
  Coding DNA Sequence Number=SeqID_48420
MENKVDFNDNRSVDPERYTFNLTGTEPISLEDKRKVGHHASIT

SEQ ID NO: 140106 - protein, 197 aa, Glycine max
  Coding DNA Sequence Number=SeqID_48421
  Gene Ontology: Mol. function=phosphoprotein phosphatase activity; Biological process=intracellular signaling cascade
  Homolog annotation: Hit_ID=A5C0F5; Match level="QueryCoverage=38%, HitCoverage=11%, E-value=4e-14, Identity=51%"; Hit description =Putative uncharacterized protein
  Pfam annotation: Domain name=DUF1723; Domain location=116-165; Score =60.8; E_value=4.5e-15; Accession=PF08330.1; Description=Protein of unknown function (DUF1723)
MFSPAASPPPVVVLKNCAVVAWEDREATAMSGQAFKSGSSDIVSGFAAAEAFWMHQQVDAVNVTVTFPLKPENQYPSIVSNPGKSIRHVKAGAQYNGELTCGIELLCQQICIIDCYRYSGAITFCRYRRRPETHTFHLMYGEATITLQDVSVLLGLPVDGNPLIGSTNIDGIDMCEQYLGVRPNANALSDGNTLKLS

SEQ ID NO: 140107 - protein, 235 aa, Glycine max
  Coding DNA Sequence Number=SeqID_48422
MDKVDIIGGDYCSQCLMKGIVVMKDGFKKCHHKVSTLDDLASCLDKMTLLAEEDDRIIEAREKAPPSTQGLGRRRESVDAEAHVIPAMPEQQHGMYYTPDQFTQESSQMSPLYPYPYQSETSSDAYFMGMQPPLQPGYVTTDLFGSPSPAGTPSFAHGCQISTPNAPMGPPWSVSENIPNITDLLGVDLGSLQSISFLNRVDLGLPFIRIKLGSGTSVHDSSDGGIESSFPRGHH

SEQ ID NO: 140108 - protein, 222 aa, Glycine max
  Coding DNA Sequence Number=SeqID_48423
MKGRKERKTLQIWFVKGIACCCSNQSSTSTGLTVPMGAPTVIWLVTIVFDGGASRSWWFGSWVVGGVSGWRAGGGVVVLGGLSDVGLIQASGVVVFGGAMVMDVGGRKAATREREREVLEQETFFSIWLHRGGEGVAIWQHCHIVLHRESGKGKGGKRKKKEKEEGEREKGTCREEEKKEEGERGRGTVTKTGEEKDEEENFFFKKIKIFQSRICVFYQKVI

SEQ ID NO: 140109 - protein, 106 aa, Glycine max
  Coding DNA Sequence Number=SeqID_48424
MTGMLEVVSNPWRFTVGNWLCDSDLVSPTGIERVLTKKDLLADSYSDLEASILDEKEFLLLKIYSKVMFILCFGYLSGFIQRSLFKYTCYCFLTGRGNIDEQSGKG

SEQ ID NO: 140110 - protein, 224 aa, Glycine max
  Coding DNA Sequence Number=SeqID_48425
  Gene Ontology: Cellular component=integral to membrane
  Homolog annotation: Hit_ID=A7PI10; Match level="QueryCoverage=70%, HitCoverage=31%, E-value=1e-18, Identity=36%"; Hit description =Chromosome chr13 scaffold_17, whole genome shotgun sequence
MARAWVKHDTWYIEGMVGYERGNVNIHGYEHATEGGNLMKTIVNQTRQMLESVLLVEGTKALKKMKNSASESGLYIIESDEDVEKDMQKDENDGNDSDYSNDSNGNLSMRKPSNYSIAWPQSYRQSIDLYGSVPSPNIGFLGTTSLSRLSSSFISSSLTRRHTLEVLQPEKKPLLQPTEEEQPRHTLLPPQISRKSSIKISKVSHEPHIPGQCTFGQAVLNGKY

SEQ ID NO: 140111 - protein, 104 aa, Glycine max
  Coding DNA Sequence Number=SeqID_48426
MVKIFDVTLAKNAFGRFQVKGPLLQSSYDTIEMAEVTVDRDCRPRYHRRKSIRIYVWMVRTGRLMRILKLAKYMLKAQVEKDEGPSGEGQSPRVEKDEGPSGEG

SEQ ID NO: 140112 - protein, 313 aa, Glycine max
  Coding DNA Sequence Number=SeqID_48427
  Gene Ontology: Mol. function=structural molecule activity; Cellular component=parasitophorous vacuole
  Homolog annotation: Hit_ID=P04927; Match level="QueryCoverage=71%, HitCoverage=73%, E-value=1e-14, Identity=31%"; Hit description=S -antigen protein precursor
  Pfam annotation: Domain name=S-antigen; Domain location=33-245; Score= -250.0; E_value=0.028; Accession=PF05756.2; Description=S-antigen protein
MIGEGSVEGSNESVDSVNMLNIEVASLTATTDSVTTMVAAKEEVKQGVADDLNSTHSTPLENQAKPSNGSVEREAEPSNGEVESEAEPSQGAVHSEVEPSNDAMEGEAKPSQGAVETKAEPSQDAVESKASLSNGALNREAETASGAMESEAKTSSGAVETEFKPSHDVVESEAKPPNGVAETESEPSVDVCQTKKDVVNSKAETSSGALQSEREACVMSEMKNNAVESEAQPSVDVNHKKTIAINSEAELSVKGGLFVESEGSNQGDEDSRLASDALDGQNVGTKVVKNPFYYLIRVPRYDDDENIKTLFTK

SEQ ID NO: 140113 - protein, 188 aa, Glycine max
  Coding DNA Sequence Number=SeqID_48428
MVGAFSQNIVTLTGLPMILLSESDLTNPLCEGVTASSSSSTSISQQQVAEIIGSLKEEWRNEFEEENKQSLEILKQELKDAIIIEMSQKGSQFSVPIEADIHVLGARVSTKGSNVETGVNPFGEEHVAHVISTMGLYVQHQHSTQLVALGKIYEGGSTILGVAYVDDDVRVSVEKVIDGDAEVPLPTS

SEQ ID NO: 140114 - protein, 131 aa, Glycine max
  Coding DNA Sequence Number=SeqID_48429
  Subcellular localization annotation: CTP_CleavageSite=64; ConfidenceScore=5.63e-01
MRVRSAPRARRWTPSIGFSTTRSAPASLPQSSGSRCARCYPRRTTRRLRRHGLIAGVSGGGGTQAEYARALAYLIADPNVSMAVLGRPHAVLSLLRRWWAFGLPHLPQRHDEAAEVTTNARMREIEWYTGQ

SEQ ID NO: 140115 - protein, 163 aa, Glycine max
  Coding DNA Sequence Number=SeqID_48430
  Homolog annotation: Hit_ID=Q6L477; Match level="QueryCoverage=65%, HitCoverage=17%, E-value=2e-11, Identity=31%"; Hit description =Putative uncharacterized protein OSJNBa0009L15.8
MASPPASPPPPLPSPPPPPPPPSDTLASPPPGADRLVVHIDHTIGKADDPHRKKLRTYLGIVARDKVDITYKNWKEVPTTHKDLIWEDIHAEFEILEASDSRTKRKLLQTVGERWRQFKSDLTRKWNLAADHDGVDDTVCEKYGISKEKWAQFFQTRRDPSWE

SEQ ID NO: 140116 - protein, 172 aa, Glycine max
  Coding DNA Sequence Number=SeqID_48431
  Gene Ontology: Cellular component=Golgi apparatus
  Homolog annotation: Hit_ID=A9P9S5; Match level="QueryCoverage=61%, HitCoverage=24%, E-value=5e-39, Identity=71%"; Hit description =Putative uncharacterized protein
MGNQELLDCLCDYAAFKAQHLYGPQGHRGMSALIFEESTAGGKRQLYGYLASKEDLYIFNKYSRAMYGSLELQQETHDLVDSMVERLRTLSRKSDGQFIVMDLRVEMLDKKGCQGRDSEKEKSCFNAQEVAVFLRKIGFEKDTTIYVTQSMWDESLDSLKDLFPKTYTKVKH

SEQ ID NO: 140117 - protein, 78 aa, Glycine max
  Coding DNA Sequence Number=SeqID_48432
  Gene Ontology: Mol. function=oxidoreductase activity
  Homolog annotation: Hit_ID=Q5QET8; Match level="QueryCoverage=80%, HitCoverage=72%, E-value=9e-12, Identity=59%"; Hit description=Auxin- induced putative aldo/keto reductase family protein
MDCMQRAYPHAPYIGTTKIKILNQNMEALTVKLSEKDPREISKAVPIGDVAGGRYYNRLDHFSWKYANTPPKDSKIST

SEQ ID NO: 140118 - protein, 347 aa, Glycine max
  Coding DNA Sequence Number=SeqID_48433
  Gene Ontology: Mol. function=oxidoreductase activity; Cellular component=integral to membrane; Biological process=electron transport
  Homolog annotation: Hit_ID=A7P9K1; Match level="QueryCoverage=26%, HitCoverage=26%, E-value=2e-27, Identity=46%"; Hit description =Chromosome chr3 scaffold_8, whole genome shotgun sequence
LVVETIPVSLMHLHLYDRWLASLCFSAGAGFEDPFLQVRAFALEGLLGFYECDRESSDVVFLLAKPSSLALVAVEEMVYIKATDEKSAEMVTDEGIGYDVFEFVSLNFAVVLVSLSTFDNYRDQLKENYCIVEKGYNSFPNRIPGTAYSKALLRDLLGHFLNYKDEKGQMLSGDQIANNVIGAEQMAVYEANEGGKMPLTWGQTRNMPITHRPRRTMNIEVNDQELDGHNTIVLKAPTHAGRGGGGEDGGEVVVDVAAGVDTDDGQSKRLKGDDANDGRCKKESDIDRDCERSAGRHKSERERNRERRNEIVDNKNRWRRQARACVTSVRSIQVKLPRGVMLTWVRD

SEQ ID NO: 140119 - protein, 37 aa, Glycine max
  Coding DNA Sequence Number=SeqID_48434
MTKDLYRWFITLGKHEDATWKIMVYSLSYSGHNNSKT

SEQ ID NO: 140120 - protein, 37 aa, Glycine max
  Coding DNA Sequence Number=SeqID_48435
MVAHQSELRLTPEVTGSPEDFESYGSIKTEDFESYER

SEQ ID NO: 140121 - protein, 135 aa, Glycine max
  Coding DNA Sequence Number=SeqID_48436
MAVKVYKRNFVKLVSILSISSSSHTFKGGAVEAAGGEGASNSNGNSKTAAFKGGAVEDAVAAFFQSLLLLIHENGERAFSATLPAASSRSLGSMFNFNSLLATTDSLNSEWEAMEKENEEMERKKREEELIHERK

SEQ ID NO: 140122 - protein, 109 aa, Glycine max
  Coding DNA Sequence Number=SeqID_48437
MRNKKKGSKSRKEHINLLVWATEWRLIPKTRENGKIDRLYIHKEYEIKCRSLKEVKRYESQWKKELMTNKGKNKKMHGTEKQIKGFGAVDELVIQEALAIDSSDKPGLG

SEQ ID NO: 140123 - protein, 189 aa, Glycine max
  Coding DNA Sequence Number=SeqID_48438
  Subcellular localization annotation: CTP_CleavageSite=29; ConfidenceScore=5.70e-01
MGPPPRGSHRPLAPLAPSANRRSARRSCRSGGKGQCGAQRALRRRILTSTSIGEERRESAVKTVNNNCLAQTELDLLPKFKGKLVPNDVVYCCCNILSVSSSSHTFKGGVVEAAGGEGASYCNGTSNAAAFKGGSVEDTVAAFFQSLLLLIQENGERAFSATSLAASSQSLRSMFNFNLLLRTTDSLNS

SEQ ID NO: 140124 - protein, 108 aa, Glycine max
  Coding DNA Sequence Number=SeqID_48439
  Gene Ontology: Mol. function=transcription factor activity; Cellular component=nucleus; Biological process=regulation of transcription, DNA-dependent
  Homolog annotation: Hit_ID=A7NUI9; Match level="QueryCoverage=73%, HitCoverage=34%, E-value=3e-20, Identity=62%"; Hit description =Chromosome chr18 scaffold_1, whole genome shotgun sequence
MGEELSGLGIKELGNLENRQEMSLKDVHMKKDQIVIDELKELHQKGSLFHQQNVELNRKINFIRKENEKLQKVYKRHSVYFRICIVKNPRHRQAKQRERQLEAKNVIC

SEQ ID NO: 140125 - protein, 379 aa, Glycine max
  Coding DNA Sequence Number=SeqID_48440
  Homolog annotation: Hit_ID=A7Q8I3; Match level="QueryCoverage=59%, HitCoverage=33%, E-value=2e-47, Identity=46%"; Hit description =Chromosome chr5 scaffold_64, whole genome shotgun sequence
  Pfam annotation: Domain name=WD40; Domain location=144-183; Score =10.4; E_value=1.6; Accession=PF00400.23; Description=WD domain, G -beta repeat
  Pfam annotation: Domain name=WD40; Domain location=187-242; Score =11.5; E_value=1.2; Accession=PF00400.23; Description=WD domain, G -beta repeat
  Pfam module annotation: Pfam domain module=WD40::WD40; Domain location=144-183::187-242
MVEHLKVGSKASRQEASLFCVANGFPVRTLSLCKHQLLVGWGMASTDVRGILTAFNPSLDFFAITTGDGRVKGQVHTEFADITSTHSTATTLHHKSSINGHLALDYTCIKWFSFEEKRKRKHISSLLVLGTGGGDVLALDVASAQLTWRLTDCHPGGVRVIASSANVSSIYTAGVDGMVCVIDFMTGNLLEKFKASTKPVSCMSVSPGIITTVLITDLAIASLLKSDGNTLATAAAQLKIFNCSNHKKIQKFSGHPGSLTVVVCDDVINLMAFKDGQHRRRHNLVLRRSFGNNRRRKIHNSNTAVNSPVVEVTTDYDGHEDTTVVEVTTDYDETVLILLRSRNNTVVEINVFYDGCMAWTVVDLYSYYYGLLLPTTVVK

SEQ ID NO: 140126 - protein, 693 aa, Glycine max
  Coding DNA Sequence Number=SeqID_48441
  Gene Ontology: Mol. function=pyridoxal phosphate binding; Cellular component=mitochondrial matrix; Biological process=arginine metabolic process
  Homolog annotation: Hit_ID=Q38IW9; Match level="QueryCoverage=13%, HitCoverage=20%, E-value=2e-45, Identity=95%"; Hit description =Ornithine aminotransferase
  Pfam annotation: Domain name=Aminotran_3; Domain location=471-693; Score=-105.6; E_value=5.2e-08; Accession=PF00202.12; Description =Aminotransferase class-III
  Subcellular localization annotation: CTP_CleavageSite=29; ConfidenceScore=5.08e-01
MTQGSFVPHGRDDILNMAIGKPEHLGRVRAAGSGMTLTQFYGRATRTSSSSSATLMQQQWVDIIGNIKEQVRNEYEEQHKRSLEEFKKELSSQIFIQLSQMGSQYSPLIEVDLQALAARLSTKGSNVETADVDPSGDKNVSLKPTMGLYVQRQHTTVLVALGKICEGGSAIHNVTDADDVVRVSVDKVIEGDAKVPFPTSEIQYESDTSPKKLPETNERGTNDFDHDPLHQLIKSLYFMYDTPVELKWDGSKFELSNVDASFFLTFSDVNEIVAGYKCLNISILQLWMFINFYVYFIKADFWMSGAQLWVMLPCMDSLSHNRYTMQRINVLNVSITYKHDSRNRNERGHWQLVVLCPATNVVAWFCSLHVDHAIIISSAMKSTNTTADGTNNPATPKWIEVKSHVQSGGYECGYYVMHWMWNIVSGGLKNDWSMWFLDGTTLDNETITTIRQKWAAYFLKVQSNQCTKWNDIKQGKTLRFRVNDGEDSYTTLPRIDPSVTQRIPTQHGRIAGPRQTTPKSVIHQICYIILFSVLYDVGGVISLSCDNEATRGFGPLLPGNLKVDFGDVEALERIFKEKGEHIAVFILEPIQGEAGVIFPPDGYLKVVRDIGSKYNVLMIADEIQTGLARTGKMLAYIAHVYSKFIGPLPGSPDEFVASINKCFPHIVDTIILLNTNLMFQEKMKRSRKSLASA

SEQ ID NO: 140127 - protein, 1182 aa, Glycine max
  Coding DNA Sequence Number=SeqID_48442
  Gene Ontology: Mol. function=DNA-directed RNA polymerase activity; Cellular component=cytoplasm; Biological process=keratinization
  Homolog annotation: Hit_ID=A5BPP1; Match level="QueryCoverage=94%, HitCoverage=70%, E-value=0.0, Identity=43%"; Hit description =Putative uncharacterized protein
  Pfam annotation: Domain name=KIP1; Domain location=1-52; Score=85.2; E_value=2e-22; Accession=PF07765.3; Description=KIP1-like protein
MDAKVKQMIKLIEEDADSFARRAEMYYKKRPELMKMVEEFYWAYRALAERYDHATGVIRHAHKTMAEAFPNQFPMMLTDDLPVVSPTETEPHTPEMRHPSRAFLDPDEPQKDASAHFHAIKRNGGYTGEPDSPLNKIGLKQLNDLYISGEQENIPNNEQNSGSNNTLSESERVTKAETEILALKKAIAKLEDEKEAGLLQYQQSLEKMSNLELEVSTAQENSRKLDERASKAEAEVQALKEAQIKLQAESEASLLQYQECLEKISNLEKNISSLQKEAGELNERATKAETETESLKQELARVEAEKEATLVQYNQCLETISKLEERIKEAEENARRIKEHANIAEKEIEALELQVTKLNEEKEDAALHYQQCIVQNRNVFSWRHQITLCSQNYNLWHKKWGLKVKNLMRSSRNWVDFGVAYKRRDCDSLRLKLLFKLFSSCILSLRKSLDLLLLKLNSKVEIMGNVESHKQALEDEVHRDEILNLRETIEKVEQEVELRIDERNALQQEIYCLKEELNDVNKKHEAMIEEVRSTDLDPQCFGSSVKKLQDENLKLKETCEADKGEKEALLVKLETMEKLLEKNTVLQNSLSDLNAEVDSVRGKVNVLEETCQSLLVEKSNLAAEKATLFSQYNPQLKRLRVKSKVLEDTCRSLDHEKSSICQEKETLVSQLNITHQTLKDLEKLHSELELKHLEVKGERESALQKVEELLVSLYSEREENSKVLKLNEDELAEKELQILILQEDANCKKKEYEEELDRAIHAQLEIFIMQKCIDDLEKKNLSLLVECQRLLEASKMSDKMISKLETENVQKQTLDNNSGHFGEDMLEEGQMLLNHIYGKLQERQKSFDTIFNGSQQMAIENSILITFLEQLKLKVKNLVTQRDTLDEEFNIQSKQFLALQTEVQKILQKNQELELTISKGEERMEEDSCKILEEKKSLTRRFLDLGEEKSNLEEEICVMIHEAIAQSNLSLIYENIIFEKLTELKELGEDLDKHCSANNDLDERLRIRDEREMLHLKENELLEAVEMFHVLHTEKTELQRMVEDLKIKCDEARVMLEEQANQILKLSSDKDHQNEELICLSEVNQKLESKMGYLRQELGETKLREKKLGDEIRQIKAHISELNLHAEAQAMEYKQKIDKTSQTISHPMHELQMQESEDEDEVEDEYYHDEDDGSEMSTDDES

SEQ ID NO: 140128 - protein, 70 aa, Glycine max
  Coding DNA Sequence Number=SeqID_48443
PVRNRKKGSKSRKEHINLPVWATEWRLIPKTRENGKIDRVGLGGLGFGAVDELVIQEALAIDSSDKPVLG

SEQ ID NO: 140129 - protein, 94 aa, Glycine max
  Coding DNA Sequence Number=SeqID_48444
ILSVSSSSHTFKGGVVEAAGGEGARNCNGNSKAAAFKGGSVEDAVTAFFQSLLLLIQENGERDFSATSLAASSQSLGSMFNFNSLLATTDSLNS

SEQ ID NO: 140130 - protein, 132 aa, Glycine max
  Coding DNA Sequence Number=SeqID_48445
MAFGGLVARPVELELAQADETETDYHCVHDELAADFEGHDGGCGRLQRSWQGLIATEWRRRRVERRRHFKEKMSLEEAHHHRKQWIRAWRLTKRHCFQEKPPQAFGMVSLMAEGTARSHCKEFQGEKFNLDK

SEQ ID NO: 140131 - protein, 116 aa, Glycine max
  Coding DNA Sequence Number=SeqID_48446
MAKENEEMERKKREEELIHEREWEERMNCKRLEWKKRVDEAGMVFILTYHNFSIQSEDLPHEFAYMDKDLPHRHMTNSGNWILTAETYLHNGCKDRDYFLHFKKIGTNFQNGRVQR

SEQ ID NO: 140132 - protein, 140 aa, Glycine max
  Coding DNA Sequence Number=SeqID_48447
  Pfam annotation: Domain name=Transposase_23; Domain location=23-93; Score=-4.2; E_value=0.0034; Accession=PF03017.5; Description =TNP1ENSPM transposase
MSRYKTIYTKGSCVDPSGNDPETGDSDRCGLYIEADLARLVAMGRVYEGSTIVHNTPLLPGQVKVSVEEVTDADTPVPVSTDGVSLVGQALHTFLAWLTHLVVVSPAKPPPKPDPEVDDPLYLMTLTIPELLLRPYQASH

SEQ ID NO: 140133 - protein, 122 aa, Glycine max
  Coding DNA Sequence Number=SeqID_48448
MDVLDGAASAVGSSVGMVGTGVATGAGLVGIGIGAGAGLVGTEIGAGASLVGSGIGAGVGFVSSGLGVVGSGLSRARMFMERTITGQGDLISSVMLSTSSRELIRRDPNHPDYGINISIRYG

SEQ ID NO: 140134 - protein, 229 aa, Glycine max
  Coding DNA Sequence Number=SeqID_48449
MHGKGTQSEIVKYETAGTLTKNTSIKRERGLSNSIAKEVPCHKHQLRNRILISKYKGWRGLDQGPQKHYFSTWWADLKSINEHQSMIDASNQFCWKMGRGDQILFWEDAWAEDGIPLKDQFPDLYRISSQRNHIVAYMGSFSESKDTCICWSWDNIMLNIKFQTHITTILNIMVKQVFWFWVLLCSSSLLSFSPSYAPVDTDMAGLPSSPPILISNGSDSPITCSPSFP

SEQ ID NO: 140135 - protein, 90 aa, Glycine max
  Coding DNA Sequence Number=SeqID_48450
MFLIFNTSALKGLDDTPQLKSKAAARWIVVKCNRQKGITECGYYVMHWMSTIILGSFMNNWETYFNEVRSIGSREIQGASLPVGTVLSKS

SEQ ID NO: 140136 - protein, 85 aa, Glycine max
  Coding DNA Sequence Number=SeqID_48451
MEVVADCEGHGRQALAKRDTQWLSVRKNPEEDELSSSLSTPLQVVKHTASAYSLSERSALSQNPLMRAKPFSFALSARARANPPI

SEQ ID NO: 140137 - protein, 146 aa, Glycine max
  Coding DNA Sequence Number=SeqID_48452
  Homolog annotation: Hit_ID=A7Q0Z5; Match level="QueryCoverage=31%, HitCoverage=5%, E-value=7e-12, Identity=69%"; Hit description =Chromosome chr7 scaffold_42, whole genome shotgun sequence
MEGLQLQQWLMFATSTVAHGDHSVLICFLPNLVEDSCMDDKSSNANGVTTGSPVPYLSTPPRPPIFTSPVRPAVVLFRTSLASPQPLAFSFTSSLPTSSSLLQFSNGSFESNTKFLIETCHMGYRMKKEKVEEAGVLLSEAYALSE

SEQ ID NO: 140138 - protein, 59 aa, Glycine max
  Coding DNA Sequence Number=SeqID_48453
MDPKKLSANRSRRDATAEGTSAAPEFDSHCFRSAEHQQCFEAIKGWLFHRERRVFLRDE

SEQ ID NO: 140139 - protein, 133 aa, Glycine max
  Coding DNA Sequence Number=SeqID_48454
MEETNLESDKSTCRKTQLARVQTQPMNRGRNEADVTFVQRPLGSQKGTKCHVELRGEIHVQSPPNLSQKNDDLRLVNRWIVVKFEYHESHKDSISGGFNLFFVSLTFENSIGAVGGITEGISGELLEMLLSLS

SEQ ID NO: 140140 - protein, 105 aa, Glycine max
  Coding DNA Sequence Number=SeqID_48455
  Subcellular localization annotation: CTP_CleavageSite=51; ConfidenceScore=5.40e-01
MTWSWEHHPVSPPQSNLQSEATSRNTRKSTRLQRFTAKFDILEALNAKKKVMSTVASRWRQFKSNLATKFVYGDSKGQHDHDHSVKYSLHKETWEEFVASRKTPN

SEQ ID NO: 140141 - protein, 276 aa, Glycine max
  Coding DNA Sequence Number=SeqID_48456
VINGDAEVQFPTSEIKDVRQALHTFLAWPTTLVKLASNEHEGTSPSKVTEAVQLMNDVVVDDLLRELIKTLVDIYEKPVQLVWDVTKFGIPNAVASLFITCADVIEIISGVQCLNIAILQLWTMYMDDWSKNLGLGSMYGFLEPQAILNSKDRRRQCEEYIEKWLKESNRDVYLGAYLNHAFKRLKTSTEGKFHTSTLRWIEVKMYILQVETGSNDPSVPQFGVFNKLIGWDFLCLLVSWLVWYSMNDRIYELGSLSPFVLVFAGHVALYCKIRKP

SEQ ID NO: 140142 - protein, 595 aa, Glycine max
  Coding DNA Sequence Number=SeqID_48457
  Homolog annotation: Hit_ID=Q6WAY6; Match level="QueryCoverage=37%, HitCoverage=45%, E-value=4e-17, Identity=29%"; Hit description =Putative uncharacterized protein
MGSSQTPSHKKRFYQVKVKSLGITSLKELGQLTGQLQRQAFRKAYGKIWDLAMAEVSTEAIASLAQRPYLFSGFYPSLARISKIVQISAQELDHRKQVENGVVGIPRKCLEAKARILAGRGEWAPFIEILTLLIFGGVLFPNVDGLVDLAAIDAFLAYHDHKESSVVAMLADLYDTFDRRCEKSSSRIVCCTPTLYVWLVSHLFRQEERLSAGSLDGKKEEPGGCISYNLVLAIRQLGYPMRGAPLEEELTPVISQGFNKTNVEVLQKVRKAWEVVQKKDKELRGSNNGPIGGYRKWLKAHVQGLDWLPSLRTAKREEVEAPEEDEEENAELRDINIATTKALEQETKRARREEHGRNKFRGALWGKLETNMLAIVSRYQEDLNLATTHEHRVADEYARVYAEKEARGRVIDSLHQEATMWMDRFALTLNRSQELPRLLAKAKAMADTYSAPEEIHGLLSYSDMSALKEQMTSMMEAMLGMRQLMEKNVAIAAAVKWCDCNRHLLLAACTIETKGPIFTAMFTPLALIITAIFSALLWKETLYLGSVGGTVLLVVGLYSVLWGKSKESVKEGVKGENLEVEQTKEETRLECIVKH

SEQ ID NO: 140143 - protein, 83 aa, Glycine max
  Coding DNA Sequence Number=SeqID_48458
MAWWIVWNNSVFKQEVPIPKFEYSVYLSVCVTLMARPGGSCNNHGGDPTDPSQDPSSPYYVHAGDGPSSVAVTPVLNGSNYHA

SEQ ID NO: 140144 - protein, 73 aa, Glycine max
  Coding DNA Sequence Number=SeqID_48459
  Gene Ontology: Mol. function=protein binding
  Homolog annotation: Hit_ID=A7P9I9; Match level="QueryCoverage=93%, HitCoverage=19%, E-value=2e-20, Identity=63%"; Hit description =Chromosome chr3 scaffold_8, whole genome shotgun sequence
MEDLARSIQNPPVDWHGDPCLPKGNSWTGVTCSNGFHAQVMTLNLTNAEVSGSLPPTLGHLSGLEHLYGMLPF

SEQ ID NO: 140145 - protein, 158 aa, Glycine max
  Coding DNA Sequence Number=SeqID_48460
MAAHPGELRLTPEVTGSPRRVSSFSLKSFGGPGKPEASLGELGSRKLKEKPGQASLKSFEQSFVLCDLCIDCGSRNPYTLTTVSYLRKIFMLYVQCGVIIISLYTPNTLASRDTCNDFRKSFGMINVIRYRISMSGSNISTGFTGPSATYLSYTVNKH

SEQ ID NO: 140146 - protein, 96 aa, Glycine max
  Coding DNA Sequence Number=SeqID_48461
MVTRGGQRWSLVVEKKVLGFGWVFGEEESEKIVFFTLKNIKIPFSEALEQMPTYFKFMKDLLKKKKRIMDDEIVEPEPQQGHQVQKMIKKCSWEAT

SEQ ID NO: 140147 - protein, 160 aa, Glycine max
  Coding DNA Sequence Number=SeqID_48462
MGFPALITGLCQSFGVPVTPSKVIRPPITRAFIEKYCTPRQAQGDAPQAADAPPPPHQADAAGSFDTDRQQSQGFAPFACPTPDQFNAEVAWPIDWLEAQVGEVPAEAPGDAEEARMDEEMTDLLGTNVCFVFSIVFCFVHTFCLDCCVSVYFVIIDNVC

SEQ ID NO: 140148 - protein, 58 aa, Glycine max
  Coding DNA Sequence Number=SeqID_48463
MARNVFAPCPYLRDLQGRELTSGVANCRNLPFGERATRDSRDACSTKGIRAESPPTFI

SEQ ID NO: 140149 - protein, 117 aa, Glycine max
  Coding DNA Sequence Number=SeqID_48464
MPWESSPSTLHQKIEVRDGWTLVIVSGERGYVGELPLLHTIRRSSGRIIGKRFSQSFKVVSCASVEPSPLLPSLSNAAIMVARVMIKNGFEPGMGLGKDGLRNADGEEECAVKTSGG

SEQ ID NO: 140150 - protein, 127 aa, Glycine max
  Coding DNA Sequence Number=SeqID_48465
  Subcellular localization annotation: CTP_CleavageSite=49; ConfidenceScore=5.33e-01
MVKVGTSYVPINVSFSPKVGPGLPGIYSAQSASGDAANLLISHRRTSALASVAVTLRVTTTPAALNAPLQGASHSPFRLRNCWEGRSVRASSLLRQLAKGGCAARRLSWVTPGFSQSRRCKTTASEL

SEQ ID NO: 140151 - protein, 274 aa, Glycine max
  Coding DNA Sequence Number=SeqID_48466
  Homolog annotation: Hit_ID=UPI0000503967; Match level="QueryCoverage =89%, HitCoverage=89%, E-value=3e-09, Identity=28%"; Hit description =UPI0000503967 related cluster
  Subcellular localization annotation: CTP_CleavageSite=56; ConfidenceScore=5.37e-01
MRTDCLVQFAILNLFPSPMNCVFVHVSSTFEFGAMRSDCLVQFSILNLFRSPMNCVFVHVPSTFEFGAMRSDCLVQFSILKLFWSPMNCVFVHVSSTFEFGAMRSDCLVQFSILNLFRSPMNCVFVHVSSTFEFGAMRSDCLVQFSILNLFQSPMNCVFVHVSSTFEFGAMRSDCLVQFSILNLFRSPMNCVFVHASSTFEFGAMRSDCLVQFSILNPFSEPMNCVFVHASSTFEFGAMRSDCLVQFSILNPFSEPHELRFRSCALHLRVWSHV

SEQ ID NO: 140152 - protein, 71 aa, Glycine max
  Coding DNA Sequence Number=SeqID_48467
EELATQLAQASQVASSRSNRLLEEESGRPKWACARQSIHGSPNKISRVEDRRTALGNQFAGLQTRWWRMHE

SEQ ID NO: 140153 - protein, 201 aa, Glycine max
  Coding DNA Sequence Number=SeqID_48468
  Gene Ontology: Mol. function=ATPase activity, coupled to transmembrane movement of substances; Cellular component=integral to membrane; Biological process=protein transport
  Homolog annotation: Hit_ID=Q7CS58; Match level="QueryCoverage=55%, HitCoverage=20%, E-value=3e-51, Identity=92%"; Hit description=ABC transporter, nucleotide binding/ATPase protein
  Pfam annotation: Domain name=ABC_tran; Domain location=1-87; Score= -1.6; E_value=1e-06; Accession=PF00005.18; Description=ABC transporter
GYQTVVAADGAPLSGGQKQRISLARAFFCDPKFVVLDEPNSNLDTQGEQALAKALLHAKRQGITTVTITQRPALLQCVDKIMVLKDGSVAMFGERMDVLKALSGNGRQASQKKNAIAEVKPQGQLEWYSEVPRSIRLHISIGLAVLLASFGGFGYWAGTAPLSSTIIAQGSFVATGNNKVVQHLEGGIIKEMMVSEGDTVK

SEQ ID NO: 140154 - protein, 85 aa, Glycine max
  Coding DNA Sequence Number=SeqID_48469
MVGYTPSSFTDLVFASKRIKVVLKRGKFNHPAWTTEKTRANEEGENEGETHAMTAIPTWPNFPPAQQYCYSANNNPSPYPPPSYP

SEQ ID NO: 140155 - protein, 66 aa, Glycine max
  Coding DNA Sequence Number=SeqID_48470
SSKVTHESDQGLHSMIHEGVGGRMRFPPFPQWSWTLRNISSRTSPPPRLMHSYYLHRVANVDVCGQ

SEQ ID NO: 140156 - protein, 85 aa, Glycine max
  Coding DNA Sequence Number=SeqID_48471
MTKARQKGVRKVNETRIKENRGGACHPARPGEPGCFLQKQPPFWRNILEGPTFRILRKLTDCVTILPFDFRHVTEFHGLRNNASF

SEQ ID NO: 140157 - protein, 65 aa, Glycine max
  Coding DNA Sequence Number=SeqID_48472
MSFLMAVILDAMEEFLQEHPLKVIPAENRPGSKVRVPRKESTRSRHQCLFEENIGKTGKDVIYKL

SEQ ID NO: 140158 - protein, 52 aa, Glycine max
  Coding DNA Sequence Number=SeqID_48473
MSVKNLVRRLGVHDKTNHTLACQVTLTRLKGALKLGDPQGLHSEESIRASPS

SEQ ID NO: 140159 - protein, 240 aa, Glycine max
  Coding DNA Sequence Number=SeqID_48474
  Homolog annotation: Hit_ID=Q84VH5; Match level="QueryCoverage=76%, HitCoverage=38%, E-value=2e-65, Identity=94%"; Hit description =Envelope-like protein
KDFKAEREKPPLRGLDLIKAAGLLKTVIKLGDCYESLVREFIVNIPSEITNRKSDDYQKVFVRGKCVRFSPAVINKYLGRPTEGVVDIDVSEHQIAKEITAKRVQLWPKKGKLSAGKLSVKYAILHRIGAANWVPTNHTSTVATGLDIVSTSGKAAASGAVSKDALIAELKDTCKVLEATIKATTEKKMKLERLIKRLSESGIGDEEAAEEEEEAAEEKEEEDAAEDTDSDGDDDSEATP

SEQ ID NO: 140160 - protein, 341 aa, Glycine max
  Coding DNA Sequence Number=SeqID_48475
  Homolog annotation: Hit_ID=Q6WAY6; Match level="QueryCoverage=70%, HitCoverage=45%, E-value=1e-12, Identity=26%"; Hit description =Putative uncharacterized protein
MSSRGKKTISFLRVSPLFEQNCNCGQGFSKRFGPHKTDSEWHSGPTTELLAEIGGRTINWFPRWKEGKEGVIFSCGGYPNILLIGTRGCINYNPVLAIRQLGYPMRGAPTEESMSPFLVRDFGAQNFKAIQAIHKAWETPLRKDQELRGIRNGIIGGYHEWLKVHIRGLDWLTKLKVVSEESFEAPEEDEEVQALKSELGKAKLAKEKFRLAATHIRKECAGLREENATTTRALEQETKRARKEEYGRNKFRGALWGSNNELKLRREERDQSRAHSMVLKEELVACSRSKRSLSQRLCEMETNMLAIIAKYQEELGLATAHEHRIADEYAQVYAEKEARGR

SEQ ID NO: 140161 - protein, 108 aa, Glycine max
  Coding DNA Sequence Number=SeqID_48476
GKIVFRTGSVQVPVVYTHSNLAVFFRDWDNVGHPLRGYQALADRRGVATYPSAGGRRVTRGMRVPRKEYARSRHQRLFEENVGKTGKDAIYELLSERLGSCIYARGKY

SEQ ID NO: 140162 - protein, 204 aa, Glycine max
  Coding DNA Sequence Number=SeqID_48477
KWTLAADQDSVEDTVCDKYDISKEKWAQFCQTRRDPSWEDVRIKAQTIQKQNTAPHVLSRGGYDYLEQKLLAKKTKKKLQEAAQSGSVDGVIDPPSPVRRHVKWKMACTKKTGEMTTEAAKEIAEKINAMYHCVFSVQDSFEEQATQGSFVPHGRQDVLAAAIGRPEHPGRVCAAGAGVTIKQYFGSAPRTSRNTSSLPSNKLQ

SEQ ID NO: 140163 - protein, 244 aa, Glycine max
  Coding DNA Sequence Number=SeqID_48478
VRKDKAAEGTSSAPEYDSHHFRSAVHQQRFEAIKGWSFLRERRGAGGGHHWLLLWPSLIPEIVLEFYANAWPTEEGVRDMRSWVRGQWIPFEADAISQLPGISDGVGKRARNASMARGGTGRRVQIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKVIRPPITRAFIEKYCTQRQ

SEQ ID NO: 140164 - protein, 196 aa, Glycine max
  Coding DNA Sequence Number=SeqID_48479
  Homolog annotation: Hit_ID=A5B5G7; Match level="QueryCoverage=82%, HitCoverage=10%, E-value=4e-07, Identity=27%"; Hit description =Putative uncharacterized protein
MASRKRKAPSTPTQARFDRSRFTSQEAWERYTDIVVPRKLLPERNVVVYYIEFDEFKEELERRHWDEKLTDFSDSSIDIAIVNEFYANLYDPEDKLPKQLRVRGHLVKFDEDTLNTFLKTPIVLEEGENLCTYSIFALLRPDPQELAAKLCIPGRGFELNADRQPLKILRKNMTTLAQTLSVLSFSNLITTYLPHI

SEQ ID NO: 140165 - protein, 133 aa, Glycine max
  Coding DNA Sequence Number=SeqID_48480
GLPVTFNRDTRMIFAKFGFRDHSLLAQYRAPRGADQLLFPCSEVLISSALAYHGFYQLSFLFSMTGIVIRLTHHTRRVNCACATGLPALPGAKGRMCCILAITMLGTLMPGCSQSECVRGRRKKAAPVRQQNM

SEQ ID NO: 140166 - protein, 101 aa, Glycine max
  Coding DNA Sequence Number=SeqID_48481
MGRDQNNYCTVLVCKEDLLQDLEAVPILEEEPQSSEASSSFPIVEHSHLDPIDDYIMAEELRRVTLEDYSSSNVPQFFTSIAQPEVQAQTITYPPSLIQLI

SEQ ID NO: 140167 - protein, 41 aa, Glycine max
  Coding DNA Sequence Number=SeqID_48482
WTHDGLSVTDLVLCLPLALDLVAYGSAMCRSNALTFFMDEL

SEQ ID NO: 140168 - protein, 94 aa, Glycine max
  Coding DNA Sequence Number=SeqID_48483
MIVARVMLGHGYEPRMGLGKNNGGRTSLRAKEAPPCHVSRSFISAGLRGKGQVIAICDDDSPRRSDLVWSCPLGFQLGNWRVEERPDVYATSIM

SEQ ID NO: 140169 - protein, 122 aa, Glycine max
  Coding DNA Sequence Number=SeqID_48484
  Homolog annotation: Hit_ID=A5BP71; Match level="QueryCoverage=64%, HitCoverage=20%, E-value=1e-09, Identity=40%"; Hit description =Putative uncharacterized protein
  Pfam annotation: Domain name=zf-CCHC; Domain location=88-105; Score =17.9; E_value=0.003; Accession=PF00098.14; Description=Zinc knuckle
MVIIVNAEACGYVSMNYYQYIDVVYTNEHILKAYSAQWWPLGNGAVIPPSDDAWTLIPDPTTIRAKGRAKSTRIRNEMEWLEPSEHRQNCSRCGAEGHNRRRCPMQSDRGVIHLIDLCMLDE

SEQ ID NO: 140170 - protein, 81 aa, Glycine max
  Coding DNA Sequence Number=SeqID_48485
MAIQADEGRAEEKVEGYKQQLAAESALEPVFDFVELEEVVEDEDDQQEKETPIKDSQEVVVGKALIDLGASINLMPLSMCQ

SEQ ID NO: 140171 - protein, 122 aa, Glycine max
  Coding DNA Sequence Number=SeqID_48486
VPPVQLLTGWCVTAKAPPDISAGKCSGHAARRVPFAIQAAQLLGRAIGAGLFAITPAGERGMCCKAIKLGNARVFPEFDVLIYYAPESDLRVKTYDHLNFSRASVVQFRASRYLMRLNETSV

SEQ ID NO: 140172 - protein, 202 aa, Glycine max
  Coding DNA Sequence Number=SeqID_48487
LLDASAGGKIKLKTLEEATELIENMFVSDHAILRDRVHQPTKKSLLELSSQDAVLAQNKLLSKQLEILTETTSKLPTKLSTGQPSQSSVLQQGPYNQQGQWRSHPGNQFNKDQGGTSNRPPQQGPNIFQRTTKLEETLAQFMQVTMSNHKSIESALKNLEIQVGQLAKQLAEESSNSFGANTEKNPKENASCCNKKQETCGG

SEQ ID NO: 140173 - protein, 138 aa, Glycine max
  Coding DNA Sequence Number=SeqID_48488
LKPLNIIHQNADPVSILGDIRKLEYNVLGRRDERSPDYREDTSKLRTVEQSSCCLKDAVEAPSCDAVDEQADQETLVHETGSGLDGCPGEEEETEDVVVDSEVHVWYNEKGDNAADHDAVYRQHFGESALVAEGEGLG

SEQ ID NO: 140174 - protein, 141 aa, Glycine max
  Coding DNA Sequence Number=SeqID_48489
  Gene Ontology: Biological process=transposition, DNA-mediated
  Homolog annotation: Hit_ID=Q1J7G7; Match level="QueryCoverage=24%, HitCoverage=48%, E-value=7e-12, Identity=97%"; Hit description =Transposase
MVKVGTSYVPINVSFRQKLAQGFPVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSIPAR

SEQ ID NO: 140175 - protein, 292 aa, Glycine max
  Coding DNA Sequence Number=SeqID_48490
  Gene Ontology: Mol. function=nucleoside-triphosphatase activity; Cellular component=intracellular; Biological process=regulation of transcription, DNA-dependent
  Homolog annotation: Hit_ID=A3XQR5; Match level="QueryCoverage=99%, HitCoverage=67%, E-value=3e-77, Identity=53%"; Hit description =Putative sigma-54 dependent transcriptional regulator
  Pfam annotation: Domain name=HTH_8; Domain location=248-288; Score =59.6; E_value=1e-14; Accession=PF02954.10; Description=Bacterial regulatory protein, Fis family
  Pfam annotation: Domain name=Sigma54_activat; Domain location=2-100; Score=-6.4; E_value=2.1e-15; Accession=PF00158.17; Description=Sigma- 54 interaction domain
  Pfam module annotation: Pfam domain module=HTH_8::Sigma54_activat; Domain location=248-288::2-100
MKVGSSQVQKTNVRIVAATNVNMMKAIQDGRFREDLFYRLNTVQIDMPPLRDRKGDIHLLFRKFAIDFAEKYRMPELVLEPSAVHYIENYSFPGNVRQLRNLVEQMTVVERERNISVEKLAEYIPTESHLPMVVNTPNAQKQSDFGNEREIMYKILFDMRNDINDLRSLTSELIKNRGAGDLSSQEKTLINRLYTSDSQQNTNANSLLYFEDNHPVVQTPTIISTPDDSYEDIQDIEIEENKPESLSLQNNEKDLIIKALEKHKGRRNKAADELGISQRTLYRKIKQYNLED

SEQ ID NO: 140176 - protein, 36 aa, Glycine max
  Coding DNA Sequence Number=SeqID_48491
MWTTTGEKLAAQLAQASKVASSRSNSLLEESSEGPK

SEQ ID NO: 140177 - protein, 66 aa, Glycine max
  Coding DNA Sequence Number=SeqID_48492
KFPGCHKEDPEELPLEPAVDALDFLEGDEDPLPEVDSPEDVMSASEADSMEESGPREMATSGGSSL

SEQ ID NO: 140178 - protein, 85 aa, Glycine max
  Coding DNA Sequence Number=SeqID_48493
MLMCNRLHLDGYILCGTSRGYIYLGCYTENKRGYISCGSVQVEGTSTWLFKENKGGYIPRGSLACKGFYKVERNLKNHWFLGDWM

SEQ ID NO: 140179 - protein, 131 aa, Glycine max
  Coding DNA Sequence Number=SeqID_48494
MAAQLIRDRVGMECLEGVWETLEGNTRCRFRGTIRFTATSLVHPDEPARTLQRTVKWILPTPTPYRLVEPVQEDLEELPPEPAVDALDFLEGDEDPLLEVDSPEEVMSASEADSTEDSGPREMAISGGSSS

SEQ ID NO: 140180 - protein, 18 aa, Glycine max
  Coding DNA Sequence Number=SeqID_48495
VNATKMSSSPAHLRGDAM

SEQ ID NO: 140181 - protein, 80 aa, Glycine max
  Coding DNA Sequence Number=SeqID_48496
EATWLALGELSSPGRAELAWASWAATTLPYFAINRGGSEEEKAEALPKRFRNVFREEFRKGFNRSSTFFIRSSSFFDLQR

SEQ ID NO: 140182 - protein, 254 aa, Glycine max
  Coding DNA Sequence Number=SeqID_48497
  Gene Ontology: Mol. function=helicase activity; Biological process =viral genome replication
  Homolog annotation: Hit_ID=Q2A9E0; Match level="QueryCoverage=92%, HitCoverage=15%, E-value=3e-81, Identity=58%"; Hit description =Putative uncharacterized protein
MAICGHIGFLDLFLTLTCNLAWPEIQKKVRKSNLTPHDCPDVVSRIFKMKLNQLMNDLKRGHVFGPILGFIYTIEWQKRGLPHAHILIFLQLANKYPNPEDIDKIISAEIPNKYTDPELYQIISKHMIHGPCGLPNRSAPCMADGKCIRFFPKKFNEATIVDRDGFPVYRRTNDGRTVQKHGIELDNRFVVPYSPQLLLKYRTHLNVEWCNQSTSIKYLFKYINKGSDRITTSIVNVQNQNGRQHQVDDELNSI

SEQ ID NO: 140183 - protein, 79 aa, Glycine max
  Coding DNA Sequence Number=SeqID_48498
MFQEVCHGIAERLEHHLNLGVVTPGSSTHEVIEECLMMARSVTQDQLVYVKSRRRRRTDQAYFIYIFYIDIRCIYRYCT

SEQ ID NO: 140184 - protein, 140 aa, Glycine max
  Coding DNA Sequence Number=SeqID_48499
MVIDAVVWKEVVSLDMGGVCKFDENLDGYSMMQTYRGMLLDLARNLRNHLGVGGLTVEDRMLVYLITYILTSRLSNHAQETNDVVEFTKVFSGITERHLKKLRMRFIDHEWIMAGEPVARNFDQMEEDAKVEAPQEPAHQ

SEQ ID NO: 140185 - protein, 257 aa, Glycine max
  Coding DNA Sequence Number=SeqID_48500
MGHLQWQAFRKAYGKIWDLAMIEVSIEAIASLTQYYDQPLRKPYLFFGFYPSMARIAKAKPMASQGEWAPFIDILALSIFGVVLFPNVEGLVDLAAIDAFLAFHHSKESSVLTILANTGGMFVHSCAKKDKANWDQLLASMEGASVNWFPCWKEGRTRILISCEGFSNVPLMGTILVTPTRGYFEEFARHGMHCKGRTKSLEEAAIESSVAIVELEKAQAVKEKFKSTVIKVRKEYDELKDINMATAEALEQETKRA

SEQ ID NO: 140186 - protein, 104 aa, Glycine max
  Coding DNA Sequence Number=SeqID_48501
  Gene Ontology: Mol. function=structural constituent of ribosome; Cellular component=ribonucleoprotein complex; Biological process =translation
  Homolog annotation: Hit_ID=A4GYN8; Match level="QueryCoverage=85%, HitCoverage=65%, E-value=3e-43, Identity=98%"; Hit description =Chloroplast 30S ribosomal protein S12 B
  Pfam annotation: Domain name=Ribosomal_S12; Domain location=1-103; Score=141.7; E_value=2e-39; Accession=PF00164.16; Description =Ribosomal protein S12
  Subcellular localization annotation: CTP_CleavageSite=42; ConfidenceScore=5.08e-01
MGQILQDQTLWESGSKGDLSVNFSTITPKKPNSALRKVARVRLTSGFEITAYIPGIGHNLQEHSVVLVRGGRVKDLPGVRYHIVRGTLDAVGVKDRQQGRSSAL

SEQ ID NO: 140187 - protein, 135 aa, Glycine max
  Coding DNA Sequence Number=SeqID_48502
  Pfam annotation: Domain name=G-patch; Domain location=4-45; Score =31.6; E_value=2.9e-06; Accession=PF01585.14; Description=G-patch domain
MAMMVARVMLGYGYEPGMGLGKNNGGRTSLVSTRGNHGKLGLGYKPTQADIRKSIAERKNRGQGSRWGQQAEGAPPCHISRTFISSVLRHEGQVVVICEDDSPSRSDLVRPCPPGFRLGNWRVEERPDVYATSIM

SEQ ID NO: 140188 - protein, 153 aa, Glycine max
  Coding DNA Sequence Number=SeqID_48503
  Gene Ontology: Mol. function=phosphoprotein phosphatase activity
  Homolog annotation: Hit_ID=A7QB55; Match level="QueryCoverage=75%, HitCoverage=53%, E-value=6e-13, Identity=41%"; Hit description =Chromosome chr4 scaffold_73, whole genome shotgun sequence
MFGMRNQTENYISDELSPSIKDKKKYQRKLFICFDNLELLGVRSQEGELQGSVVKLSWLVHHFSQINIHDGNVEQLQRFTRAWILIFIRGVLFVDKSSNKVSLRYLQFLHDLNSAARMHGDLSCLLIYIEMPSATDYKIKSIGGMCILIQMWA

SEQ ID NO: 140189 - protein, 93 aa, Glycine max
  Coding DNA Sequence Number=SeqID_48504
  Homolog annotation: Hit_ID=A5AGE5; Match level="QueryCoverage=87%, HitCoverage=5%, E-value=1e-30, Identity=74%"; Hit description =Putative uncharacterized protein
  Pfam annotation: Domain name=zf-CCHC; Domain location=21-38; Score =14.8; E_value=0.0087; Accession=PF00098.14; Description=Zinc knuckle
MSSTTGQRRMTPAEREQYRNENCQYCDKMGHIAKICWWVSKKPTQFDDIPQALATLTLDNTIAETEWTSNTGASNHMIGMRNRETDYHREAQG

SEQ ID NO: 140190 - protein, 235 aa, Glycine max
  Coding DNA Sequence Number=SeqID_48505
  Gene Ontology: Biological process=transposition, DNA-mediated
  Homolog annotation: Hit_ID=Q6UUU1; Match level="QueryCoverage=25%, HitCoverage=40%, E-value=3e-18, Identity=78%"; Hit description =Putative uncharacterized protein
DLPSQVLQWLLFLSAVPPVQLLTGWCVTAKAPPDISAGKCSGRVPFAIQAAQLLGRAIGAGLFAITPAGERGMCCKAIKLGNARVFPEFDGDNNKGKILGIGNGGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140191 - protein, 67 aa, Glycine max
  Coding DNA Sequence Number=SeqID_48506
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q8MBP8; Match level="QueryCoverage=91%, HitCoverage=19%, E-value=3e-27, Identity=100%"; Hit description=ATP synthase subunit beta
MAPDGRGRMPSAVGYQPTLSTEMGSLQERITSTKEGSITSIQAVYVPADDLTDPAPATTFAHLDATT

SEQ ID NO: 140192 - protein, 78 aa, Glycine max
  Coding DNA Sequence Number=SeqID_48507
MDVHALLKKGKWLRRNSPRRGLEETPQQKGPVPPLSLIVIISGAPSTSSASRPSEDGRSTERGVSSSGRMSIRTFRRR

SEQ ID NO: 140193 - protein, 181 aa, Glycine max
  Coding DNA Sequence Number=SeqID_48508
  Subcellular localization annotation: CTP_CleavageSite=64; ConfidenceScore=5.14e-01
MPDGDVGFTLGTVLVAATATALASIIFFMLIMASIIAAICSFIASMSAFTFSCTSSALPITLALAQVRSRSNDVTQSTFCPNFCKMVTSILQLDSMNLFIKARAWFNPITQGMAILIANTSTTFHRDERLENTHAMHGKCNYEIEMLEETSFLNEPRIRNGFMIPTWLAHGENARVTHEQT

SEQ ID NO: 140194 - protein, 98 aa, Glycine max
  Coding DNA Sequence Number=SeqID_48509
  Gene Ontology: Mol. function=protein kinase C binding; Cellular component=cell projection; Biological process=keratinization
  Homolog annotation: Hit_ID=Q86AI8; Match level="QueryCoverage=94%, HitCoverage=34%, E-value=1e-12, Identity=38%"; Hit description =Similar to Homo sapiens (Human). Mucin 2
MSSPSEGYTPSPFEGWMPSPSEDYMSSPSEGYMPSPSEDYTSSTSEGCTPSPAEGYTPSPLEGCTPSPLEGCTPSPSEGCTPSPSFAIHKDSKPDSMQ

SEQ ID NO: 140195 - protein, 94 aa, Glycine max
  Coding DNA Sequence Number=SeqID_48510
MWAWEHCTTLAPKRTPLVIENKPLGHRWLRRGNQHIDNDDLIVFRRKLDIMKRHEFLWESYTTTVMSVLPPIWQARRWDRPCGTSSRHHAHHNE

SEQ ID NO: 140196 - protein, 225 aa, Glycine max
  Coding DNA Sequence Number=SeqID_48511
  Homolog annotation: Hit_ID=A1FTG4; Match level="QueryCoverage=32%, HitCoverage=5%, E-value=6e-35, Identity=98%"; Hit description =Putative uncharacterized protein
MDLTVSLGDKVKMTGFGLKGALTGKMQVWAKPGREMTANGGLEVSGRYKAYGQDLTITRGNLTWNYNAVSDPRINIRAERRIAAACGRVVRAGDVAVRSTGLPGAGPQPDWCQQRPDPAGQRGFRGALGRQRPAGFAAGRQAGPGRRRCEPVARAGRLGDRCRQVHLAQAVRRLRRVAGRCRFGDHAEVPAASRLRRGSGIEHGGKPWVDQLAAGDRIPAARGIH

SEQ ID NO: 140197 - protein, 76 aa, Glycine max
  Coding DNA Sequence Number=SeqID_48512
MQLSSPVISSSKETRASAKRNIPGLSARKNLEEDELYRFAKGTASSLYAHRFSSSAKRERRAKPKITCWIKWPRNN

SEQ ID NO: 140198 - protein, 157 aa, Glycine max
  Coding DNA Sequence Number=SeqID_48513
  Gene Ontology: Biological process=response to desiccation
  Homolog annotation: Hit_ID=A9PFS2; Match level="QueryCoverage=49%, HitCoverage=24%, E-value=2e-25, Identity=69%"; Hit description =Putative uncharacterized protein
MARNFTDYATIPSLTFGMLRNFADCATMLPFDYKNDSSQIVQMDNSRFNTTFNPNNPVLDKDTKHQNSVRKCFYSHSHMKIQLKRFSCEEIVAILHLMLDNNNEFDLGLNALDYEIWVGNVSIGGAELANSAKLVKSGITDIDVPITLRPKDFGSAL

SEQ ID NO: 140199 - protein, 85 aa, Glycine max
  Coding DNA Sequence Number=SeqID_48514
GRSLWKNWLCRGSHSLLRFPRDLPKIEFRPVGDKPLSARRMTTERRSSGQFAEYESVSHILLARAPFSLPHEALHWNTLISVPNM

SEQ ID NO: 140200 - protein, 182 aa, Glycine max
  Coding DNA Sequence Number=SeqID_48515
  Homolog annotation: Hit_ID=Q6WAY4; Match level="QueryCoverage=94%, HitCoverage=30%, E-value=4e-16, Identity=31%"; Hit description =Putative uncharacterized protein
MGQLQRQAFCKTYGKIWDLAMVEVSTEAIASLTQYYDQPLRCFTFGDFQLSPMVEEFEEILGCPLGGRIPYLFSGFYPSLARISKIVQISAQELDHRKQVENGVVGIPRKCLEAKARILGGKGEWALFIDILALLIFRGVLFPNVDGLVDLAAIDAFLAYHDHKESPVVAMLADLYDTFDRR

SEQ ID NO: 140201 - protein, 60 aa, Glycine max
  Coding DNA Sequence Number=SeqID_48516
MTEARQKGVRKVNENENKREELATQLAQASQVASSRSNRLLEEESGRPMWAWLLFTPFFY

SEQ ID NO: 140202 - protein, 53 aa, Glycine max
  Coding DNA Sequence Number=SeqID_48517
GKPDVPAALMNRPTRGERRYAYRALAQCILAYYVGTDESVSAVHHVVGEKGCT

SEQ ID NO: 140203 - protein, 95 aa, Glycine max
  Coding DNA Sequence Number=SeqID_48518
MKDIVKEAPKSMIHSDASSIGACRPRIFFINGFLCFLEDEWQRNGERKRERRRHFKEKMSLEEAHHHRRPWIRAWRKKEMNEGRGREEHEILCSK

SEQ ID NO: 140204 - protein, 60 aa, Glycine max
  Coding DNA Sequence Number=SeqID_48519
  Subcellular localization annotation: CTP_CleavageSite=52; ConfidenceScore=5.26e-01
MVKVGTSYVPINVLFSPKVGPGLPAVPPVQLLNGVVLSVTIRTQAYRAGSISAASVAWGA

SEQ ID NO: 140205 - protein, 90 aa, Glycine max
  Coding DNA Sequence Number=SeqID_48520
MMISFHLFRSLSSLVLPYKAPQNFALIWEPIQSLCSDSQPLMIAADDPITASPKLSVLSSCRIPCLANSLEYPRVVVTETSCDERRDAFV

SEQ ID NO: 140206 - protein, 119 aa, Glycine max
  Coding DNA Sequence Number=SeqID_48521
  Subcellular localization annotation: CTP_CleavageSite=53; ConfidenceScore=5.16e-01
TLSPFLSPVIDYQRSPQHTVSISKPGNRLHILGNRLPEAVATYPSAGGRRVTRGMRVPRKEYARSRHQRLFEENVGKTGKDAIYELLSERFGSCIYARGRVFPFAPTYFSIWDEKIRPT

SEQ ID NO: 140207 - protein, 79 aa, Glycine max
  Coding DNA Sequence Number=SeqID_48522
  Subcellular localization annotation: CTP_CleavageSite=30; ConfidenceScore=5.41e-01
MYPLLFSVTTTQVDVPSTCTTKDVPSNVLRQSSQAVSPLKLCKGETKEFSDGRRERQKEFKRLVIVEFFLAKEEENEKI

SEQ ID NO: 140208 - protein, 132 aa, Glycine max
  Coding DNA Sequence Number=SeqID_48523
MSPHVMQDGGSSQYCIIIMILQRILLGETAVYAMMLVFPPEFSPLKTILFGNPSQDTVELLMEALEEDYKDGNEINESRQFIGGVLDLEKRINRLGMYFYNIFRHQPMLRHGKKGRGTVTKNLVIFCIQGPW

SEQ ID NO: 140209 - protein, 90 aa, Glycine max
  Coding DNA Sequence Number=SeqID_48524
  Homolog annotation: Hit_ID=Q1J7G7; Match level="QueryCoverage=38%, HitCoverage=62%, E-value=6e-10, Identity=72%"; Hit description =Transposase
  Subcellular localization annotation: CTP_CleavageSite=70; ConfidenceScore=5.38e-01
WLLFLSAVPPVQILTGWCVTAKAPPDISAGKCSGLARVVTTTPAALNAPLQGASHSPFRLRNCWEGRSVRASSLLRQLAKGGCAARRLSW

SEQ ID NO: 140210 - protein, 163 aa, Glycine max
  Coding DNA Sequence Number=SeqID_48525
MHERQPIHGAPYKSGEWRIALGNHFAWLQTHWWRMHERQSINGAPNKSGEWRIALGNHFAWLQTHWWRMHERQSIHGAPNKSGGWRIALGNHFAWLQTHWWRMHERQSIRGAPNKSGEWRIALGNHFAWVQTHWWRMHERQSIHGAPNKICWKDRMVHRVFST

SEQ ID NO: 140211 - protein, 138 aa, Glycine max
  Coding DNA Sequence Number=SeqID_48526
TKVERKDIELVDEEEAKIGVDRSSATSNKCEIYKEEARNATQKHKPKRVESVNADVEAFAEALEHTKKRDTGHQSVSFENKTGDSTVLKIGNSAKVVIKQDMKGRKHKYGFNNNKREKIEKKRVVDDETATNMSYMKS

SEQ ID NO: 140212 - protein, 85 aa, Glycine max
  Coding DNA Sequence Number=SeqID_48527
MPIMEYEKSYFGIGIDQGALPATNPMRTRWCWVHNGVRGVIVLGRSGYGGFMAGIFWERQGHRMSGEGYSCFLGDVGRKKMWCKK

SEQ ID NO: 140213 - protein, 190 aa, Glycine max
  Coding DNA Sequence Number=SeqID_48528
  Subcellular localization annotation: CTP_CleavageSite=90; ConfidenceScore=5.48e-01
MDSIRFTAPFRVQKVTFHIKKRFLLNCISIFFQLPRLTFFACRTFSKFLSPITSNGCATTPNTFYSTTIARYISLGRAHNLNESVILRLVASDKNTTFTIYIDGSAHHHSSLKPIIYRRRYIFTVDITDDMLQQNLPLKLPAAASKFVVWLQKKYYHPPRTFKIHEMATHHPPCVISWKFLPGIFGNDAF

SEQ ID NO: 140214 - protein, 50 aa, Glycine max
  Coding DNA Sequence Number=SeqID_48529
MTGDASKFTHISLKKSGHVTYGDNNKGRILGVGKIVKMMIHGYGIGGLLI

SEQ ID NO: 140215 - protein, 67 aa, Glycine max
  Coding DNA Sequence Number=SeqID_48530
MNAYGDKQSDLGIIDKKLKRLAEQAMQAQTTKWNNYDGGKNKKGKGKWKNNKWKGSGEGPSSSGNHN

SEQ ID NO: 140216 - protein, 55 aa, Glycine max
  Coding DNA Sequence Number=SeqID_48531
MLKQQQSSLMQSYPARALDRRLQVDRAKDPREGPRVLMSLRLSSSFSSQGDELSY

SEQ ID NO: 140217 - protein, 107 aa, Glycine max
  Coding DNA Sequence Number=SeqID_48532
  Homolog annotation: Hit_ID=A5AZG1; Match level="QueryCoverage=48%, HitCoverage=15%, E-value=4e-09, Identity=53%"; Hit description =Putative uncharacterized protein
MSLHSSSSVNGEGSTPKDPLYKILDELRSLKLWKEEQERKEKDNVEAYLDGEIKVEQLFACHHISEERKVPLATLSFQGYALYWWTSLVRERRIHGDPYVEARLHDE

SEQ ID NO: 140218 - protein, 74 aa, Glycine max
  Coding DNA Sequence Number=SeqID_48533
MSLSLQGQGSTSFPCPTSDQFRAEVAWPGDWPEALAGEAPAEAPAEAPDEADEAREDEEMTDLLDFLGGSGATD

SEQ ID NO: 140219 - protein, 76 aa, Glycine max
  Coding DNA Sequence Number=SeqID_48534
  Homolog annotation: Hit_ID=A7PKQ3; Match level="QueryCoverage=67%, HitCoverage=8%, E-value=2e-12, Identity=68%"; Hit description =Chromosome chr7 scaffold_20, whole genome shotgun sequence
MAEVTSHTTDKGLDGLLEEDENGAKDSWEKAENEVTSLKKQVQALTLRNSTLEDRVTHLDGALKKCVRQLRQTRCL

SEQ ID NO: 140220 - protein, 193 aa, Glycine max
  Coding DNA Sequence Number=SeqID_48535
MPGTAMHTMSLAGRSFRKGMREIEWRNWHKELTNFSEGSIDVAIVKEFYANLYDPEDKSPKQVRVQGHLIKFDVDALNTFLKTPVVIEEGESLSAYSWLANLRPVPQELATRLCIPGKGFELNADELPLKILRKNLTTLAQTWSVLSFSNLALTSHTSDITLDRSKLIYGLIMKMDMNLGSLISGPDLSYSTT

SEQ ID NO: 140221 - protein, 181 aa, Glycine max
  Coding DNA Sequence Number=SeqID_48536
MVAGFFAGKFLLGLVFALGLVLPTGRDCAGNEFYGGGLCGHVGAEVTAWVSPSFFLAPPTLNLLLLCGSDIIKISPSQAYLNSLARKHQIYETRGHITHHHLIVEHWQHVYYHGYHFSLHHGGCYLGRQIPPPLGILFEGLMFLLAHVLLLGSIRSHVGVVLILPDESNHQVLPRTDLRSF

SEQ ID NO: 140222 - protein, 122 aa, Glycine max
  Coding DNA Sequence Number=SeqID_48537
MSHHSSSVRGDGTSHKDPLSRILDELSSLKLWKEKLERKEKGKERVEINQDEREQIREEERRKIMKEMKREKHGSYSSHDSCKSLSEELSDYYRGCHSSHTKHHSQRREKDRRPQEVNISLP

SEQ ID NO: 140223 - protein, 83 aa, Glycine max
  Coding DNA Sequence Number=SeqID_48538
MVDMGKKILQMGIEDQKINFDLFHEDKDPPRQNVCLIVHVMEEKRPKMKLSTHRCAKPNIFTVSCTLSSGLSVDDALSATSSL

SEQ ID NO: 140224 - protein, 111 aa, Glycine max
  Coding DNA Sequence Number=SeqID_48539
MLCRLIGRDRHDDHDPADVPERRRPTASARRQRVHQMTADARDMAEDVADMAEDVPDLAEEAPEMRADVQGADGVEGSDADDVEGFPGGPRDPSVLTSFADHVAHVAWSGQ

SEQ ID NO: 140225 - protein, 49 aa, Glycine max
  Coding DNA Sequence Number=SeqID_48540
MKKQQCKKRCGGRQRRRGEGRHHPLGNKPRKKELQHQELPWIRSLKRML

SEQ ID NO: 140226 - protein, 89 aa, Glycine max
  Coding DNA Sequence Number=SeqID_48541
  Subcellular localization annotation: CTP_CleavageSite=71; ConfidenceScore=5.36e-01
MGLQIATRPTWAFQDVPPEGGCFWRKQPSSPGRAGWQKSKPRRFRNASETFPWVISQRFSVVLHSFFVVLRSSTGKFPKSNISIHSMSP

SEQ ID NO: 140227 - protein, 104 aa, Glycine max
  Coding DNA Sequence Number=SeqID_48542
MATKGWSFVGASMVEEEEEDGNSLAFLCTRRGPFFKKISRMSQYSHPLRNFVPEINYSMNKLGYNSLALSSNSQVESPLSGPHCTFTNAISFPLSDFILRSVIF

SEQ ID NO: 140228 - protein, 169 aa, Glycine max
  Coding DNA Sequence Number=SeqID_48543
MAEVDVVQERMKANVEAMKEQMATMIEAMMSMKKIMEVNTTAVATVSAVSRVDPIPPSGLNLINHPTSDTGSPHFVQVQNKYVFPPYGLPSNNTPPNENVNSTPILIESQQPQTDHAYVSQPMGKTHEISHCNLGDFEPRLEYAIEGQAVDDICDILEFLPGILHATYN

SEQ ID NO: 140229 - protein, 60 aa, Glycine max
  Coding DNA Sequence Number=SeqID_48544
MAGRGRDHNHDVLDCITAMLETLVQERDVEPTEYRGLMAFRKNHPPKFSGDYDQRVLGCG

SEQ ID NO: 140230 - protein, 99 aa, Glycine max
  Coding DNA Sequence Number=SeqID_48545
  Homolog annotation: Hit_ID=A7NSI9; Match level="QueryCoverage=49%, HitCoverage=20%, E-value=5e-14, Identity=75%"; Hit description =Chromosome chr18 scaffold_1, whole genome shotgun sequence
HKVDFKDNRSVDPEKYTFRLTGRKPISLEEKRKLGEGYIPLLQTSIPEKMETLTSHFRVRVGGLKVNFGIHGLVTMLQLLETLLELYVSSPKLFIIMTK

SEQ ID NO: 140231 - protein, 94 aa, Glycine max
  Coding DNA Sequence Number=SeqID_48546
MAKFDPDIVLEFYANVWPTEEDVWDMWSWVRGQWIPFDADALNQFLGYPLVLEEGQECEYSQRRNRADGFDEEAIAQLLCILGQDFALTAAGKR

SEQ ID NO: 140232 - protein, 73 aa, Glycine max
  Coding DNA Sequence Number=SeqID_48547
MMTKVMNKKLKDQRTTQVESKNISSESRTSQEFKKRIKKKFKTQEDKPRIKIQGSRSQESRSRFKNEEKTQSR

SEQ ID NO: 140233 - protein, 208 aa, Glycine max
  Coding DNA Sequence Number=SeqID_48548
MTQEMVARGDTLRLSAPRHSVTPSVIDEQRPVWSFAPFPEMSASSGGDFFKSHKLSRTTSKSLAFVGCPTISVILTLRSCDMRRQNLVIPHPFAIQTQSCLMARRDKIWSFCTLCHQEAAGPMTCGDKIWSFRTPLPFRHSRVRWHAETKFGHSAPFCHPKAAGPMTCGDKIWSFRTPFPFRHSRVRWHAETKFGHSAPFVIQRRRAR

SEQ ID NO: 140234 - protein, 115 aa, Glycine max
  Coding DNA Sequence Number=SeqID_48549
MTPSTEDVKKAMQGLFAVLQLSMWGWFHTFFSKKVGPSIRYKEGRIKILSSCEGCPNVPLMGTRVTTTRGYSKEFARHGMRREERIESLGEAVMGSSAAITVRDDEVKASEESDE

SEQ ID NO: 140235 - protein, 75 aa, Glycine max
  Coding DNA Sequence Number=SeqID_48550
MDILVPHPLTNACLLIQLSPECGCKPLVYLLKRPALLSVDFQDCSIRDYSSCTKFVFLEKRVVKNRMLDKWPQLP

SEQ ID NO: 140236 - protein, 124 aa, Glycine max
  Coding DNA Sequence Number=SeqID_48551
  Homolog annotation: Hit_ID=A5BA10; Match level="QueryCoverage=42%, HitCoverage=5%, E-value=1e-07, Identity=45%"; Hit description =Putative uncharacterized protein
MGHISERFVHIPKRSRIVEGMNDQTGHPRATGIVFTLNGTEDSKSKDLIQVVTSLQEDAQVYMILSNLATKTKVSMGDLPVVKEFPEVFLVDISSLPPGREIEFSIDLVHGAGPTSITLIGCFL

SEQ ID NO: 140237 - protein, 144 aa, Glycine max
  Coding DNA Sequence Number=SeqID_48552
MPISPCRCTGWDRAHKMPSGPEEVQQGPGVSSSGYGPLSDLQGARSPSEESHPQRHPVDPKKSNRALGFPALGSRLQDTQWTRRSPIRVLELSSSNYGSLSVLRSTCPPPARASDPPTNRAFIKKYCAPRQAQGETPQQHWDGR

SEQ ID NO: 140238 - protein, 125 aa, Glycine max
  Coding DNA Sequence Number=SeqID_48553
MGSSQKPSLKKRFYQVKIKSLEVTSLGELGQLMGQLQRYYDQPLRCFTFEDFQLVPTVKELERKSWGCQLGGRKPYLFFGFYPLHDKSCQVVLFPNMEGLVDLAAIDAFLAFHHGKESPVVAILA

SEQ ID NO: 140239 - protein, 158 aa, Glycine max
  Coding DNA Sequence Number=SeqID_48554
  Pfam annotation: Domain name=Transposase_23; Domain location=7-66; Score=-2.6; E_value=0.0023; Accession=PF03017.5; Description =TNP1ENSPM transposase
MGFYIVCGDSTQLVAGGKVFGVGGTIHIVAYGDDVVRVCVDTVYDGEAIVPLPTLEIQYVRDAVNSFIGWPRHLVKPLSYKPVEHSSDAKLVGESDPLGELMKILFYVYQNPVEVSWEANQFGLPDIGAKFYITHADLAEIISGDKCLNIAILQLWTM

SEQ ID NO: 140240 - protein, 110 aa, Glycine max
  Coding DNA Sequence Number=SeqID_48555
  Subcellular localization annotation: CTP_CleavageSite=61; ConfidenceScore=5.37e-01
MGCLYFTVMLLMALQSIHILHVPSFLGTNNTSTAHGLRLSWTQPFSNKFFNLRLYLISLLRVSPIGGNPGGISLGNISPNSCKSSWNFGGKVSNVGIVAMLRDVSLDKRR

SEQ ID NO: 140241 - protein, 84 aa, Glycine max
  Coding DNA Sequence Number=SeqID_48556
  Homolog annotation: Hit_ID=Q84VH5; Match level="QueryCoverage=79%, HitCoverage=9%, E-value=6e-19, Identity=71%"; Hit description =Envelope-like protein
MLSQHPNILNNIDSVMKRESPLSLHYKLFEGTHVPDIVSTSGKAAASGAVSKDALIAELKDTCKLIEDAAVNCSRSMKTGGAES

SEQ ID NO: 140242 - protein, 182 aa, Glycine max
  Coding DNA Sequence Number=SeqID_48557
MEAMKDQMTSMMEAMLSMRRMMENNVAAVAATSTAAKADPIHPSSINQTSHPVPDMVGQGGEVLGSTSGPHMVQNKNSFPPYDLPPNYAPPNPNAAGAPQHRPLQPLHFLMGRLPLAMEEREKLDLIEERMRAIEGIDDYPFADMAELCLVPDVIIPPKFKVPDFDKYKRTTYPKNRLKMYY

SEQ ID NO: 140243 - protein, 422 aa, Glycine max
  Coding DNA Sequence Number=SeqID_48558
  Homolog annotation: Hit_ID=Q6WAY4; Match level="QueryCoverage=70%, HitCoverage=59%, E-value=2e-37, Identity=31%"; Hit description =Putative uncharacterized protein
STLEDPTQIGKRFYQVKIKGLDVTSLKELGRLMGPLQMQAFRKAYGKILHLTIEEVFTEAVVSLTQYYDQPLRCFMFGDFQIVPTVEEFEEILGCPLGGRKPYLFSGFLPSLSKIAVVVRDSARELDRVKQTRNDVVGLPRKYLEGKARDMANQEEWVLFADVLALLIFGVVLFPNVDGFVDLAAIDAFLAYHHSKESPVVAILANLFDTFDRRVDWDQYLAGIRGRTIKWFPRWKEGKEGVLFSCGDYPNIPLIGTRGCINYNPALAIRQLGYPMRGAPTEESLSPFLARDFSAQSFKIVQRVHKAWESPLRKDKELRGIRNGIIGGYHELLRVHTRGLDWLSKLKIINEENFEAPEEDEEVQALKTELGKARLAKEKFKLVATDIRKKCAKLQEENAATARALEQETKRARKEEHGRDKF

SEQ ID NO: 140244 - protein, 89 aa, Glycine max
  Coding DNA Sequence Number=SeqID_48559
MAIARWALKHPVHGIVILRRMFLNEKLYTVPEFQQTLLTTTKDPTVMWLRMPPDSWVTVTKSGVVDKSRAFAPTYPQFVMRNSDLRSSC

SEQ ID NO: 140245 - protein, 211 aa, Glycine max
  Coding DNA Sequence Number=SeqID_48560
MGEVEKVQEQMKVDMEAMKEQMATMMEAIISMKKIREVDMVAVAATNAVAKVNPMPPFGLKQMNHPTSNMVGKDLGSTDDTMMCKFKTSTPSRHMACLPNYTPPNVAYIPNEDANTSTPILIKIQQPQSDHAHVSRPMEETHGMPHHNLADFEPCLGYATEEKAVGGIPLQNTLEGPQCHPQPQPSHSTAVKNPHAMAEMGKGKGSGPLKE

SEQ ID NO: 140246 - protein, 162 aa, Glycine max
  Coding DNA Sequence Number=SeqID_48561
MSIREEEIVEVDTQEESPVNEHDLEEEDEEKAQQREQCLQTHTQQEDNFQLNTCSHQLNIKEERHEDHESSFILGQPYLPFASCVLDMGKECLVNEDGGKMLACIDDLGDLDDESIGHMMFEELENNRPKENPKVELKTLPVFLEDTETKPVIISISLQKIK

SEQ ID NO: 140247 - protein, 168 aa, Glycine max
  Coding DNA Sequence Number=SeqID_48562
  Homolog annotation: Hit_ID=A5BSP7; Match level="QueryCoverage=63%, HitCoverage=9%, E-value=2e-08, Identity=28%"; Hit description =Putative uncharacterized protein
  Pfam annotation: Domain name=zf-CCHC; Domain location=95-112; Score =22.8; E_value=0.00054; Accession=PF00098.14; Description=Zinc knuckle
MVLVTVPFLGRIASLREEERTSMARFLSGLNMEVRDKQQLKIKSSSKSYDFHSYPRKDQAQGILGPTPSKPKEDKGKTIEKPTPKTSSQARTNNIECFKCLRGGHIVSQCPTKETMMMRGKDIYSSQEETTSSPSSRGSEDKERGEESSEKVYSHVKGDLLMVRRLFG

SEQ ID NO: 140248 - protein, 105 aa, Glycine max
  Coding DNA Sequence Number=SeqID_48563
MLAIITKYQEELNLATAHEHRVADEYAQVYAEKEARGMVIDSLHQEATMWMDRFAFTLNGSQELPRLLAKAKAMANIYSAPEEIHGLLSYCQHMIDLMAHIIRNR

SEQ ID NO: 140249 - protein, 110 aa, Glycine max
  Coding DNA Sequence Number=SeqID_48564
EEIYPQEEGQPLMLKEECKETLVSTATPLGLEVIPQVKELLDEGLVLKSLNPCALLVPKIGVPTDPKRIKIIPDWPTPPTPFIELVRNHVPSWEDVSREGAQSMKNLRNL

SEQ ID NO: 140250 - protein, 64 aa, Glycine max
  Coding DNA Sequence Number=SeqID_48565
MNVLSGATLFCKITRTPNIFMVCVHRDPLGVGGRIPEYEEPRDLRSNPFQGGGDDAILPPKGIG

SEQ ID NO: 140251 - protein, 54 aa, Glycine max
  Coding DNA Sequence Number=SeqID_48566
MAQPPILRTYQMNTRLVGSKTMVVILTPLPGPKEVTCLHPMKQYSNGIVSYVRV

SEQ ID NO: 140252 - protein, 189 aa, Glycine max
  Coding DNA Sequence Number=SeqID_48567
  Subcellular localization annotation: CTP_CleavageSite=37; ConfidenceScore=5.48e-01
MPKVKRFINPQKSAPQPQCPSPSDSTQAPEVPTGNVPLSHESTSEVPAMNPEISSPPSDSTQAPEVPTGNVPLSHVSTSEVPQEDETTRRHVGRESTHCWTVEAIDSEETIKKIKVKVRGVNSLPRELRIIVNFDDQGQAIGEAQALLAGFLGTLAADCKLFPMDYDRWSGPSGVPKAYFDDCFETILK

SEQ ID NO: 140253 - protein, 68 aa, Glycine max
  Coding DNA Sequence Number=SeqID_48568
MRQFKSDLMRKWALAGDQDDVDDTVCEKYDISKEKWVQFCQTRKDPSWEMCGKRHRPSKNRTLPPGIL

SEQ ID NO: 140254 - protein, 203 aa, Glycine max
  Coding DNA Sequence Number=SeqID_48569
  Homolog annotation: Hit_ID=A4WBQ0; Match level="QueryCoverage=89%, HitCoverage=100%, E-value=1e-70, Identity=74%"; Hit description =Spore coat U domain protein precursor
  Pfam annotation: Domain name=SCPU; Domain location=121-179; Score =26.7; E_value=8.5e-05; Accession=PF05229.6; Description=Spore Coat Protein U domain
MTASLRGLRKCAEGHVQPFFALMVGLLMLPTAEAVTSQSFKVSATIVPGCAVATGSGGLLGTLDFGSHNGVESAPVSTSFVPNGALSIACTPGVALSMSINGGQNYASLRRMKRTNGPEMVGYRLYSSSSLAANSEIGVNQAIPVTYTNSNNIALPLFGVALLTGFSPAGTYSDQLTVTLSWPGTGGRHHTVMAYRSGAWGRR

SEQ ID NO: 140255 - protein, 58 aa, Glycine max
  Coding DNA Sequence Number=SeqID_48570
MKPHKRRNESRKLRCWRRKERVLLWNYQDIFAWSYQDMPGLNPDNVQHRLPLLIYSNC

SEQ ID NO: 140256 - protein, 208 aa, Glycine max
  Coding DNA Sequence Number=SeqID_48571
MSPFLVRDFGAQNSKTIQRIHKAWETPLRKDQELRGIRNGIIGGYHEWLKVHIRAKRILKHRKKDKEVQALKKRVRKGKNSPRRSSKLAATHVRKECAGLREENTITARALEQETKRARKEEYGRNKFRGALWGSNSELKLRREERDQSRAHSMVLKEELIACSRSKRSLSQRLCETETNMLAIIAKYEEELGLATAHEHRIADEYAQ

SEQ ID NO: 140257 - protein, 112 aa, Glycine max
  Coding DNA Sequence Number=SeqID_48572
MERSHPGNQFNKDQGGPSNRPIQQRPNIFQRTTKLEETLIRFMQVIMSNHKSTESTLKNLEIQVGQLAKQIADKSFNSFVANTEKNPKEECKAVMTWSKRFVEAEDEECVMH

SEQ ID NO: 140258 - protein, 32 aa, Glycine max
  Coding DNA Sequence Number=SeqID_48573
MFSKKEGMMRILKLAKYRLEAQVEKDEGPDTL

SEQ ID NO: 140259 - protein, 73 aa, Glycine max
  Coding DNA Sequence Number=SeqID_48574
MTKVLSELRGLRSYVGERFDSLDTRFAGMDIRLTQLEEDDLYCHHQKGGDCRKNDSRIQATTSRLLDKWPQIS

SEQ ID NO: 140260 - protein, 33 aa, Glycine max
  Coding DNA Sequence Number=SeqID_48575
MENCTKQSLRSDSKLVGGGCMNENAIHGAPKRG

SEQ ID NO: 140261 - protein, 272 aa, Glycine max
  Coding DNA Sequence Number=SeqID_48576
  Gene Ontology: Mol. function=hydrolase activity, acting on ester bonds; Biological process=lipid metabolic process
  Homolog annotation: Hit_ID=A7PP46; Match level="QueryCoverage=27%, HitCoverage=38%, E-value=3e-20, Identity=55%"; Hit description =Chromosome chr8 scaffold_23, whole genome shotgun sequence
MKNVEERSKTFAKFLTENVTETFRKRLGLDFLHGNNFSKQIRKREKCQRGRTLFFFTSSPIYSKIGEVVAAQLAQASSARPGEPGCFLQKQQPSGGIFWRAQVGLGNVNKFWPGHDKIADWWSVGILLYEMLTRKDATNQQSLVIVYFGGNDSMHRHLSGLSPHVPLQEYIENMKKIVIHLKLSIKATRRTNEACQTYSEACLELCYEMKPLISSLHSGKGMIAPLELVGLGSSLSMDSFASWKMNGSGMEKEEREETPLKGEDESRRSSPS

SEQ ID NO: 140262 - protein, 126 aa, Glycine max
  Coding DNA Sequence Number=SeqID_48577
MVICALSGDVIIFRWRLFKSHKFQKLRRGGGPDDKQRPSLVILHPRYAEIPYGYLHPFARQTQLCPMASRDQVWSFCTQDTRRYLTVICTPLLGRHSCVRWQAEIKFGHSAPKIRGDTLRLSAPLC

SEQ ID NO: 140263 - protein, 25 aa, Glycine max
  Coding DNA Sequence Number=SeqID_48578
STVSYPNFVRGPLLNDMRPFFGPCE

SEQ ID NO: 140264 - protein, 367 aa, Glycine max
  Coding DNA Sequence Number=SeqID_48579
  Homolog annotation: Hit_ID=Q84VH5; Match level="QueryCoverage=100%, HitCoverage=57%, E-value=1e-145, Identity=72%"; Hit description =Envelope-like protein
  Subcellular localization annotation: CTP_CleavageSite=21; ConfidenceScore=5.16e-01
MATSPKETSSPGSPSVPSSPSSTKAPSNQEQPEFNIQPIQMIPGQAPIPEKLVPKRQQGVKISENPSLATSPREVDTEMDKKIRSIVSSILKNASVPDADKDVPTSSNPNAEVLSSSSKEESTEEEDQATEETPAPRAPEPAPESDEEPIANKLAPGIAERLQSRKGKTPITRSGRIKTMAQKKSTPITPTTSRWSKVAIPSKKRKEISSSDSDDDVELDVPDIKRAKKSGKKVPGNVPDAPLDNISFHSIGNVERWKFVYQRRLVVERELGRDALDCKEIMDLIKAAGLLKTVTKLGDCYESLVREFIVNIPSDITNGKSDEYQKVFVRGKCIRFSPAVINKYLGRPTEGVVDIAVSEHQIAKEIT

SEQ ID NO: 140265 - protein, 64 aa, Glycine max
  Coding DNA Sequence Number=SeqID_48580
MMSKLWKKTSERNPHEEGRLNNSLLAIILAKREKFHWLPLAFKGMPSIGGDPLLGNEGFMGILQ

SEQ ID NO: 140266 - protein, 230 aa, Glycine max
  Coding DNA Sequence Number=SeqID_48581
  Homolog annotation: Hit_ID=Q88BM1; Match level="QueryCoverage=91%, HitCoverage=89%, E-value=4e-54, Identity=53%"; Hit description=TraM protein
MQNPQPAALPEGAGAAITDPDAYEHAVLAQHERSLGAEFARSCLKKLGWSLTVNVIQGIAICVLVVMYWYVPREYFATEAGRITPVYGTDKPVWSESDVRQFGADTINQAFTLDFVHYRDQITAVSPNFSEEGFAGYNQALTTGSNILSLIRDKRMNLTNTAEPGVITRRGIIGDRYTWEFQYPVTLKLQGQNSSSPPLRYIFTLRIQQADVRKKPRGLEVTQTITNNAG

SEQ ID NO: 140267 - protein, 143 aa, Glycine max
  Coding DNA Sequence Number=SeqID_48582
  Homolog annotation: Hit_ID=UPI00006A17C9; Match level="QueryCoverage =72%, HitCoverage=56%, E-value=5e-07, Identity=32%"; Hit description =UPI00006A17C9 related cluster
MLLSSNVIYICVRVVMLVRMIRTRLFAVARVKSCPGMHSSCVIASLSGCARTVGPPPISGGGPGTMWSTLKMRTRSPLKVRACSPLKARMCSPLEVRACSPLLARTCSPLKVRACSPLLARTCSPLKVRACSPYEGEDMQSFD

SEQ ID NO: 140268 - protein, 180 aa, Glycine max
  Coding DNA Sequence Number=SeqID_48583
  Homolog annotation: Hit_ID=Q2HW90; Match level="QueryCoverage=45%, HitCoverage=16%, E-value=7e-08, Identity=38%"; Hit description =Putative uncharacterized protein
MGTNQNGKRFYQVKVKGLDVTSLKELGRLMGPLQRQAFRKVYRKILDLTAAKVFTEAVVSLAQYYDQPLRCFTFGDFQMVPTVEEFEEILGCPLGGRKLYLFSGFLPSLSKIAVVVGDSEKEFGSYEANSERRSGPVAEILGRQGKGYGKPREVGPVCGYTSFADLWGCPLSEHRRFGWT

SEQ ID NO: 140269 - protein, 61 aa, Glycine max
  Coding DNA Sequence Number=SeqID_48584
MIKARQKGVRKENRGGACHPARPGELSAPERARLLPPEATTFWRNTWKAQVGLVAICTFFY

SEQ ID NO: 140270 - protein, 106 aa, Glycine max
  Coding DNA Sequence Number=SeqID_48585
MKQAKYSLKAQVEKDEGPSGEGQSPRVEKDEGPSNPCGVYPDLSSFTGSGVYPDLSSLTGSGVYPYFSSFTGSGVYHDLFSFTVSGAIQTFVACIKRSFPFMFTLL

SEQ ID NO: 140271 - protein, 56 aa, Glycine max
  Coding DNA Sequence Number=SeqID_48586
MPPPLLWRCSPLAQRREGVTIGRSRSYPSFAFIPKYLQVGDKQYAANRDWSSSYLG

SEQ ID NO: 140272 - protein, 54 aa, Glycine max
  Coding DNA Sequence Number=SeqID_48587
  Subcellular localization annotation: CTP_CleavageSite=14; ConfidenceScore=5.32e-01
MAESSKKRKGSSASASASRAHRAGATSASTAAIPPSLSSSTLFSSEEQQKRTTL

SEQ ID NO: 140273 - protein, 66 aa, Glycine max
  Coding DNA Sequence Number=SeqID_48588
MTKYNAEQRGHLKAESQHFASVNDANPYVASIPYFGFIDEIWELNYVKFTWISYNWFLERESSRKQ

SEQ ID NO: 140274 - protein, 41 aa, Glycine max
  Coding DNA Sequence Number=SeqID_48589
MSVSGNVRSAQVEKDKALEWRRVKAQVEKDEGPEAETLSRL

SEQ ID NO: 140275 - protein, 295 aa, Glycine max
  Coding DNA Sequence Number=SeqID_48590
  Gene Ontology: Mol. function=peptidase activity
  Homolog annotation: Hit_ID=A7PD93; Match level="QueryCoverage=49%, HitCoverage=26%, E-value=8e-32, Identity=49%"; Hit description =Chromosome chr17 scaffold_12, whole genome shotgun sequence
  Pfam annotation: Domain name=HEAT; Domain location=185-221; Score =23.1; E_value=0.001; Accession=PF02985.13; Description=HEAT repeat
MASRKRKSTTSRPQHNYDTRRFTSEEAWNRYADNILGQNILPERNVKLYIMEFVKFRRELEKRNLHKHLTNLADGRIDVTVVKEFYANLYNPEDNSPKQVRVRGHLIKFDTDTLNTFLGIPVVLEPGETIPTYSRFCRLRMDPQEIAVELLPRFEKLLKRDSFKAKPMPSTLVETAVAANCTSDHTQLKSLVPCLVEALSSDDWATRKAAVETLVVVVDMERDFLSEFKVRDVMNQMLEAWKLVPNVSDEVSPPPKSQSSSKENASDGHYPQVSQNSCSPRSMMANLQKKSTPFS

SEQ ID NO: 140276 - protein, 54 aa, Glycine max
  Coding DNA Sequence Number=SeqID_48591
MLDDPEPLKLPHCTEVPLKACGNHMTVLRRHGPPLQWKVETLNPAIGGKGVVQP

SEQ ID NO: 140277 - protein, 125 aa, Glycine max
  Coding DNA Sequence Number=SeqID_48592
MAGLPNYTPPNVAYIPNEDVNNSTPILIKSQQPQSDHAHVSRPMEETHGMPYHNLADFEPCLGYATEGQAVGGIPLQNTLEGPQCHPQPQPSHSTAVKNPHAMAKMGKRKGSGPLKEVKIMPLLT

SEQ ID NO: 140278 - protein, 202 aa, Glycine max
  Coding DNA Sequence Number=SeqID_48593
MTGRLLSGSLAFESRILHYLIVRILLPRSSNLAQVSEEDLIVMWAFHKGLQIDWSHLVRYRMHKALRLNAPLPYPYLVTLFLQHFNIPLDSEPYVPIKRSFLIGASVIASFGYIKEHDGSWVKKGARNIGEEGHEGEDSSLLSKILERFDGLQTFVGERFDTLKLQVDMRFNEMESRMTKVEEDVSYIRSSFDLPPPPPPSS

SEQ ID NO: 140279 - protein, 96 aa, Glycine max
  Coding DNA Sequence Number=SeqID_48594
MARHKVTRTHTHTHSRRHKGEEGLGRPSARAHTYLAPGRQNEREPTNGSLFWPAGFVGDLEGRDESQRQGLNLSGSWQQGHSATTIPRLVFKSLCK

SEQ ID NO: 140280 - protein, 168 aa, Glycine max
  Coding DNA Sequence Number=SeqID_48595
MAASDHAILRDRAYTPTKKSLLELTSQDALLAQNKLMAKQLETLGCNICGGTHESGLCMAQDDASKEGGNFSQGQGWRSHPGNNFNKDQGVPSNRPPNQGSNLYERTTKLEGTLMQFMQVSLSNHKSNESTIKNLEVQVGQLAKQMVEMPTASFVANTEKNTKEECKE

SEQ ID NO: 140281 - protein, 145 aa, Glycine max
  Coding DNA Sequence Number=SeqID_48596
  Gene Ontology: Mol. function=sodium channel activity; Cellular component=integral to membrane; Biological process=sodium ion transport
  Homolog annotation: Hit_ID=A9ZLE9; Match level="QueryCoverage=35%, HitCoverage=100%, E-value=4e-15, Identity=75%"; Hit description =Putative uncharacterized protein
ELGFDFRRGKPEKRLPHPKEGSRRANYPILTRGVKKLVVGPWVGSIGPPPVCTGRLVPSAGDALLSLTGRVVPPHGITPQDSDPIVLAFGIGVMINRDSRGHSYFIVRGEILGFMKDEQLRKHLPRMFSLIKNESWGLEDDQIPS

SEQ ID NO: 140282 - protein, 146 aa, Glycine max
  Coding DNA Sequence Number=SeqID_48597
MSPIVVITLARAEVKNFVTIMKEGIGHILDLTPIGEKNGRKPQEVNIKLPYFHGKDNVEANLDWEIRVEQQLKRKSTSKYYGSHSYPKGHITSQCPTKKTMIMRGQDIYSSQDEATTSPSSSESEEAKGGESSEEIYPQEEGQPLM

SEQ ID NO: 140283 - protein, 66 aa, Glycine max
  Coding DNA Sequence Number=SeqID_48598
MRIKRSFKVVMGQGQAFEKQHFIQHACSELQNKERETKLKRAIKGINSRTHQQESSQGYCASNQWG

SEQ ID NO: 140284 - protein, 68 aa, Glycine max
  Coding DNA Sequence Number=SeqID_48599
MQRAMQPMKSMDDMGLNQFRFFNMVHDILVKVKLEVTRISTVLNVFGSRRSSDRKMQGSRMSEHEKQK

SEQ ID NO: 140285 - protein, 69 aa, Glycine max
  Coding DNA Sequence Number=SeqID_48600
MSAEKYQSRLFNSPMLAVVLSIQSLNNIWMMSIRKCSIGVTIGDFSFTSDLSNFPGRCRLAFFSISIGE

SEQ ID NO: 140286 - protein, 59 aa, Glycine max
  Coding DNA Sequence Number=SeqID_48601
MPVPLARSRHRDIGKDCTRKIPSGPGEVQQGPGVFGSDYGLLLVLRSARRPQQGHQAPY

SEQ ID NO: 140287 - protein, 910 aa, Glycine max
  Coding DNA Sequence Number=SeqID_48602
  Gene Ontology: Mol. function=signal transducer activity; Cellular component=membrane; Biological process=signal transduction
  Homolog annotation: Hit_ID=A7MQ09; Match level="QueryCoverage=99%, HitCoverage=74%, E-value=0.0, Identity=68%"; Hit description =Putative uncharacterized protein
  Pfam annotation: Domain name=DUF1215; Domain location=686-812; Score =103.7; E_value=5.7e-28; Accession=PF06744.3; Description=Protein of unknown function (DUF1215)
  Pfam annotation: Domain name=ImcF-related; Domain location=271-577; Score=199.9; E_value=6.2e-57; Accession=PF06761.3; Description=ImcF -related
  Pfam module annotation: Pfam domain module=DUF1215::ImcF-related; Domain location=686-812::271-577
MELHDRLGIRFPVYVLVTKTDLLKGFRSYFASLDKTQREQIWGFTFPWAQASTAEFELNSQFQQEYSLLQQRLDAGLADTLLAESDAQARAESYLFPQEFAALRPLLAEALDTLFARSDFETQFAPRGIYFASGTQEGLPFDRVMGELSRALHLPGQRSGESGSWDQVDKESPIPPNKGQSFFLKGVLENVIFQESGLAGSNRWWELRNRAGLWSGYLALLVLVLIAGALWLTSYSKNKAYLQEMAGKTPQVEQLGQQLERQGNGDLFALVPYLNTLLQLPKSADFSLEDPPLTRRMGLYRGTEVSDATRTLYDKALKQLLLPQVAQNITRWLRNDNGSDADYSYEALKAYQMLYQPKHYDGKFLHAWLMLNISRELPQNVTQQEVKQLAWHLQQLLETQIQSSPYAKDDALVKREQALINQMPLSQRVYGRLKRLLQRDGSLQPVTLAALGGPQSELVFSRKSGKSVNDGVAGLFTPDGYWQHVDKQIAPVTQALFQDDVWVLGGVASPENSQQTDLAVRQLYVQDYIRQWEQFLSDIQLNSSADLSQRINTARLLSGNHSPLRQLVVNLSKLLTLNRAQPDEQSAQAQPATGNSATRTLEALFSSSKASAAPGQGAAQQAPEQAVAVHFAPVLELAQPLQQGSKVLAVDDFLHQIDDLYRYLTAVQDAANSGMPPPSGDAISRLQASAGRLPGSLQNMVSSMAVGASSDAQRRDMDNVRKRITMEVGSFCRQAIAGRYPLVRNARSEVTPDDLARMFAPGSGLMDSFFRDNLASKVDTTNTAWRFTPGIDGKTLPGGEALLRPFQQAQSIRDAFFANGATTPSFRVTLRTVKMDNDILNLTLDVDGQILRYSHGPQAVQMVSWPGPGGTSQVRMQLGLTNGTTSTLVTSGPWALNRFFDRARVTASVA

SEQ ID NO: 140288 - protein, 492 aa, Glycine max
  Coding DNA Sequence Number=SeqID_48603
  Gene Ontology: Mol. function=hexokinase activity; Biological process =glycolysis
  Homolog annotation: Hit_ID=A8GG65; Match level="QueryCoverage=91%, HitCoverage=96%, E-value=0.0, Identity=79%"; Hit description =Putative uncharacterized protein
  Pfam annotation: Domain name=DUF877; Domain location=21-461; Score =1001.3; E_value=3.5e-298; Accession=PF05943.3; Description=Protein of unknown function (DUF877)
MTQSSHQQQQGASHYSENELSALLNKEFRPTSDQARAAVESAVKTLAQQALENTVTISNDTYRTIQALIAEIDDKLSQQINQIIHHEEFQQLESAWRGLSYLALAGIRVPLFKKIYEQEYGQFGGEPFGCLVGDYYFDHSPQDVELLGEMARISAAAHCPFITGTAPTVMQMESWQELANPRDLTKIFQNTEYAAWRSLRESEDARYLGLVMPRFLARLPYGIRTNPVDSFDFEEQTDGSNHNGYTWSNAAYAMAANINRSFKEYGWCTAIRGVESGGAVENLPCHTFPSDDGGVDMKCPTEIAISDRREAELAKNGFMPLVHRKNSDFAAFIGAQSLQKPAEYHDADATANARLAARLPYLFACCRFAHYLKCIVRDKIGSFRERDEMERWLNDWVMSYVDGDPANSSQETKSRKPLAAAEVSVEEQEDNPGYYAAKFFLRPHYQLEGLTVSLRLAVMYGGLNAHKALQLPCKRKTLIASRLHVSILMSRN

SEQ ID NO: 140289 - protein, 204 aa, Glycine max
  Coding DNA Sequence Number=SeqID_48604
  Homolog annotation: Hit_ID=Q6D565; Match level="QueryCoverage=53%, HitCoverage=83%, E-value=5e-24, Identity=48%"; Hit description =Putative exported protein
  Pfam annotation: Domain name=DUF1311; Domain location=97-201; Score =60.9; E_value=4.2e-15; Accession=PF07007.3; Description=Protein of unknown function (DUF1311)
GKAFNAKIEYNCKEGNLTCNDILLKSSSLKNNSSITLKGETINTHCPDVCDFQGYQFKNGEYEYSFYPSVKEVNLWDYIVTYKDKVIAQDVAFAAALCSSEPSDSAVYQCTLHEKQLAEDALNQEYTAAKKRIASSYRADKKLADDYLSTLTNTQRGWLKYRDGQCKLEAFDAEEGSIAHEVATNICIVRINKERLESLRQIPY

SEQ ID NO: 140290 - protein, 1717 aa, Glycine max
  Coding DNA Sequence Number=SeqID_48605
  Gene Ontology: Mol. function=nucleoside-triphosphatase activity; Cellular component=cytoplasm; Biological process=protein metabolic process
  Homolog annotation: Hit_ID=A7MQ35; Match level="QueryCoverage=35%, HitCoverage=98%, E-value=0.0, Identity=74%"; Hit description =Putative uncharacterized protein
  Pfam annotation: Domain name=AAA; Domain location=1545-1715; Score =12.5; E_value=1.4e-06; Accession=PF00004.20; Description=ATPase family associated with various cellular activities (AAA)
  Pfam annotation: Domain name=Clp_N; Domain location=1347-1399; Score =26.4; E_value=0.00011; Accession=PF02861.11; Description=Clp amino terminal domain
  Pfam annotation: Domain name=DUF1305; Domain location=1042-1342; Score=55.9; E_value=3.5e-14; Accession=PF06996.2; Description =Protein of unknown function (DUF1305)
  Pfam annotation: Domain name=DUF879; Domain location=407-1027; Score =756.9; E_value=1.3e-224; Accession=PF05947.3; Description=Bacterial protein of unknown function (DUF879)
  Pfam annotation: Domain name=GPW_gp25; Domain location=298-413; Score= 58.4; E_value=2.4e-14; Accession=PF04965.5; Description=GPW  gp25 family
  Pfam annotation: Domain name=ImpE; Domain location=6-254; Score =112.0; E_value=1.8e-30; Accession=PF07024.4; Description=ImpE protein
  Pfam module annotation: Pfam domain module=AAA::Clp_N::DUF1305::DUF879 ::GPW_gp25::ImpE; Domain location=1545-1715::1347-1399::1042 -1342::407-1027::298-413::6-254
MESLQSRLASASLAESLADITRQIQASPANADLRAAFVQLLCLAGNWTRAQTQLQSWLALTPQAQPTVTLLQQAIAGEQQREAVLRGAAQPQLPGSAWAWCETLLAALTADIRGDFAQGAEQRAAALAQAEANPGQLQQQEQTAEVAWLMDGDSRFGPVCEAIANGRYYWIPFAAIREMEFQAPASVTDLVWRHTRVQLVDGSEQICQIPVRYPLLPGADERYLRASVTEWQPLGHDDTMSRDNSSHNDGYAQLHGGFRARKNRDALTARDKLQSSLLDRLTDNAPDKQSEASNTTLISHSTLRRHVLRDLQWLFNTINNEAQQDLSAFGEVQRSVWNFGVAPLAGQNISDIEWQDMQRKMTDAILHFEPRILPQGLQVRCVSDLKSLSLHNVLSIEIKGRLLIMDSKLLDYYNRELAYLRELGAEFAARYPKVAGRLGMRGIEVADPYVERLMEGFAFLTSRVQLKMDAEFPRFSQRLLEMIAPSYLSPTPSMAIAQLTPDSRKGDISNGFHVPRGTMMESQHLKKSGVTCSYTTAHDVTLHPLRISDVSLGGVPGDLPLGELKLSGRGAASALRVRIACEGISSLSQLNVADLMLYLSGPDIQAQKLLELLMQHRVGIVLQSVEQKPLRQVLPDDSLQQEGFAPEQALLPDDLRNFDGYRLLQEYFAFPARFQFISLSQLAPFLRRCDNAQEFDIIILLDKADSALESVVDSSHLALHCTPVINLFPKTAERLKVSDSQHEYHLVVDNIRPLDYEVHSVQRLFATVEGKREEQLFRPFWSTFSGDDGDYGAYFSLRREQRTLSEQAQRYGTRTGYIGSEVFLSLVDEHHTPWRDDMRYLSADVLCTSRDLPLMLLQQEQGNFVMPDSIPVGQLKLCKGPTPPRPALAEGLSAWRLISHLQMNYLSLMDSSDGQGAAALRQLLSLYANLAEAAVARQIDGIRHCQLSAVNRRVPEPGPVVFARGVSITLEVDEQAFSGASPWLLGSVLERVCSRLVALNSFTEFTLNSQQRGEEGAAMSEAQIIPLQRAQRLPDDFWQAVMAAPWRYDLFQLLRRLDAQGGQRYPLGRAPLPKFEALRIGQQPSLAFAPATLASVQPRAEDARHDVAIYSFGLFGPNGPLPTHLTEYVHERIVHHQDHSLAAFADIFHHRATLLFYRAWADAQPAVSLDRADNRRFVDYLACLAGIGLPAQQQATGTERAAVVDAGRARSGAAGSRTPDAAAGRIGVPWCGGARCAAPFSPAARSAERAAVCPLSARCAGRARSARLGASLSRYRDAMGPQPDPGGGRGAKRHAGRQCPAGLHQLAGTRATAAGSRRFHRPDMSEISRAVLFGKLDTLLFTSLESATAFCKLRGNPYVELVHWLHQLMQQQDGDLQRVISHFSLDENALTRDIVAALDRLPRGASAVSDLAEHIDSAVERAWVYASLKYGATRIRGGHLLIGMLKTFNLASVLKGISGQFGRINADALLEQFDTLLASSKEAQQALVAQPGVESAAPAASTSTLAQYAQDLTARAREGRIDPVTGRDEEIRQMVDILMRRRQNNPLLTGEAGVGKTAVVEGLALRIAAGDVPAPLRDVQLWLLDIGMLQAGAGMKGEFEARLQALINEVQSSPTPIVLFVDEIHTLVGAGGQQGTGDAANLLKPALARGQLRTIGATTWAEYKKYIEKDPALTRRFQTVQVQEPDEAKAILMLRSTVSALEKHHQVLLLDEAVSAA

SEQ ID NO: 140291 - protein, 112 aa, Glycine max
  Coding DNA Sequence Number=SeqID_48606
MEANSNSNGHNFLLGGFRFRHIIYRDVEIEKQKLSRNSNGHKFSLGGQIQEHNISRRSKLNSGSSQEIQMVKNFHTERCSKLNNGSSREVKMVINFHSEVRCKRITYTDVRN

SEQ ID NO: 140292 - protein, 59 aa, Glycine max
  Coding DNA Sequence Number=SeqID_48607
MTLKRKVQGLIDAGFSTFTGIGCKPLVYLLKRPVTIQSEVTRLARWRGCRKTTNKAQNK

SEQ ID NO: 140293 - protein, 80 aa, Glycine max
  Coding DNA Sequence Number=SeqID_48608
MSLPSAVHVSSTFEFGAMLQDCLSVDPQVQSSILPLFRSPHEGHCLALFMSPPPSSVEPRECSLPCAIRQSPFSTFFGAQ

SEQ ID NO: 140294 - protein, 318 aa, Glycine max
  Coding DNA Sequence Number=SeqID_48609
  Homolog annotation: Hit_ID=UPI00006A2D9E; Match level="QueryCoverage =38%, HitCoverage=94%, E-value=5e-10, Identity=18%"; Hit description =UPI00006A2D9E related cluster
  Subcellular localization annotation: CTP_CleavageSite=46; ConfidenceScore=5.70e-01
GAKRPHLQKTTRPRHQRATCPRLQRTTRPRLQRTTRPRVQRTARPRLQRATHPHLQRTTRPRLQRTSRPHLQRTTRPHLQGAARPHLYRTIRPHLQRAARPRLCRATHPHLQRAACPRLCRATRLHLQRTTRPTFRRTICPRLQWVTRTFRGRHVLAIRGLHVLALVGLHALAFRGLLALAFRGLHVLAIRGLHALTFRGLHVLAIRGLHALTFRGLQVLAIRGLHVLTFRRLHVLTFRGLHALAFRGLHALAFRGLHVLVFRGSHTFSFRGLHALAFKGRHVLNFRGLHALAFRGLRVLTFSGLHIHTLREFKVLCP

SEQ ID NO: 140295 - protein, 143 aa, Glycine max
  Coding DNA Sequence Number=SeqID_48610
  Pfam annotation: Domain name=Transposase_23; Domain location=47-108; Score=-11.2; E_value=0.02; Accession=PF03017.5; Description =TNP1ENSPM transposase
  Subcellular localization annotation: CTP_CleavageSite=52; ConfidenceScore=5.38e-01
MASFSPDTSPSFSSQMQFQGLTLPPDPLLVPQETILGQVTQTGAACTSKQILSALVALGRVYEGSTVVHNTPLLPGQVKVGVEEVKDPDAPIPVPTDEVSLVGLAIHIFLAWPTHLVKPLSHQLCLQQNHLKSRIRRSMILFI

SEQ ID NO: 140296 - protein, 186 aa, Glycine max
  Coding DNA Sequence Number=SeqID_48611
MEAIKEQMATMIKAMMSMKKIMEANAVNPMLPSGLKQMNRPTSNMVGKDLGSTDDPMMCKFKTSTPSHHMACLPTIHHPMWHTLSMKISITPLRYSLRTNNLIRHISLKTMGKTHEIPHHNLADFEPWLGYATEGQAVGGIPFENPLEGPQYHPQLHLLHSTADKNPHDYGRNGKVGSSKGKAQGH

SEQ ID NO: 140297 - protein, 72 aa, Glycine max
  Coding DNA Sequence Number=SeqID_48612
MYNTIITNIGLHCNAHWQMVVILPKENFIFWFCSLHNRPDNYLKGIINSALKGLNDIPQPKSKVGARWIVVK

SEQ ID NO: 140298 - protein, 143 aa, Glycine max
  Coding DNA Sequence Number=SeqID_48613
  Gene Ontology: Mol. function=iron ion transmembrane transporter activity; Biological process=high-affinity iron ion transport
  Homolog annotation: Hit_ID=P0AEL7; Match level="QueryCoverage=77%, HitCoverage=34%, E-value=3e-55, Identity=100%"; Hit description =Ferrienterobactin-binding periplasmic protein precursor
  Subcellular localization annotation: CTP_CleavageSite=22; ConfidenceScore=5.08e-01
MDSHKRNVMSCAVLPPLPSRVRAGVRVNVRTRIAAVQAADWPRQITDSRGTHTLESQPQRIVSTSVTLTGSLLAIDAPVIASGATTPNNRVADDQGFLRQWSKVAKERKLQRLYIGEPSAEAVAAQMPDLILISATGGDSALA

SEQ ID NO: 140299 - protein, 76 aa, Glycine max
  Coding DNA Sequence Number=SeqID_48614
MMTMIVDTLPVFYYEKMVGYTPSSFADLVFIDERIKATITPTQGSSTSISPRIRLERNVCLSWRSLGAFHLSIVGA

SEQ ID NO: 140300 - protein, 64 aa, Glycine max
  Coding DNA Sequence Number=SeqID_48615
MNRHIDNIVEATSKIILMMPKNQELSKFQRFKNKFQESRFKNNQDQDFKTQDSRIKRRLNQDKY

SEQ ID NO: 140301 - protein, 124 aa, Glycine max
  Coding DNA Sequence Number=SeqID_48616
HALRRPYRTRARARVMGEVEELQEQMKADMEAMKEQMATMMEAMMSMKKIMEANAIAVAATRAVAKYGRPHDMQIQNEHAFPPYGLPPNYTPPNVAYTPNENVNNSTPIPIESHQPQTDHAHFS

SEQ ID NO: 140302 - protein, 115 aa, Glycine max
  Coding DNA Sequence Number=SeqID_48617
MKDKRDEEEKLEKQKKKKDSKVLSSKAKGKEKEEKDSSKKIVKKENHFATKGDIKRALLLKKSVYLLLSRETSLSTATPLELEFFPQVKELLDEGLVRKSLTSALLVPKIRIMRH

SEQ ID NO: 140303 - protein, 198 aa, Glycine max
  Coding DNA Sequence Number=SeqID_48618
  Subcellular localization annotation: CTP_CleavageSite=55; ConfidenceScore=5.04e-01
MMSMKKIMEANAVIVAATSAVAKMNPMLPSGLKQMNHPTSNMVGKDLGSTDDPMMCKFKTSTPSRHMACLPNYTPPNVAYIPNEDVNNSTPILIKSQQPQSDHAHVSRPMEETHEIPHHDLANFEPCLGYAAEGQAVGGMGKLDHLEERLRAIEGGEDYSFANLEELFPIPNIITPLKFKVLDFDKFKGITCPKNHLK

SEQ ID NO: 140304 - protein, 460 aa, Glycine max
  Coding DNA Sequence Number=SeqID_48619
  Gene Ontology: Mol. function=RNA polymerase II transcription factor activity; Cellular component=nucleus; Biological process=regulation of transcription factor activity
  Homolog annotation: Hit_ID=A7P0I4; Match level="QueryCoverage=94%, HitCoverage=80%, E-value=1e-161, Identity=65%"; Hit description =Chromosome chr19 scaffold_4, whole genome shotgun sequence
  Pfam annotation: Domain name=CBFD_NFYB_HMF; Domain location=2-65; Score=13.1; E_value=0.0099; Accession=PF00808.14; Description =Histone-like transcription factor (CBFNF-Y) and archaeal histone
  Pfam annotation: Domain name=DUF1546; Domain location=255-370; Score =139.8; E_value=7.6e-39; Accession=PF07571.4; Description=Protein of unknown function (DUF1546)
  Pfam annotation: Domain name=Histone; Domain location=5-68; Score =7.6; E_value=0.026; Accession=PF00125.15; Description=Core histone H2AH2BH3H4
  Pfam annotation: Domain name=TAF; Domain location=2-68; Score=139.6; E_value=8.6e-39; Accession=PF02969.8; Description=TATA box binding protein associated factor (TAF)
  Pfam module annotation: Pfam domain module=CBFD_NFYB_HMF::DUF1546::His tone::TAF; Domain location=2-65::255-370::5-68::2-68
MSFVPKETIEVIAQSIGITNLSSDVALSLAPDLEYRIREIMQESVKCMRHSKRTFLTTEDVDTALALRNLEPIYGFTSNDPPRFKRAAGHKDLFYIDDKDVDIKDIVEAPLPKAPLDTSITSHWLAIEGVQPAIPENAPVEAPSEIRKSEFKEDGLPVDVKLPVKHLITRELQLYYEKITDLTLKKPGSIPFRRALVSLSADSGLHPLVPYFTFFVADEVARNLNNLAVLFALMRLVRSLLQNSQIHIELYLHQLMPPIITCIVAKRIGNRLSDEHWELRNFSANLVTSICQSPYDFFGWAVWCTFLQLYGTKKSNEKVKPRVMKTFLHSFLDPTKALPQHYGAIKGIEALGSRLIRLLILPNLEPYLHLLEPEMQPEKQENEMKRHEAWQVYGALLGAAGQCVHEKVKTFGNLFSPPTQVTSRGSGKSVIAMPGVALFFYICNYSDVFEKQYLPAEWGN

SEQ ID NO: 140305 - protein, 74 aa, Glycine max
  Coding DNA Sequence Number=SeqID_48620
MAETAVSLAGQHALPKILEAIKMLNKMMEGVIEIKRKGDAAERSSFCMEDVIDEYNISCEDKQPGDPRCAAFTM

SEQ ID NO: 140306 - protein, 182 aa, Glycine max
  Coding DNA Sequence Number=SeqID_48621
  Gene Ontology: Mol. function=nucleoside-triphosphatase activity; Cellular component=membrane; Biological process=defense response
  Homolog annotation: Hit_ID=Q19PL1; Match level="QueryCoverage=53%, HitCoverage=4%, E-value=9e-16, Identity=44%"; Hit description=NBS -NBS-LRR type disease resistance protein
MPRLMYLRFFYNAYEGETLHFQCGGFQKLKQLQLGSLDQLKGILIDRGALCSVEKIVLEDLSQLKTVPSGIQHLEKLKNLSISNSSTEFEQRIDPDGGEDHWIIQDVPHIVLNVPNFDALKFDPLCTTMNFREARREDSLLTPTQYEEVENSVPTKTDNFLQRENSRFPQVLSFTAREMVDA

SEQ ID NO: 140307 - protein, 748 aa, Glycine max
  Coding DNA Sequence Number=SeqID_48622
  Gene Ontology: Mol. function=microtubule motor activity; Cellular component=microtubule associated complex; Biological process =microtubule-based movement
  Homolog annotation: Hit_ID=A5C201; Match level="QueryCoverage=100%, HitCoverage=67%, E-value=1e-163, Identity=44%"; Hit description =Putative uncharacterized protein
  Pfam annotation: Domain name=Kinesin-related; Domain location=94-706; Score=752.5; E_value=2.8e-223; Accession=PF06548.2; Description =Kinesin-related
SNDATLQTLRFGEQVRSIRNEPVINVVKETDADLSNNIRHLKEELIRAKDDVHSSAGSKDGYFQGHNMRESLNLMRVSLNHSLLLSNIDNDTDEHVNVNEDDIRKLRQQIDELDNSSEGNPKDISVDEDCVQFYSDEEYCDADTNSCDEVEKADVYCGKTLSNPSVATESSFRDSISLNSCNHSATLAGPQLSESPKFSKTQRRSVAISSSYLGSWNNVAESSTFSNKVLRKSFKQGDHVQSSLQSSKAKSLAASLQKGLQIIDYHQQNSALNKSSTSFSFEHLTLTPCLDIDKDDSYDQTIQQKPSSDEVTAAFLCASCWAKISNEDSSKAQAGNPDGMTDKIPKHLENVIAKSIMKEKELENVCKEQAARIEQLNQLVEKLKGEKELDSVTMYNSMKDEEKLLRGISSSGHLPCIIEENCEVKEVQEELAQSDVSFDSTEKESLLKEIQNLRSKLQLCSDAPVKKSTEKLRSSLVSRSIQLQKSGVFSYDNGNEDLENERQRWTEMESEWICLTDELRADLESYRQLTERLEMELKLEKKSSAEMDDALKRAVMGHARMVEHYADLQEKYDDLVTKHDATMEGIAEVKKAAAKASKKGHARFAKSLSAELSALRVERERESKLLKKENQSLKIQLRDTAEAVQAAGELLVRLREAEHAAAAAEENFANLQQDNENLKMQIAKMKRKHKTEINTMKQYITESKLPESALQPLYREEDSDVAHNATSSYTYDDQAWRAEFGAIYQEHY

SEQ ID NO: 140308 - protein, 131 aa, Glycine max
  Coding DNA Sequence Number=SeqID_48623
  Subcellular localization annotation: CTP_CleavageSite=47; ConfidenceScore=5.04e-01
MAKSDRKNGQEGNKLQTSSMALKCKNKIPSNGAKNLLALWQVYQIARSNNLSACQTLARGLATHSHEGFTMRRGVKERLTLLFIGANLGLRLRKLVGREASRSARVVRLAPCLHARWARPALSSLLNLSFF

SEQ ID NO: 140309 - protein, 157 aa, Glycine max
  Coding DNA Sequence Number=SeqID_48624
MIHVIVPTPNTLLTAQDQPNLTFVRESIPTTLIRDASPFTPDDSLTPEYPPDSNCEYIVDQRPFIRAYKGEAKFDEPTPSWLKVSVDLCDRWFREFKPKEFQRPTTAWEVMEKTKKLKSGEWINDKSCELASIMPAPSPSTTIADGTERHVDDTQDM

SEQ ID NO: 140310 - protein, 15 aa, Glycine max
  Coding DNA Sequence Number=SeqID_48625
MEAKREEQKGHFMGK

SEQ ID NO: 140311 - protein, 199 aa, Glycine max
  Coding DNA Sequence Number=SeqID_48626
  Gene Ontology: Mol. function=ATPase activity, coupled to transmembrane movement of substances; Cellular component=integral to membrane; Biological process=transport
  Homolog annotation: Hit_ID=A7Q947; Match level="QueryCoverage=94%, HitCoverage=21%, E-value=8e-59, Identity=51%"; Hit description =Chromosome chr19 scaffold_66, whole genome shotgun sequence
MEFKDKRMKATFEILNNIRILKLQAWEMKFLSKIIQLRKTEEIWLKKFLAGTAIIKIASFLRLEELQTDVVEKLPWGSSDKAIELVDGYFSWDLSSINTTVKNINLAIFHGMRVAVCATVGSDKSSLLSCIIGEVPKISGTLKICGTKAYVSQSPWTQGGKIEDNILFGKEMDREKHKFSDCKQLLDDCGNTCFINCRT

SEQ ID NO: 140312 - protein, 562 aa, Glycine max
  Coding DNA Sequence Number=SeqID_48627
  Gene Ontology: Mol. function=nucleic acid binding
  Homolog annotation: Hit_ID=A7Q340; Match level="QueryCoverage=99%, HitCoverage=98%, E-value=1e-125, Identity=46%"; Hit description =Chromosome chr12 scaffold_47, whole genome shotgun sequence
  Pfam annotation: Domain name=RRM_1; Domain location=339-407; Score =10.2; E_value=0.017; Accession=PF00076.13; Description=RNA recognition motif. (a.k.a. RRM, RB
  Pfam annotation: Domain name=zf-CCCH; Domain location=185-210; Score =18.6; E_value=0.0047; Accession=PF00642.15; Description=Zinc finger C-x8-C-x5-C-x3-H type (and similar)
  Pfam module annotation: Pfam domain module=RRM_1::zf-CCCH; Domain location=339-407::185-210
MDISEYTRIVFDKLQRFEPEHTTKIIGYLLLQDHGEQEMVKLASLPDHLIRGVAYKARTELQRLAARSAIQPISLPINSQQCLNHLSVISPTSVITPGTPTSPASFQVQSPYWDPQSASNTNAEFMALGYLDSISEFQKQTPLFSLDNHMDTMNSGTAGIANDYYGLDASSVSNLGGKNGRRFEFPVKTCHYFNKGFCKHGNSCRYYHEHGVPDMFSHMYGNDTFNDDPVISPGSLAQLESEIVELLKLKKGGSISIASLPMAYYERYKKVLQAEGYLTESQRHGKSGYSLTKLLARLKNSIRLIDRPHGQHSVVLAEDAPKFNGKVDYGKYISASRQIYLTFPADSTFSEGDVSYYFSTFGKVEDVRIPSQERRMFGFVTLNDPETVKVILDKGNPHYVCESRVLVKPYKEKPKFMPRKHSDRIEHSAYYSPHYVDIDTEPTSSEHDILGTWIFLLPVMNPRFLRRLLIEKQEEAAFEFQRRRFAELQMAQKSLSTSPHLGFNTDGFKVSDEHFNVQSAESHSHALNDKAGYTDNNCTDEDSNQGLNLPDSPFAFPVDSGF

SEQ ID NO: 140313 - protein, 80 aa, Glycine max
  Coding DNA Sequence Number=SeqID_48628
  Homolog annotation: Hit_ID=A2Q3F3; Match level="QueryCoverage=50%, HitCoverage=22%, E-value=8e-10, Identity=75%"; Hit description =Transport protein particle (TRAPP) component, Bet3
MVRKALECCVDSLLTGMVACYCNLFYANKPELVAHRIKAIGTTRTTGGGALESTRDVTIANEEHLSDYIEVKDELLTLGD

SEQ ID NO: 140314 - protein, 131 aa, Glycine max
  Coding DNA Sequence Number=SeqID_48629
  Subcellular localization annotation: CTP_CleavageSite=83; ConfidenceScore=5.55e-01
MSTSSGKSRKRFSGSLPEEVSSGRRLVTSERTLLPETFRKCSSGTSGRTPNGSSGSLRRSTATSYNNVVSYKQRGVRETNLVRGEEEDEVRACLAGEEEAVRGEGRTSFAEGMSSSRKVSSGEGGLFIIFY

SEQ ID NO: 140315 - protein, 34 aa, Glycine max
  Coding DNA Sequence Number=SeqID_48630
MKNLVGCPGVHDKTDHTLGDQSGSRSDHVGSTQT

SEQ ID NO: 140316 - protein, 1472 aa, Glycine max
  Coding DNA Sequence Number=SeqID_48631
  Gene Ontology: Mol. function=ATPase activity, coupled to transmembrane movement of substances; Cellular component=integral to membrane; Biological process=transport
  Homolog annotation: Hit_ID=Q9LK64; Match level="QueryCoverage=73%, HitCoverage=89%, E-value=0.0, Identity=55%"; Hit description =Multidrug resistance-associated protein 3
  Pfam annotation: Domain name=ABC_membrane; Domain location=537-806; Score=62.6; E_value=1.3e-15; Accession=PF00664.14; Description=ABC transporter transmembrane region
  Pfam annotation: Domain name=ABC_tran; Domain location=1253-1436; Score=160.2; E_value=5.7e-45; Accession=PF00005.18; Description=ABC transporter
  Pfam annotation: Domain name=ABC_tran; Domain location=880-1051; Score=151.1; E_value=3e-42; Accession=PF00005.18; Description=ABC transporter
  Pfam annotation: Domain name=Cytochrom_B561; Domain location=176-374; Score=-69.5; E_value=0.053; Accession=PF03188.7; Description =Cytochrome b561
  Pfam annotation: Domain name=DUF568; Domain location=88-216; Score =182.7; E_value=9.5e-52; Accession=PF04526.4; Description=Protein of unknown function (DUF568)
  Pfam annotation: Domain name=MMR_HSR1; Domain location=881-958; Score= -13.2; E_value=0.017; Accession=PF01926.14; Description=GTPase of unknown function
  Pfam annotation: Domain name=SMC_N; Domain location=869-1055; Score= -134.6; E_value=0.098; Accession=PF02463.10; Description=RecFRecNSMC N terminal domain
  Pfam module annotation: Pfam domain module=ABC_membrane::ABC _tran::ABC_tran::Cytochrom_B561::DUF568::MMR_HSR1::SMC_N; Domain location=537-806::1253-1436::880-1051::176-374::88-216::881-958::869- 1055
MASIRKSVLLFLTFLTVIIIPATPQPCNSYKFPNNFNYAACEDLPVLESSLHWKYHPSSGAVDVAFNKANVKGSSWVAWAINPTSKGMLGSQAFVAVYKQDGSIKAYTSPITSYATMLQEGNLTFPVYGVSASYTNGHVIIFASFQLPGNTTLVNHAWQEGLVSDDGTLRPHSFSRANLQSFGTLDFLSGKVSETGGNSDSRITLRNVHGVLNTISWGVLMPIGVILARYLKAFDGLGPTWFQLHRACQSLAFLMGIAGFGTGLYIGNHYGIHNAPHRCVGITLLCLAITQVCLAVFLRPKKDHKYRMFWNIFHYIVGYSIIALAVWNVFKGFDILNAQNIWKKTYVGSIISLAIIAVVLEVITWIWVCKKKRVKEPENHVEIVIDFVAYGKHVFLPVMYVISDIGSSITGLFLCYVGCCLNNMRKLAPLEEALLNGHSSVCNNSDSRETRVNKNLTRYSNAGFFSILTFSWISPLITLGNEKTLDHEDLPLLATDDSAYGVFPTFRNKLESECGSLRNVTTLKLAKVLFLSTWQGILLSGLFAFLYTCASYVGPFLIDIFVQYLNGDHKFKNEGYVLAMAFVAAKLVECLSQRHWMFRFQQVGVRMQSKLVAMIYAKGLTLSCQSKEVHSTGEIINLMSVDAERIGEFCWYMHDPWMCVLQVALALLILYRSVGVGSIAALAATVIVMLLNLPVASLQEKFQGKIMGFKDKRMKATSEILNSMRILKLQAWEMKFLSKIIQLRKTEETWLKKFLVGTAIVRFLFYNAPTFIAVVTFGACALIGIPLESGKILSALATFRILQMPIYSLPDTISMIAQTKVSLERIVSFLRLDEWKTDVVEKLPRDSSDKAIELVDGNFSWDLSSPNPTLKNVNLTVFHGMRVAVCGNVGSGKSSLLSCIVGEVPKISGTLKICGTKAYVSQSPWIQSGKIEDNILFGKEMDREKYDKVLEACSLTKDLEFLPFGDQTTIGENGINLSGGQKQRVQIARALYQDSDVYLFDDPFSALDAHTGSHLFKECLLGLLKSKTVIYITHQVEFLSDADLILVMREGRITQSGKYNDILRSGTDFMELVGAHKAALSSIKSLERRPTFKTSTTTKEDTSSVSYFELDKNVVYDQNDMSDDIVEPKGQLVQEEEREKGRVGFNVYWKYITTAYGGALVPFILLSTILTVAFQIASNYWMILATPMSATAEPDIGSFKLMVFYVALAIGSSIFTFARAFLAVIAGYKTATVRYAPHLPLVLRGLTCTFTAGAKTGIVGRTGSGKSTLVQTLFRLIEPVAGQILIDRINISLIEIHDLRSRLSIIPQDPTMFEGTVRTNLDPLEEYTDEQIWEALDMCQLGDEVRKKEGKLDSIVTENGENWSMGQRQLFCLGRVLLKKSKILVLDEATASVDTATDNTIQQTVKQKFSECTVITIAHRITSILDSDMVLFLNQGLIEEYDSPKKLLKNKSSSLAQLVAEYTRRSNSGFGN

SEQ ID NO: 140317 - protein, 339 aa, Glycine max
  Coding DNA Sequence Number=SeqID_48632
  Homolog annotation: Hit_ID=A7PUF5; Match level="QueryCoverage=97%, HitCoverage=46%, E-value=5e-40, Identity=33%"; Hit description =Chromosome chr7 scaffold_31, whole genome shotgun sequence
MHKYPKLFNTHNIEGFSPLKILASRPSAFKSGINLKWWEALLYHCVSAESLDVEKTKESYMKDEPAEHNKHFGIRFASRKTKKKKQLPENYDTCRRLYCAFRLFVLVPIFLIDSIGFALLRKKRKQEDPEEHQMREDSSSDHEVVPQNYVTCLQFLKLAYINIIGITGPGVGDIGKMKQKHIWSAQLLRAFMEKPYLSYTGGPPPLNEGVQTDYRKVSVDSKETVILVAARNGIVEMVNEIISKIPSAIHETNSEKKNVLLVAVENRQTLIVEALKNWFEQEKKELIFYNLKLGVDDQENTVLHLAATLPNKGWMISGLALQMMWHIKWFQVYVYDIRM

SEQ ID NO: 140318 - protein, 219 aa, Glycine max
  Coding DNA Sequence Number=SeqID_48633
  Homolog annotation: Hit_ID=A7QA99; Match level="QueryCoverage=91%, HitCoverage=20%, E-value=7e-12, Identity=30%"; Hit description =Chromosome undetermined scaffold_70, whole genome shotgun sequence
MAETAVSLAGQHALPKILEAVKMLRDLPKEVRDITDELESFQDFINDADKVAEAEQDDGRRHRIKERVMRLREVAFCMEDVIDDYNISCEDKQPDDPRCAALLCEAVAFIKTQILLLQSAYKIQDVKSLVRAERDAFQSHFPLEQRPTSSRGNQDVTWQKLRRDPLFIEEDEVVGLDGARGLLRHMLNELCKEKKEDPPKDVSTIESLTEEVRNRLHNK

SEQ ID NO: 140319 - protein, 359 aa, Glycine max
  Coding DNA Sequence Number=SeqID_48634
  Gene Ontology: Mol. function=nucleotide binding; Biological process =defense response
  Homolog annotation: Hit_ID=A7QAA1; Match level="QueryCoverage=86%, HitCoverage=37%, E-value=4e-30, Identity=31%"; Hit description =Chromosome undetermined scaffold_70, whole genome shotgun sequence
WIAEGFVKHETEKTLEEVGQQYLSGLVRRSLVQVSSFRIDGKVKRCRVHDLIHDMILGKVKDTGFCQYIEEREQSVSSKIVRRLTIAIDDFSGSIGSSPIRSILICTGENEEVSEHLVNKIPTNCMLLKLPVYTESKSTKIHWQPPEFRDLGYKRQDIGGMTSLQEIPRVFIDDDGVVIREVAKLKQLRELTVEDFMGKHEKTLCSLINEKPLLEKLLIETADVSEVIDLYITSPMSTLRKLVLFGKLTRLPNWISQFPNLVQLHLYNSRLTNDVLKSLNKMPRLLFLDLSSNAYEVPSGIQHLEKLKDLYIEDMPTEFEQRIAPDGGEDHWIIQDVPHVRIWSEDAEEPLHIFGRSHH

SEQ ID NO: 140320 - protein, 269 aa, Glycine max
  Coding DNA Sequence Number=SeqID_48635
  Homolog annotation: Hit_ID=A7PUG5; Match level="QueryCoverage=80%, HitCoverage=66%, E-value=4e-38, Identity=43%"; Hit description =Chromosome chr7 scaffold_31, whole genome shotgun sequence
  Pfam annotation: Domain name=Ank; Domain location=126-162; Score =21.6; E_value=0.003; Accession=PF00023.21; Description=Ankyrin repeat
  Pfam annotation: Domain name=Ank; Domain location=203-236; Score=2.0; E_value=17; Accession=PF00023.21; Description=Ankyrin repeat
  Pfam annotation: Domain name=Ank; Domain location=86-118; Score=4.6; E_value=7; Accession=PF00023.21; Description=Ankyrin repeat
  Pfam module annotation: Pfam domain module=Ank::Ank::Ank; Domain location=126-162::203-236::86-118
METIEEQQYGDQLTKEESQRAVELETDAEDVEIIGIRKIDIEEEKEIGPMSSEDKFRGLTVEGKWEEVIKMCEEDIKLCTIKINNKRGTALHVAVNEGNEDAVKCLVGTMIKHKRGEKALTLKNERGDTPLHLAATRGLKNICECIIGKNKERKGLITFLNDEGETPFFQVALSWQKEAFWYLCSLVPADENVNYSKFLIRNNGDSILHCAIRREFFDLALIIMYKYPKLYDIQNREGFSPLKLLATRPSAFKSGSNLLWWKRILYHCK

SEQ ID NO: 140321 - protein, 222 aa, Glycine max
  Coding DNA Sequence Number=SeqID_48636
MIEVYNWSSAEFTKECAFIYTSITDTDKRSIFRLSLNPEKRMLLRFAHSFCDAHPVRSLHMEATAERDSNGCFNFGVVRVVADGFTSEQTLRDTEHFAHLCGTKSCFYGVVRKGGNVNVGSEEKMTTWEVLLSIKGQVLREGLPKQSEGSSLIRREVDGKPPKACCAFVESEFTGQQQGEGKGTRVNIVNTGGLFHGHGNGATYENCNILMKTYFCSNCSSK

SEQ ID NO: 140322 - protein, 112 aa, Glycine max
  Coding DNA Sequence Number=SeqID_48637
MCMSRRATNSRRGLRGTNDKISNQAKGTLGSPKPSTSPGHGELEVPKHDQEEYYLTDNHDVTSPQTSGPTSFGSNPHLSVEVPFASILPSILLDTHAPKTSVGKTKQTILRY

SEQ ID NO: 140323 - protein, 185 aa, Glycine max
  Coding DNA Sequence Number=SeqID_48638
MYYYHSWLSSIYSHYKESVYGRIDKGIADTATHIYAGDPANDDSSVTYALPLKIEHTAQSQCFQLQTLSLSLRLGLLIGLVGVERRVVVVAGDEVEELLGGFGKGSVGVERSLRLGEEENEGEKKRSGEKQWPEIGEDVEEPRSEVEHGEDREGHEECHSDVVPELQQLLLDLHGKKKERKGNGG

SEQ ID NO: 140324 - protein, 243 aa, Glycine max
  Coding DNA Sequence Number=SeqID_48639
  Homolog annotation: Hit_ID=A7PLR8; Match level="QueryCoverage=27%, HitCoverage=6%, E-value=8e-08, Identity=54%"; Hit description =Chromosome chr14 scaffold_21, whole genome shotgun sequence
MTVELGQQTVENGVGQNNGTNIRTNDRKHAKVYPREARNGILDNKIDYLENKMKMVEGELREPAAIEAGLYSVVADHMALTTGLMAYEDITLSYIFMMTDHGHFCNLRGTVLGNMMGDSWDILSPSNVNVTSQDLANRLNAFNLAFDERVNGNHIPYAHNVVAVKYLNCGRDELICGSYNFNGNGSFSSAVFGSHRRVRVGEHEIKQKGEGGKGEWWGSMRENIKGKEEWCGGSDSEGKWEKG

SEQ ID NO: 140325 - protein, 28 aa, Glycine max
  Coding DNA Sequence Number=SeqID_48640
MEIVVAKGREEILEGCVGGRRGTFNIDY

SEQ ID NO: 140326 - protein, 116 aa, Glycine max
  Coding DNA Sequence Number=SeqID_48641
DRWMHFADHVLAVGELCLVPGQAGDQPRDAPAADPEEYMQPPSPQVPVAFDPPPHAVDDYDGYEAIALRLERVLNLRMVTAGTKLYDIMQDYLTIARRGASADRSVRARQRRRTEH

SEQ ID NO: 140327 - protein, 142 aa, Glycine max
  Coding DNA Sequence Number=SeqID_48642
  Subcellular localization annotation: CTP_CleavageSite=54; ConfidenceScore=5.71e-01
MLGALSNIAGAPSNLLNVPFCPSFKNFKKLSFPLSEPFTPSSLLLLFFSVSLVRLLLREPDCLFSLDQTHHLPSRRCRKKWGKGGYGGGFRKIRVGFFRNFRKKVFWKIFRRRVLPEVLKGHPEEQVFRNTYSGRRVLPDDL

SEQ ID NO: 140328 - protein, 21 aa, Glycine max
  Coding DNA Sequence Number=SeqID_48643
MARDGAWGSSWPSGERQFDKL

SEQ ID NO: 140329 - protein, 69 aa, Glycine max
  Coding DNA Sequence Number=SeqID_48644
MEKVVNISNKSACNTLFSTLLQLSTSYTIFACYTAAMLTKCEGENNKEVGKNDTTASQKVGKKDTTATQ

SEQ ID NO: 140330 - protein, 249 aa, Glycine max
  Coding DNA Sequence Number=SeqID_48645
MSSKHKPKYIYFVVPLYSVFFYSDLQDPPMFFASGMTYQFKAVFHVDRNIIEVPSVYHKQWTPDYPDYVVLDYNGKKHHIRVRKFSNRVYIVDGLKHFRRDMGIYEGVMITFAAPDKNWKFDIHFSPPLHAQTCGRPVHSAREYVFTVDVDNRMIVRLYPLVLPLDVVGYVNAGDGYVTVLGVCGHCHFWKLSMHNGLKCFADPWFQFLTENDLMAGDEVVFYFRPNQLLWEVIARKQTVWDEDEDDSP

SEQ ID NO: 140331 - protein, 174 aa, Glycine max
  Coding DNA Sequence Number=SeqID_48646
MPQIIAKATQSATPPKIIGALHLELEPDSSPTEPRELSGELAGAVPGEALLDGSVIGEPAGTADEGIPAGESGVGASATGGVPTGELTGATVGGGVAGDGAGGEETLLEGLEAGGTEDVAGGGVDPDGETAGDCEGGDKVGDFAGGAGWVAGEGGLAVGDEGDDLGEGAGALSA

SEQ ID NO: 140332 - protein, 141 aa, Glycine max
  Coding DNA Sequence Number=SeqID_48647
  Subcellular localization annotation: CTP_CleavageSite=21; ConfidenceScore=5.09e-01
MLQPYGISIGLKKHSNPVTPKAYTPKSPSGPLPPDSGNLHFLFNTAHLHFSQDNIGRFYQDSSGFLRKRKRLQCEGYFSQFRHDIEIPNGENARNWVVNVVLKFHNDPTVNESEIVIFLGQVWWAAGKKERVLRGEGKKRK

SEQ ID NO: 140333 - protein, 154 aa, Glycine max
  Coding DNA Sequence Number=SeqID_48648
MKLVVDPWTSRSLVPKVFLKGESMDRDNVTQPPTCLNCSKCEYPCQQQPSTPLPYLAPPPLQPSSPPPYGYSIYGAPPPPKEKDKDPSKCPPAAGVQCCTPPAPYAKGIGCVLANDQNGLCKILTQRQVFEGKTFFFVYVNPMSKGVVSAYGRR

SEQ ID NO: 140334 - protein, 235 aa, Glycine max
  Coding DNA Sequence Number=SeqID_48649
  Homolog annotation: Hit_ID=Q2PEU1; Match level="QueryCoverage=26%, HitCoverage=31%, E-value=1e-07, Identity=40%"; Hit description =Putative uncharacterized protein
MMFMLRKTLKWNVDDVGNALTAFFRRCLGALIDPWSLALACGHVHTSYVVYVHGGCIDLVGRPLCGKLKWLKNLSISEGMLRTFNSFMVIVLDGAHGTPSGLGRRVDTLRAISLVLDTVRTALHLRVEVRKNPKVNYDGQQLSYKSKYGIEDKTELLQLDAYPTVMEDLQTFAACSGAFEDPDIIHVDDIVDPVRDLEVITEELRLKSVIYITDVEMRVYQGGFGLKTALDNVNF

SEQ ID NO: 140335 - protein, 293 aa, Glycine max
  Coding DNA Sequence Number=SeqID_48650
  Gene Ontology: Mol. function=NAD-dependent histone deacetylase activity; Cellular component=chromatin silencing complex; Biological process=regulation of transcription, DNA-dependent
  Homolog annotation: Hit_ID=A7Q987; Match level="QueryCoverage=85%, HitCoverage=42%, E-value=1e-93, Identity=70%"; Hit description =Chromosome chr19 scaffold_66, whole genome shotgun sequence
  Pfam annotation: Domain name=SIR2; Domain location=13-171; Score =80.5; E_value=5.5e-21; Accession=PF02146.8; Description=Sir2 family
MIKKSKHLVVFTGAGISTSCGIPDFRGPKGIWTLQREGKALPEASLPFHRAAPSMTHMALVELEKAGILKFVISQNVDGLHLRSGIPREKLAELHGNSFMETCPSCGEEYFRDFEVETIGLKETSRRCSVAKCGTRLKDTVLDWEDALPTKEMNPAEKHCKQADIVLCLGTRTSLFLNRPDNHWLKFCGKSFTALVIPKCTDILTSCSESQQLWHVWLSPMDNSLQITPACNLPLKALRGGGKVVIVNLQFILSCGQKWVIGSQGSAAYISWHMASWFGEFTLGRIKGGMAEF

SEQ ID NO: 140336 - protein, 119 aa, Glycine max
  Coding DNA Sequence Number=SeqID_48651
MVTGVVGGIPTEGANAELNDGELGGGVSDLQSDVRTWRRSSASDGSKFAVVTVFEGNATPHCVAVVADPRARANARESAGEGSLCGFIGCALVLQFLVGGLEEGQRKIVGEGGDVNGVV

SEQ ID NO: 140337 - protein, 395 aa, Glycine max
  Coding DNA Sequence Number=SeqID_48652
  Gene Ontology: Mol. function=transporter activity; Cellular component= intracellular; Biological process=transport
  Homolog annotation: Hit_ID=O48939; Match level="QueryCoverage=77%, HitCoverage=98%, E-value=1e-119, Identity=65%"; Hit description =Polyphosphoinositide binding protein Ssh1p
  Pfam annotation: Domain name=CRAL_TRIO; Domain location=84-262; Score= 21.7; E_value=6.2e-06; Accession=PF00650.11; Description=CRALTRIO domain
  Pfam annotation: Domain name=CRAL_TRIO_N; Domain location=3-75; Score= 13.7; E_value=0.003; Accession=PF03765.6; Description=CRALTRIO, N -terminus
  Pfam module annotation: Pfam domain module=CRAL_TRIO::CRAL_TRIO_N; Domain location=84-262::3-75
MGGGNQEAVKQLQTLMENVDDEQLKNTFQIMHQGYQTETLIRFLKARDWSVAKAHKMFKVLQLIDCLNWRVENEIDNVLRKPIPTDLYKAIRDSQLIGMSGYSKEDLPVIAVGVGLSTYDKASPTATRKHGRYIGTCVKVLDMSGLKFSALNQLRLLTAISTIDDLNYPEKTDTYYIVNAPYVFSACWKVVKPLLQERTRRKIQVLQGCGKEELLRVMDYASLPHFCRKEDSKSSKHHASGNSENCFSFNHAFHQQLYNHIKQQAIIMESISPIRQGSFCVDIPEPDPDDAKIAKTIENEFHKLENQKNGFTNSLTGLLQLMAIESYATKASNCFWPLLSHFYLLITLWSLLEKEGYTCRSYLYPVIRSNIVMFASTRCKILQADLNLISTTTLR

SEQ ID NO: 140338 - protein, 263 aa, Glycine max
  Coding DNA Sequence Number=SeqID_48653
  Gene Ontology: Mol. function=nucleoside-triphosphatase activity; Cellular component=integral to membrane; Biological process=transport
  Homolog annotation: Hit_ID=Q9LK50; Match level="QueryCoverage=98%, HitCoverage=37%, E-value=1e-109, Identity=71%"; Hit description =Putative white-brown complex homolog protein 27
  Pfam annotation: Domain name=ABC2_membrane; Domain location=1-202; Score=132.9; E_value=9e-37; Accession=PF01061.15; Description=ABC-2 type transporter
RTFKIRCKDYFDKLRLVQALGIALLLGLLWWKSSTNTEAQLRDQVGLAFYICIFWTSSSIFGAVYVFPFEKYYLIKERKADMYRLSVYYACSTICDMVAHVLYPTFFMVILYFMAGFKRTVACFFLTLFSILLIAITSQGAGELFGAAIMSVQRAGTAASLILMLFLLTGGYYVQHIPKFMKWLKYLSFMYYGFRLLLKVQYSGDQLYDCESKGGCRTLQSSPTFGIVNLKGGLKEVWILLAMALVFRLLAYLCLRRRIDHSN

SEQ ID NO: 140339 - protein, 805 aa, Glycine max
  Coding DNA Sequence Number=SeqID_48654
  Gene Ontology: Mol. function=protein binding
  Homolog annotation: Hit_ID=A7Q9D7; Match level="QueryCoverage=99%, HitCoverage=84%, E-value=2e-75, Identity=30%"; Hit description =Chromosome chr19 scaffold_66, whole genome shotgun sequence
  Pfam annotation: Domain name=WW; Domain location=178-208; Score=38.6; E_value=2.3e-08; Accession=PF00397.17; Description=WW domain
MGKRKERRRLAALGNAGRRVKLDLFAEPSGELGGSTLHGDAGGDTDSQHRDGSPNSPSSSGQQPQNPLLLLGQYSDDEGDAGSSKGLNDANVQSPMLNEETKGVHDEESKDLDISVPVDLVAQSNGLQNTIQNSASLDVAYSERNESDGAAGSLQNEMISKDQIYVSESYDEQVVTDVGLGWKMVMHEESQRCYYWNIETGETSWEVPQVLAHADQLANDSIPHAFVNDKTKSAAVGDNSNVLSAVMQDTSSAFIIDCSLEATVASHKELYGHGSQINGGSVECTNQNQGSDVNGNELTRNDGHMSLSDKGHHSSVSKFGVEEQQLDIVFPSRLVEQSESLLERLKSLKNVKSLYLPVPDLTNRILHRSKDNLQGQDFLSKYMLEIEIRLSDIRSLASYGSSLLPFWEHSDRKIKLLESLITDDLMQTGNSSHDEVEDVEDKLVPVSEELADQLNGMGHESEVDNNKNKGSLLTCDVSNESQVDASAAVLEDINNNISANGQHVPLSSSPGSHMETDVEINSKVEAIINPQEPIHKHGYNVGEDVDMDVDMEVEDMNSSGNTTVIDVPVANDSVHTDQLVQLNPPVDYHSVLPEEGEFVPPPPDDEWIPPPPPDNEHVPPPPPPDNDQVPPPPGDPLAPSYSVLPCYAETGQPLSYAQYSLYPGVAAEYYGQTAAEVPSSNIYGQIAMPPAQIYYNTAVPNIYSENPQFMINPTGTVAYYEVQDGAGSKSIPAININDSGVGEADWASCDSPSTSSSIHAPATVSVDEGVSLPPATAKSAAENNTSSLVPKAQTKGTDTEQVYCY

SEQ ID NO: 140340 - protein, 103 aa, Glycine max
  Coding DNA Sequence Number=SeqID_48655
MAGGDCLHAESAGNGVVGRPNGGFDIEGESGGVLRGLGGCVGVPIGEQRRRRLRLLLAALPREPTLHFSRRFPQMQLRSLLEESHKPSRRGNGTRVCDSLSLD

SEQ ID NO: 140341 - protein, 1024 aa, Glycine max
  Coding DNA Sequence Number=SeqID_48656
  Gene Ontology: Mol. function=microtubule motor activity; Cellular component=nuclear chromosome, telomeric region; Biological process =microtubule-based movement
  Homolog annotation: Hit_ID=A7Q9E6; Match level="QueryCoverage=91%, HitCoverage=97%, E-value=1e-173, Identity=64%"; Hit description =Chromosome chr19 scaffold_66, whole genome shotgun sequence
  Pfam annotation: Domain name=CH; Domain location=54-174; Score=43.0; E_value=1.1e-09; Accession=PF00307.22; Description=Calponin homology (CH) domain
  Pfam annotation: Domain name=GBP_C; Domain location=187-433; Score= -142.9; E_value=0.03; Accession=PF02841.5; Description=Guanylate -binding protein, C-terminal domain
  Pfam annotation: Domain name=Kinesin; Domain location=441-649; Score =190.3; E_value=4.8e-54; Accession=PF00225.14; Description=Kinesin motor domain
  Pfam module annotation: Pfam domain module=CH::GBP_C::Kinesin; Domain location=54-174::187-433::441-649
MPQESSQNSFFTSPSKRGLKGLVSINKEPSCTAATDESFNDNELAQRKAEEAASRRYKATEWLRQMDHFASSSLSPTPSEEEFCLSLRNGLILCNVLNKVNPGAVLKVVDNPGLAVQSAEGAAHSAIQYFENMRNFLEAVKDMQLLTFEASDLEKGGSSNKVVDCILCLKGFYEWKLSGGVGVWRYGGTVRITSFPKKSPSSTVGSESADESLDESESSQYEQLLEFLQLSEDFLIEETRTANALAFLYDHFGLRLLQAYLREANNGIEDLPLNAMVIDTLLSKVVKDFSSLLVSQGNQLGLFLKKILKGDIGCLSKREFIEAISLYLNQRSSLASNDFSKFCNCGGKRDSIRQNANYSEKYVEVINTQQKQLEGMKYFFEETKLEVRQIQSEWEEELSRLEHHIKSLEVASSSYHKVLEENRLLYNQVQDLKGAIRVYCRVRPFLPGQSNGPSTVDYIGENGDMMIVNPLKHGKDARRVFSFNKVFGTSVTQVPVTCTQDVLDLMRIGQKNRAVGATALNERSSRSHSVLTVHVRGRELVSNSILRGCLHLVDLAGSERVEKSEAVGERLKEAQHINRSLSALGDVISALAQKSPHIPYRNSKLTQVLQDSLGGHAKTLMFVHINPELNAIGETISTLKFAERVSSIELGAAQSNKETGEIRDLKEEISSLRLALEKKEAELEQCKAGNARNTIDSQKPRAVSPFQLPKYGTSGNMKHESGQRLMDDRNFESRSCSSGKQRRSRFPSAFIDKDSMPKMSLLTEEKLVSSGKGRSQSPPVRRSLSNDRGTTIKSKVKTETVDNQPILKHPFPARVPANKSLATMPVAASTDNNTRMYVNSQEPVKQKNISETLFNLQKVNYKKVNQEHEEEQFKQALSAVRQGGIRKSKVESMAKAKHPQLSPFKIQKPDLIPTFIPDMDFAGEINLEQPPKNDYSEAENDLRFMETAVHGALSLKKIRQNFARNFQNLESRGIVQTGEPLLVSKVENKVVNGSGSNIKEGSNASTPEFRRSRSTPRGKFFGLS

SEQ ID NO: 140342 - protein, 49 aa, Glycine max
  Coding DNA Sequence Number=SeqID_48657
MSLSLRRFMALPKIVQPYPCICKEAVSGFEPMTNKSPRHNFTAAPGLAL

SEQ ID NO: 140343 - protein, 115 aa, Glycine max
  Coding DNA Sequence Number=SeqID_48658
  Homolog annotation: Hit_ID=A5BP71; Match level="QueryCoverage=65%, HitCoverage=19%, E-value=2e-11, Identity=46%"; Hit description =Putative uncharacterized protein
  Pfam annotation: Domain name=zf-CCHC; Domain location=88-105; Score =17.3; E_value=0.0036; Accession=PF00098.14; Description=Zinc knuckle
MVIIVNAEACGYVSLNYYQYIDVVYTNEHILKAYSAQWWPLGNEAAIPPSNDAWTLIPDPITIRAKGRPKSTRIRNEMDWVEPSEHRQKCSRCGTEGHNRRRCPMQSERGSCSNH

SEQ ID NO: 140344 - protein, 132 aa, Glycine max
  Coding DNA Sequence Number=SeqID_48659
MQVAGVIGAFGDEVTPGTGLASGVSSFRQVGLVSQTGELRVGEFRGLQAAEAISEGVVRNAQRLQGVARLNGELVGQKRHPLQRFQLLEVLKSPLPRRPFTRKKKRRKEEAFVAAFVFHTGERRRAVASICV

SEQ ID NO: 140345 - protein, 164 aa, Glycine max
  Coding DNA Sequence Number=SeqID_48660
  Homolog annotation: Hit_ID=Q1SN17; Match level="QueryCoverage=82%, HitCoverage=33%, E-value=1e-11, Identity=30%"; Hit description =Transposase, putative
MDEDQWMYDSMMSQEVEMNDENEKDVGVKVDCSDAFNTSELFGSRDEVLQWARSLAHDIGFVAVIMRSYTNIGVRGKVSFLLIACERSGEYRPKKYNLVRTCTGRLTKDEKIVVADMTKSMVKQKNILLTLKEHNDNSYTTIKQIYNARHAYRSSIRGSNTELQ

SEQ ID NO: 140346 - protein, 151 aa, Glycine max
  Coding DNA Sequence Number=SeqID_48661
MSEFHDDHSFYCDEEIQEWLKDKDERLHPSTMSSWTLLLPLKILSLNLKIHPALLSESYSMGYTSEVLSSNTVSACTAVNYFKKCCSVLVKSKAGVRSEQPQRLHATAMTTTSARRTKELDEFLKVLSASQDSSPQPEVLASAPSTQAPAY

SEQ ID NO: 140347 - protein, 401 aa, Glycine max
  Coding DNA Sequence Number=SeqID_48662
  Gene Ontology: Mol. function=identical protein binding; Cellular component=extracellular region; Biological process=negative regulation of catalytic activity
  Homolog annotation: Hit_ID=A7Q9H4; Match level="QueryCoverage=81%, HitCoverage=60%, E-value=2e-76, Identity=41%"; Hit description =Chromosome chr19 scaffold_66, whole genome shotgun sequence
  Pfam annotation: Domain name=Peptidase_S8; Domain location=1-355; Score=-76.1; E_value=0.011; Accession=PF00082.13; Description =Subtilase family
MEWFPMIPYGEGVIIDNIDTGVWPESKSFSDEGMCPVPSRWRGICQLDNFICNRKLIGARFFSNGYESKFGKLNKTLYTARDLFGHGNGTAKGGSPRAYVAAYKEGSPKNPTCWLGTIDLECTDADIMEAFEDAISDRVDVISCSLGQPTPTEFFEDGISIGASHAIVNDRIMLTGGGNAGPEPGTGASLSTGLPYKKFYSLINSIDAKVANATIEDAQLCKAGTIDPKKAKGKILVCLLKKEVDGLSYAEGSPMAYMTRAKTLLGLKPAPVIASLSSKGPNPIQLSILKPDITAPGSGTFASFPHVSGIIGLLKRLYRNWSPAALKSAIMTTGHAIPALTMLIFKKIPHQRHTSEHTCATHSTTHVVLEPKIRINLTRPNMVMFSSARFSTASADLRTAI

SEQ ID NO: 140348 - protein, 591 aa, Glycine max
  Coding DNA Sequence Number=SeqID_48663
  Gene Ontology: Mol. function=aspartic-type endopeptidase activity; Cellular component=cytoplasm; Biological process=protein modification process
  Homolog annotation: Hit_ID=A9PEP6; Match level="QueryCoverage=100%, HitCoverage=100%, E-value=3e-95, Identity=62%"; Hit description =Putative uncharacterized protein
  Pfam annotation: Domain name=Asp_protease; Domain location=197-286; Score=52.4; E_value=2.3e-15; Accession=PF09668.1; Description =Aspartyl protease
  Pfam annotation: Domain name=UBA; Domain location=552-588; Score =41.6; E_value=2.9e-09; Accession=PF00627.22; Description=UBATS-N domain
  Pfam annotation: Domain name=ubiquitin; Domain location=6-74; Score =62.4; E_value=1.6e-15; Accession=PF00240.14; Description=Ubiquitin family
  Pfam module annotation: Pfam domain module=Asp_protease::UBA::ubiquiti n; Domain location=197-286::552-588::6-74
MKITVMTADEQIITLDVDPHESVENVKALLEVETSVPLQQQQLLFNGKEVRNSEKLSALGVKDDDLLMMVSGAGAGATASSGSTNDLSLNADGSAVNPGSFQQHIRHDSNLMSQLFQSDPELAQAILGNDLNKLQEVLRLRHHQRDELKRQKEEELALLYADPFDVEAQKKIEAAIRQEGKKLMNMGPTGAIPSQVEKGIDENWAAALEHNPEAFARVVMLYVDMEVNGVPLKAFVDSGAQSTIISKSCAERLGHCLPVLLNGGHGGAMADLGGGFAKKRHRIAVAWRVWDGGRGGYGGVAEMAGFCLVFVRGRSWADPTQPYPPLRPSRTSASSLTPPHPAAAATGDTRSPHTQPPPPATPLTLRRRLTSRRAPARHELRRRTAFLLSREEDEEAEEDKLADQRYRGIAHGVGQSEILGRIHVAPIKGKMIGEMSLQFSHEQVSISSGFLVSDWEYILPLLILGAGFSQYGVSLWTGYAPKAPENVLRVGGGEVSVPFLQEKDIPSRFLDEEKYAKEASGSGGQVASGSNNPSTGGHSSGGASGDRTKDSEFEAKVAKLVELGFERNAIIQALQLFNGNEEQAAGFLFGG

SEQ ID NO: 140349 - protein, 262 aa, Glycine max
  Coding DNA Sequence Number=SeqID_48664
  Gene Ontology: Mol. function=RNA binding; Cellular component =nucleolus; Biological process=biological_process
  Homolog annotation: Hit_ID=A7PGM2; Match level="QueryCoverage=83%, HitCoverage=100%, E-value=9e-98, Identity=81%"; Hit description =Chromosome chr17 scaffold_16, whole genome shotgun sequence
  Pfam annotation: Domain name=KH_1; Domain location=141-193; Score =26.0; E_value=0.00014; Accession=PF00013.20; Description=KH domain
MESNQEASSMEVETVPSEAKLLPPKPKFEPLKPHEMSDGQVQFRKVNVPPHRYTPLKKAWMDIYSPIYEQMKIDVRMNLKARRVELKTRPDTPDISNLQKCADFVHAFMLGFDVIDAIALLRLDELYIESFEIKDVKTLRGDHLSRAIGRLSGKGGKTKFAIENASKTRIVIADTKIHILGSFANIKIARDSLCSLILGSPAGKVYSKLRAVTARLAERFFNDFCEIKYDEDEFLWEAASKNPDRFCLPMCRVHYQGARANR

SEQ ID NO: 140350 - protein, 149 aa, Glycine max
  Coding DNA Sequence Number=SeqID_48665
MTSLPEIPPVIIDDDGVVIGEVGKLKQLRELLVLDFRGKHEETLCSVINEMPLFEKLRIRTADESEVIDLYITSAMSTLRKLVLSGMLTVFAPLQWRVSETKATVPRKFASIEVHPYRQRSTVFCGRNCFKRPLPTQNSSLWNSTPGET

SEQ ID NO: 140351 - protein, 271 aa, Glycine max
  Coding DNA Sequence Number=SeqID_48666
  Homolog annotation: Hit_ID=A7UQU7; Match level="QueryCoverage=53%, HitCoverage=24%, E-value=4e-20, Identity=37%"; Hit description=IMP dehydrogenase/GMP reductase, putative
ALRDLTQTRRYAWGAAGLVHMYDHLNDASIGTNRYVAGYIMLLQCWIYEHFSLVAECNADSEYDEVSLYACRWIATKKIVKKISTATYKQRLDHLRIPDVCWMPYAEHRPVQDFHPISCFSRQLRWGPVVVRYRPETVMRQFRYVQCIPAHPVDSWVSFDDVDDRWTHYSDHLALTSNPPRDAFAAQPRHIPQEPAPGSTHADSDADEPRHAVEACHAIAETLEHHLSLNEVTLGTLTHEVIQKCLRIDRGVTEDRNVYVRSRRRRRTDQP

SEQ ID NO: 140352 - protein, 128 aa, Glycine max
  Coding DNA Sequence Number=SeqID_48667
MKADAYLDGAAPTEKKNAQSRGDEEERASTMLKKNVQQQPHRRQLKNAQKKTKMNSSHGRKKERKRRRGRKKELLGAPAIILGAPSNSPNQTLLHLSSKNITTEGGFERNKMVLRICEAGLDCYNGHA

SEQ ID NO: 140353 - protein, 168 aa, Glycine max
  Coding DNA Sequence Number=SeqID_48668
  Gene Ontology: Mol. function=protein transporter activity; Cellular component=integral to membrane; Biological process=protein transport
  Homolog annotation: Hit_ID=A9PJK2; Match level="QueryCoverage=86%, HitCoverage=41%, E-value=2e-55, Identity=74%"; Hit description =Putative uncharacterized protein
MKKSSGSAADKKRVRRSSALDPTSDAPPRKQAVKKDVFRVFAEKVRDHKELVSRWAVLQETRVEYFRGKDFVSFLKSHPELKDVLELDRILETEEIANILLAKNLLVRCDRVVKTVRPGKKKLSTWPAHLEIFPYGEIFDVGNLWSFSMDGLGLPMPDIVTRAMLRNG

SEQ ID NO: 140354 - protein, 462 aa, Glycine max
  Coding DNA Sequence Number=SeqID_48669
  Gene Ontology: Mol. function=binding; Cellular component=cytosol
  Homolog annotation: Hit_ID=A7NZQ7; Match level="QueryCoverage=93%, HitCoverage=65%, E-value=1e-166, Identity=70%"; Hit description =Chromosome chr6 scaffold_3, whole genome shotgun sequence
  Pfam annotation: Domain name=Arm; Domain location=231-271; Score=3.5; E_value=3.9; Accession=PF00514.14; Description=Armadillobeta-catenin -like repeat
  Pfam annotation: Domain name=Arm; Domain location=274-314; Score =19.5; E_value=0.013; Accession=PF00514.14; Description=Armadillobeta- catenin-like repeat
  Pfam annotation: Domain name=Arm; Domain location=316-356; Score =38.1; E_value=3.1e-08; Accession=PF00514.14; Description =Armadillobeta-catenin-like repeat
  Pfam annotation: Domain name=HEAT; Domain location=109-145; Score =7.7; E_value=1.9; Accession=PF02985.13; Description=HEAT repeat
  Pfam annotation: Domain name=HEAT; Domain location=236-273; Score =24.9; E_value=0.00029; Accession=PF02985.13; Description=HEAT repeat
  Pfam annotation: Domain name=HEAT; Domain location=285-316; Score =7.2; E_value=2.3; Accession=PF02985.13; Description=HEAT repeat
  Pfam annotation: Domain name=HEAT; Domain location=327-358; Score =4.3; E_value=6.1; Accession=PF02985.13; Description=HEAT repeat
  Pfam annotation: Domain name=HEAT; Domain location=369-401; Score =9.9; E_value=0.9; Accession=PF02985.13; Description=HEAT repeat
  Pfam module annotation: Pfam domain module=Arm::Arm::Arm::HEAT::HEAT:: HEAT::HEAT::HEAT; Domain location=231-271::274-314::316-356::109 -145::236-273::285-316::327-358::369-401
MAVVDAAARSLRMIYQSMLAPKYDFFQEENMQFLLSLLKSENENLTGLGAGIVIHSCKTIGEQNILCHAGVLEKLTSLLEGSLSQRDASLESLAAIIRDNPVSVSEFVELHSGRALHSVTELTKDRYPRTRLLACLCLISVKNSSTCYLQDVGIKTKLVYILLELLDDSGQVGDEASFAFSRLIAEKEDLQKLAFEANAINKFNCLLQKRPVHPKRLEGVFLALADLCSKLECCRSSFLSLQVLNLVVDALTHEDASVRTAACICLRSVSRSIKNLSAGRFMNERVVFPLVQLLSDLSTSVQVAALGAISNIVVDFMPHKSTFIQCGGIKELVQLTKSMDSSLRLNAVWALRNMVFLADKICKEGIFVELTASSMASLICDPEPSVQEQALALVRNFVDGCVYSVEHAFAEDGIILDAVGRQLQKSSKIEIGIQNDDIELQQQQQQRLIPLGGVGYMDQLPP

SEQ ID NO: 140355 - protein, 69 aa, Glycine max
  Coding DNA Sequence Number=SeqID_48670
MGCALQGTPNPGFAGRKDDDDGRRQWLMVAGDNSGRWRRQRQSEWDCTRSDTMLKLRTTLLKGLRYTLH

SEQ ID NO: 140356 - protein, 161 aa, Glycine max
  Coding DNA Sequence Number=SeqID_48671
  Gene Ontology: Mol. function=DNA photolyase activity; Biological process=DNA repair
  Homolog annotation: Hit_ID=Q6EAM9; Match level="QueryCoverage=79%, HitCoverage=24%, E-value=1e-32, Identity=49%"; Hit description =Cryptochrome 2A apoprotein
MRQWLPEMARKPTEWIHHPSDAPLPVLRAEGQQKAAGSEPRDEVVVDNSNTLENLDTRKVVVLGKAPSATILANDKKVPALQDSKTEPPTRKRQKHMVEEGKNQDNSQNHNKDTGMSSIDQDICSTADSSSFPLQYSSSSNLKWHGKIRLTWSRVQAKMLI

SEQ ID NO: 140357 - protein, 172 aa, Glycine max
  Coding DNA Sequence Number=SeqID_48672
  Gene Ontology: Mol. function=aminoacyl-tRNA ligase activity; Cellular component=mitochondrion; Biological process=tRNA aminoacylation for protein translation
  Homolog annotation: Hit_ID=O23627; Match level="QueryCoverage=45%, HitCoverage=11%, E-value=7e-25, Identity=68%"; Hit description =Glycyl-tRNA synthetase 1, mitochondrial precursor
KAAQPEIDAAIEALNALKLEKSSIERSLLGGSDCRKAFRQSVVNTLERRLFYIPSFKIYRGVAGLFDYGPPGCSVKGRVHDEEGNSDLSGRRRDERENKRGTSLEEMREGVNTWRIVEAEEEPESLLLRRWRCRPRRWASERPRVIRRLAGGNHRTYGGGFLAVSAVLRGVV

SEQ ID NO: 140358 - protein, 82 aa, Glycine max
  Coding DNA Sequence Number=SeqID_48673
  Subcellular localization annotation: CTP_CleavageSite=53; ConfidenceScore=5.12e-01
MYRHDYGELKPNASLSCSYSLRPSGVPPVIPSKHARPSRHSEWRELATAKSPSPMAVSTPISSVLLAISFHVSTACRFRHSY

SEQ ID NO: 140359 - protein, 122 aa, Glycine max
  Coding DNA Sequence Number=SeqID_48674
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=95%, HitCoverage=18%, E-value=1e-31, Identity=49%"; Hit description =Chromosome undetermined scaffold_127, whole genome shotgun sequence
MASQARKSLQNVMSHGMWRAIHCIMGMLSLFQEDNLRSEQKIVENEKGGFRLEMKPFLLHSMMREAASTAKCLCVYEGFGFEIDVQKSLPETVMGDEARAFQEILHMIGYLLNMNDKGTLNF

SEQ ID NO: 140360 - protein, 123 aa, Glycine max
  Coding DNA Sequence Number=SeqID_48675
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=95%, HitCoverage=18%, E-value=4e-24, Identity=42%"; Hit description =Chromosome undetermined scaffold_127, whole genome shotgun sequence
MANQAMKSFENVMSHGMWRAMHCILGMLSLFQEDNLWSEQKIIGDIIKRKGRLSVRDETFHSMMREAASTTKCLCVYEGFGFEIDVQKSLPETVMGDEARAFQEILHMIGYLLNMNDKGTLNF

SEQ ID NO: 140361 - protein, 172 aa, Glycine max
  Coding DNA Sequence Number=SeqID_48676
MSLPAIPKDVEKTFQQQKISSSVCPLKLNMKIHKAYLVLIALELTCIGIKYGVSNTNNPFQQSSLLMLFLTAIFSHVLASTADMTKQIIIITFHISGITGCETLLWILIHDFMCYCMVNLLLLLLAKFFFFNQVAQLVVYFFKYISQLLRQVSGSNVDQMSNLELQPQQDRV

SEQ ID NO: 140362 - protein, 370 aa, Glycine max
  Coding DNA Sequence Number=SeqID_48677
  Gene Ontology: Mol. function=two-component response regulator activity; Cellular component=endoplasmic reticulum membrane; Biological process=two-component signal transduction system (phosphorelay)
  Homolog annotation: Hit_ID=A7QMR7; Match level="QueryCoverage=22%, HitCoverage=10%, E-value=6e-23, Identity=59%"; Hit description =Chromosome undetermined scaffold_127, whole genome shotgun sequence
MAGTNLQAPLIIFHLSGIVGCEVLIWVLLADIFWYSMVNMFASIVAFICFFNHILNIFADHEMPVIEMQPPEEEYLVLVALELTCIGIKYEVSNTNNPFQQSSLLFFLTAIFSNVLASTTDTTKQITIITFQVSGITGVETLLWILIPDFMCYCMVNLLLLLLALFFFNHVAQLVVYFFKYISQLLLQVSGSNVDQMSNLELQPQEDRNSILVNDSDVWEIRKNKGVKILRPNSAEVSANETEYGRAKLRTATGLKECNDGQQGKEVISECHEPLNVEGYAFLINDVMEIAENEKRGFRLEMKPFLLHSMMREAASTAKCLCVYEGFGFEIDVQKSLPETIMGDEARAFQEILHMIGYLLNMNDKGTLNF

SEQ ID NO: 140363 - protein, 51 aa, Glycine max
  Coding DNA Sequence Number=SeqID_48678
MYDSQMWIRPSKDQGKDSRQRGGPYMATLSTRTFREYDTAMKLKMFACDKC

SEQ ID NO: 140364 - protein, 71 aa, Glycine max
  Coding DNA Sequence Number=SeqID_48679
MPHGLFHPRFGSLSYAYKGVNKRKRYSRKKVLPQEGKALPRKNLSFADASGRWKIWLFRGSCDTLYPSHIY

SEQ ID NO: 140365 - protein, 193 aa, Glycine max
  Coding DNA Sequence Number=SeqID_48680
MSPRKNHLPREGNGTSLTHAEEASSVDGSSTESPEVPYLPSSAGVRGRNDLLPDLQQHRYTRGRNEPSVEEGSSSTSRNENQHRPNQTKHGVTRMLKSFKCRQWRTTRAKKKTWTRGEEEELVAERVELWSRKKKNSKVKKLWVAEEEEEIEGGRRSAFGRGRNQQGDPTIPPPPLELKAESDKIVFCNTQAT

SEQ ID NO: 140366 - protein, 130 aa, Glycine max
  Coding DNA Sequence Number=SeqID_48681
  Homolog annotation: Hit_ID=A9Y0K9; Match level="QueryCoverage=39%, HitCoverage=21%, E-value=2e-12, Identity=66%"; Hit description=ERN3
  Pfam annotation: Domain name=AP2; Domain location=23-65; Score=12.6; E_value=0.064; Accession=PF00847.11; Description=AP2 domain
MEYQNQRAKEGRFCEKLKIKNKPKFIGVRQRASGKWAAEIKHTSKKIRLQLLILRECFYFAASKQEEMPSYGVFPEYRDHPDGPPITKEISRIGHGPLRPESNEVELLLMLNQFFSPTCVTNLIAERSNQ

SEQ ID NO: 140367 - protein, 71 aa, Glycine max
  Coding DNA Sequence Number=SeqID_48682
MSYLLFLTVKANPFIHSELQISESIKSPQVGFTTSQLTADRSSPSGDGAKEVLRIQEKLRHPPVDLNLVPT

SEQ ID NO: 140368 - protein, 74 aa, Glycine max
  Coding DNA Sequence Number=SeqID_48683
  Homolog annotation: Hit_ID=A7QMR7; Match level="QueryCoverage=58%, HitCoverage=5%, E-value=9e-07, Identity=58%"; Hit description =Chromosome undetermined scaffold_127, whole genome shotgun sequence
MASQATKSFENVMSHGMWRAMHCILGMLSLFQEDNLWSEQKIIDYSRVLSQMKQFQQYIILVGGSTTTMKLRRG

SEQ ID NO: 140369 - protein, 180 aa, Glycine max
  Coding DNA Sequence Number=SeqID_48684
  Homolog annotation: Hit_ID=Q00M75; Match level="QueryCoverage=20%, HitCoverage=5%, E-value=3e-10, Identity=86%"; Hit description=PPR -repeat containing protein
MACGKIYLYIARPVQLLVGVMKFCRGIQCINSRASPGAAVKLCLGDLLVMGSNPETASLHMQGVFRIKILLAILKDVEKVCKTKQKNQKIQQVQVEEYQEHEEEKLFVTNCYVLYAAESNIDAWQINKGSSRLSLYGGIFRSLGLSFVLGLYVSRKGIIVSRCGTWIIFNTLPQGGLVEA

SEQ ID NO: 140370 - protein, 79 aa, Glycine max
  Coding DNA Sequence Number=SeqID_48685
MAETSDELIQIKIVEADLQEEVVDSSTMVLLVVHLNVVAAIREKGKFKCQILGFKQKYERGVCIAIRKVHLAKAVFFDK

SEQ ID NO: 140371 - protein, 196 aa, Glycine max
  Coding DNA Sequence Number=SeqID_48686
  Gene Ontology: Mol. function=two-component response regulator activity; Cellular component=endoplasmic reticulum membrane; Biological process=two-component signal transduction system (phosphorelay)
  Homolog annotation: Hit_ID=Q0PHI2; Match level="QueryCoverage=99%, HitCoverage=24%, E-value=1e-13, Identity=29%"; Hit description =Ethylene receptor
NSIPVSDPDVLEIRQTKGVKILRPDSALGAASSGGSAELGAVAAIYALITCNYIAVAFSCSLDLIIKLLTNNSIPVSDSDVLEIRQTKGVKILRPDSALGAASSGGSAELGAVAAIYIVSADEIEAGRAKPSTANNAMMASQARKSFQNVMSHGMRRAMHCILGMLSLFQEDNLRSEQKIIGDIMLPVGHVPSSPV

SEQ ID NO: 140372 - protein, 171 aa, Glycine max
  Coding DNA Sequence Number=SeqID_48687
  Gene Ontology: Biological process=embryonic development ending in seed dormancy
  Homolog annotation: Hit_ID=A7NYM1; Match level="QueryCoverage=88%, HitCoverage=89%, E-value=6e-51, Identity=63%"; Hit description =Chromosome chr6 scaffold_3, whole genome shotgun sequence
MECYTRPNRSDIHLSAEEEATIEAKTREYFDGVAPQRHTKPQRSDYSAQYVDAFSNAHHSSLTIPELTQFQLLQNDPQEKKLVYNGSQVPEEFVETEYYQDLNSVDKHHHTTGTGFIKVEKNGNDFHIEPDNDTGCHHSCKGNPATNDWVPAPSTEANLTGVTTRNGGVAT

SEQ ID NO: 140373 - protein, 92 aa, Glycine max
  Coding DNA Sequence Number=SeqID_48688
MGGYDEYSVIDPYYTEQQPNWFPTMQFNLNNSMGADQMVSGSTFKDSYYVITVFKCYIWVDIQRRLLQQAEREGSNEGARSKQSRVQSNLES

SEQ ID NO: 140374 - protein, 116 aa, Glycine max
  Coding DNA Sequence Number=SeqID_48689
MEGYDTMQNGFLHYDYLEAIEDDLMKDNQDDLQLNDIVAIEDDQDDQQEVQLDDDNFFEYCCFQDQLLNLDLKGEEQSPNIMKGSSAMYEQNGFAFPKNIEDELMKDDQEQDLQVQ

SEQ ID NO: 140375 - protein, 547 aa, Glycine max
  Coding DNA Sequence Number=SeqID_48690
MQQGTLTSILKKQGDEREKETKSGNTEGQIGGMHRTFAPSISQDFQRRWVRRICGLNFKKWEDVREVFIAKKKNRSGRKYGFVRFKGVEEVGMLECQLDNMVIGDLKLHANLPKHGREPVINDKSIIDMKHKVGLVMDKVAEDEQQQGKKETEHTFKNRGLLKQHPQRMQSPVSYAKGNNNMERRCFPRHVTPTRSISHSTLQPSIPIEENKWYYNAWVGRLRNLVLFDKMEDQIMWVGGEDITPKYLGDDMVLLLGLTDTRAKEMCRKGACWGIPLHAWDKENIKKNVPAVGEVVEVDDEVGELQQLDRARETCYSPNTCKWHMRSMMGSSEEISSNESKMGLPLTAANESSESKFPMNISNENGGGGKLGGVARDKQFSDGQCPTLGPKGIPYGETAGNVNRGISRPTQQLQSRGKDTKHTTARDHEEETGGNKEGGPSRLANFELKWRGSQALEEAESPLMGLATQNHNGTNAGEKDNLEVKSNGSAHTWQVYSRNKGRKKQMGLNKTADLKVGHSTHKNTNASRICNISSSVMRGNRLKEVAG

SEQ ID NO: 140376 - protein, 67 aa, Glycine max
  Coding DNA Sequence Number=SeqID_48691
MKAKKLTSDDAVLFMTAKERKLVEDDKQLPEEKLGRSHGQQIHTTNNINSSFTEEKKETNRHTKNSK

SEQ ID NO: 140377 - protein, 143 aa, Glycine max
  Coding DNA Sequence Number=SeqID_48692
  Gene Ontology: Mol. function=oxidoreductase activity, acting on the CH-NH2 group of donors, NAD or NADP as acceptor; Cellular component =chloroplast; Biological process=nitrogen compound metabolic process
  Homolog annotation: Hit_ID=Q93WZ8; Match level="QueryCoverage=30%, HitCoverage=2%, E-value=6e-13, Identity=81%"; Hit description=NADH glutamate synthase precursor
  Subcellular localization annotation: CTP_CleavageSite=54; ConfidenceScore=5.06e-01
MCALYQFVRLSFKLWPQKMHLGMITGRSNVTLLILVPAKTFQFLTPLVAPRIVPAFSLSKQQGPPPPPPPISLFHTKRDTVCSNKFWAFGGNVVAMDKDSCGVGFVAELSGESSRKTVIDALKMLVRMTHRGAYGVKPTLEME

SEQ ID NO: 140378 - protein, 89 aa, Glycine max
  Coding DNA Sequence Number=SeqID_48693
MEDDYFCKMSDEVDMDMYKNMDDTVKNEACSIFLQLHSTKERGQTKSHDVVRKVQGERGGVEEGGIVAVNHMSLQEGGIIITGREVPRH

SEQ ID NO: 140379 - protein, 532 aa, Glycine max
  Coding DNA Sequence Number=SeqID_48694
  Gene Ontology: Mol. function=binding; Cellular component =intracellular; Biological process=RNA processing
  Homolog annotation: Hit_ID=A7NYI9; Match level="QueryCoverage=99%, HitCoverage=99%, E-value=1e-139, Identity=53%"; Hit description =Chromosome chr6 scaffold_3, whole genome shotgun sequence
  Subcellular localization annotation: CTP_CleavageSite=80; ConfidenceScore=5.86e-01
MGIKVMQLSQPVLPHSPSSSHTLASAIFSPSSSKTRTLVCRFVHRSSLFPTTTTRLLRRTKSFEQHALFTRRGNIRRACSASLEPFSDEEFAKKIEDLALKFQLSDDATTNANDLESEDFQEISSTVNFAEEFEPPEEIIPANIERKANSVELPFSLRIIKKKLQWKEGFREAGESAYCSVKKAFSSMVFIIRELHSFTLQMREVLFYEDLQGILERVQNEMHASFVWLFQQVFSHTPTLMVYVMILLANFTVYSMGNNAAIAAVAPPPVSTVTEAHDQRGHIRGHNIDSSAIKTFSVSNGKITAYVGGGNGGGGKVRPAANGTDGDGRFDRSRHGTVFSDGGASTQAYKTGEKTESVSGQEEEEEENLWNAMVEEASRMEVSWRGKDLDSDVMKRFVSPVMASIESDDYAEYLRTELVYQTGLSQDPNNTLLLANYAQFLYLVAHDYDRAEEFFKRAIEVEPPDAEAYNKYATFLWKVKNDLWAAEETYLEAISADPNNSFYAANYAHFLWNTGGEDTCFPLSSPDNSQEV

SEQ ID NO: 140380 - protein, 146 aa, Glycine max
  Coding DNA Sequence Number=SeqID_48695
  Homolog annotation: Hit_ID=A7QA96; Match level="QueryCoverage=66%, HitCoverage=10%, E-value=2e-07, Identity=39%"; Hit description =Chromosome undetermined scaffold_70, whole genome shotgun sequence
TGEDEAVSEHLVNKIPTNYMLLKLPVYREISKLKKLRHLLSGYIPSIQWKDIGGMTSLQEIPPVIIDNDGVVIREVGKLKQLRELTVIDFTGKHKETLSSLINEMPLLEKLLIDTADESEEACPMGDVNKVSKLDFTVPKPELELE

SEQ ID NO: 140381 - protein, 228 aa, Glycine max
  Coding DNA Sequence Number=SeqID_48696
  Gene Ontology: Mol. function=protein dimerization activity; Cellular component=nucleus; Biological process=regulation of transcription, DNA-dependent
  Homolog annotation: Hit_ID=Q5JMK6; Match level="QueryCoverage=59%, HitCoverage=53%, E-value=8e-12, Identity=30%"; Hit description =Putative transcription activator RF2a
  Pfam annotation: Domain name=bZIP_1; Domain location=100-163; Score =29.8; E_value=1e-05; Accession=PF00170.12; Description=bZIP transcription factor
  Pfam annotation: Domain name=bZIP_2; Domain location=101-154; Score =33.0; E_value=1.1e-06; Accession=PF07716.6; Description=Basic region leucine zipper
  Pfam module annotation: Pfam domain module=bZIP_1::bZIP_2; Domain location=100-163::101-154
MGEAANKICLASLKNQSCHVFGNAEGRTKLNLDLKLGLSDIYSAQARDNHYNNHTFNQVEENFIHGSSSTHGVGINFNTNQTYEGQASKPGLDLNMATKMEDPKRLKRIMANRISSRRYRLKKLDRMDQLEKQIKAIRQQISNLRQQIGEAKNKQQSLRIEQQHLKFRIADFQNEKIVREVEIGNNMEEVKRLRELHINQLQTNAQPAMPNSDDGHAVEAQLDLNLGL

SEQ ID NO: 140382 - protein, 42 aa, Glycine max
  Coding DNA Sequence Number=SeqID_48697
MASCPHPGTKVLGNTQVPHRLPQSLECGLYICWATSLNANWF

SEQ ID NO: 140383 - protein, 32 aa, Glycine max
  Coding DNA Sequence Number=SeqID_48698
MANMVRSCTSSSNLNALLRITVVMNMMALGNM

SEQ ID NO: 140384 - protein, 86 aa, Glycine max
  Coding DNA Sequence Number=SeqID_48699
MGAEHGVVEGGEKQEIMALPLIVASAFFFFFFFFARCYLLNKTRIFISTGSRFYTWTLHTEQDPSTWVTNDYRILYLFHFVMFKLN

SEQ ID NO: 140385 - protein, 82 aa, Glycine max
  Coding DNA Sequence Number=SeqID_48700
MLNPTQFQAKKEKVQVVDDSLSEADSLSEWHPLSEAYNSLNSEPVLLSEPVSLNESSKVKESKSLYNTKVGRISRENTFCEE

SEQ ID NO: 140386 - protein, 849 aa, Glycine max
  Coding DNA Sequence Number=SeqID_48701
  Homolog annotation: Hit_ID=A5BKF5; Match level="QueryCoverage=76%, HitCoverage=60%, E-value=6e-42, Identity=26%"; Hit description =Putative uncharacterized protein
MGLNVKDIQIRLFKVVQDSANFLVCMSPFLVCAVIFIKIFWSSEQTQLKYVKTKEEKGGQKKVEPKCPKIPNNRRPEMLCKYPSQNATSKRRNFSDKNWDVYSGLEDKAKDLSAVFHNEFTKRNIENKGARSFEKGESSLDNRLSAKKTQVPKRQILRSEPSMVDLVECGDLEIEKKIEDGDDEDGEETQEESNKAIEWTEDDQKNHMYLRNSEMERNRRMESLIARRRAKKLFKGQIEKGQIDKKSMAPVLTKRRNHLDSSKDFDDGLDMPGSAPSFMPRSPYDIPYDPSEEKPNLTGDSFPKEFSSQKDMPFSRHGSFSSTHLFPSETKHDHGAREHYYFNKGSKYSDRLAYSRFRRHHTDKGTHDWLIDQLIYNEGGENGLQIPNTLTNGEESTHEEDRKCKTDGENMKDENDHETKSMSGQISEPGSDRSRPWPTFPKPHRRLLTFPVSTTATTHTTNINEALYETVTSIVDKRQESIFLTHGRICHTPTYSVASDLQVEVSEVGSPTSTVGENAETNSSIDRDSILYDGDIDRDVSSGSEELWGASFHGGKEAQGVRSEADDNAEVNNNSKDVVSSTTPRHIDENEADVSSMSSKSDVPEDTPTHASHHNFFGYMKHPEWCNMPENVTNEAQVINAVNNSTSTEQDNTDNLRSNEDPGTSVMRQESIDETFNGSVSSSPRSVLPEITMADEVSPSAFDQDLHIDAQQFIMEGLAQETLNSESPPDTMPQTIQPTMDDTTDESHSVDFNFNHCQEQTNHLENCIEESNVFGSMNDEVSNMEEEDKSKNDENSEDNSYHLNRQEATTESTRPISEIATLEDMVPSTELIEDDKNDKPSSSSNIQKE

SEQ ID NO: 140387 - protein, 402 aa, Glycine max
  Coding DNA Sequence Number=SeqID_48702
  Gene Ontology: Mol. function=hydrolase activity, hydrolyzing O -glycosyl compounds; Cellular component=integral to membrane; Biological process=carbohydrate metabolic process
  Homolog annotation: Hit_ID=A7NYK5; Match level="QueryCoverage=50%, HitCoverage=33%, E-value=1e-73, Identity=68%"; Hit description =Chromosome chr6 scaffold_3, whole genome shotgun sequence
  Pfam annotation: Domain name=Glyco_hydro_3_C; Domain location=97-292; Score=69.1; E_value=1.5e-17; Accession=PF01915.13; Description =Glycosyl hydrolase family 3 C terminal domain
MTSIVSGLQGQPPQGHEHGYPFVAGSYTSGTMSLHVPSILLEMEVPTKGFVISDWEGLDQLCEPHGSDHRYCISSAVNARIDMLHRDLARKAVQKSLDLLKNGKDPSKPFLPLIRNAKRMLVAGTRADDLGYQCRGWTKAWYGMSGRITDETTILDVVQATVGAETEVTYEKYPSIYTIERHEFSFAIVAVGEAPYAETWGDNSELTIPVNGADIISLVADQIPTLVILISGRRLVLEPRLLEKIDALVAAWLPGNEGEGIIDVIFCSHDFKDKLPVTWFRRVERQISQIGGRVTWRWCRHSHKCLAFCLRGIENTSTNGELVMAPVKRETLGLQRCRVQVRVVATQKQQVSGEGRVIGYCELHKGGAIPSSDLLLSIALSLLTPHTSTFIFLFKKLGSFGS

SEQ ID NO: 140388 - protein, 245 aa, Glycine max
  Coding DNA Sequence Number=SeqID_48703
  Gene Ontology: Mol. function=transferase activity; Cellular component= integral to membrane
  Homolog annotation: Hit_ID=Q84XY8; Match level="QueryCoverage=54%, HitCoverage=38%, E-value=1e-29, Identity=54%"; Hit description=Wax synthase isoform 2
MVDERKEEEGCFLAFLCTSRGQFSKNFQDVTLLPILYLFLTLPFNLSFFHLGGTTTFFLVWLDTFKLILLSFYQGPLALSPPNILHFISIASLPINPKQHSPTKNNHTNNTQKPKWLLLLKVLIFAMIIRAYDYREKLHPHFILVLYCCHMYLGIELVLALSAIPIRTLLGFEIEQQFNEPYLFTSLQDFWGPSHVLFCASRCAHCGEDDDKEGDAPSWVAVASRCIRTARGGVLGGHRKVPHTS

SEQ ID NO: 140389 - protein, 304 aa, Glycine max
  Coding DNA Sequence Number=SeqID_48704
  Homolog annotation: Hit_ID=A7P0H2; Match level="QueryCoverage=68%, HitCoverage=33%, E-value=3e-17, Identity=48%"; Hit description =Chromosome chr19 scaffold_4, whole genome shotgun sequence
MAGEKWVQVAVHGVHGVVQTSKGLVELASRAANLQQEEEDTEEYYIITEFVMHESSKIFLITVLPILPSASNKITKSFYLPGSVDANDRQIDQWNVKPPQLYLWTDKHKAIARKHVMVRKADKTSWKRKRTEENDGRRLGVTSPPNPIDGRPYVREDENYLRELETRQQTRHYGIQNPNSVMSNYLSVHDPANSHHMGPSYPALALASEPYVMNTPAMQRYAPRLDELNHARMDPLGSEPAIVGRNGAFERSALPPGYGSRMPGFAAGSHHMYSRQNSSDRFNGCQFHGVKATKPAVADYEQPF

SEQ ID NO: 140390 - protein, 510 aa, Glycine max
  Coding DNA Sequence Number=SeqID_48705
  Gene Ontology: Mol. function=nucleoside-triphosphatase activity; Cellular component=integral to membrane; Biological process=defense response
  Homolog annotation: Hit_ID=Q19PL1; Match level="QueryCoverage=52%, HitCoverage=59%, E-value=4e-34, Identity=36%"; Hit description=NBS -NBS-LRR type disease resistance protein
  Pfam annotation: Domain name=LRR_1; Domain location=183-204; Score =11.3; E_value=2.4; Accession=PF00560.24; Description=Leucine Rich Repeat
  Pfam annotation: Domain name=LRR_1; Domain location=317-339; Score =6.7; E_value=17; Accession=PF00560.24; Description=Leucine Rich Repeat
  Pfam annotation: Domain name=LRR_1; Domain location=390-412; Score =3.1; E_value=81; Accession=PF00560.24; Description=Leucine Rich Repeat
  Pfam module annotation: Pfam domain module=LRR_1::LRR_1::LRR_1; Domain location=183-204::317-339::390-412
DGIINFNPSGIGYGYENMLGSQDKRLGRQYPYPFCLIAMSTYGFLSSLLYSIQPRKLYNYGFSGSLVCQSAAMLATFLVSGLVHELIYYHVTRVPPTWEVTCFFVLHGVCTVAEVAVKKVVLRRGWRLHRAVSGPLVVAFLAISANWLFFPQLLRNEMDRKSSEDFRYAGIESLLKSIGKLQNLETLDIRETGVSEMPEEISKLTKLRHLLSDYITSIQWKDIGGMTSLQEIPPVIIDDDGVVIGEVGRLKQLRELTVRDFKGKHKETLCSLINEMPLLEKLLIDLYIMSPMSTLRKLVLWGTLTRLPDYWTSQFPNLVQLRLGGSRLTNDALKSLKNMPRLMHLCFVLNAYEGETLHFQCGGFQKLKQLFLQSLDKLKSILIDRGALCSVEEIGLEYLSQLKTVPSGIQHLEKLKDLFISSMSTEFEQRIAPNGGDAENPSPPNLSQKNDDLGLINCWIVVTFEHHVRNPIPRISTIGNFDIINQRKKLRNLRNLLEMPLSLSETRESA

SEQ ID NO: 140391 - protein, 34 aa, Glycine max
  Coding DNA Sequence Number=SeqID_48706
MYRVPIPAPPKSIANLGVPYTIYWKNENAFYRKL

SEQ ID NO: 140392 - protein, 75 aa, Glycine max
  Coding DNA Sequence Number=SeqID_48707
MWESGAGPLVAKFVPSCGSSYEQKDVNTQDDPPIGGAVLQRKEGTGHKGSCTDGDGGGVGEEDDERMGGVHQFSE

SEQ ID NO: 140393 - protein, 286 aa, Glycine max
  Coding DNA Sequence Number=SeqID_48708
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=A5AWE7; Match level="QueryCoverage=30%, HitCoverage=8%, E-value=2e-27, Identity=68%"; Hit description =Putative uncharacterized protein
  Pfam annotation: Domain name=Glyco_hydro_1; Domain location=6-277; Score=-236.6; E_value=8.3e-07; Accession=PF00232.9; Description =Glycosyl hydrolase family 1
MVMRNSSSTLVDIVIEDTHIINGKQVEIKRTILRGAAGWNSKRLSNEKDFCGWNSFDVTKGLQPYVIVFHCDVPQALKDEYGGFLSPHIVDDFRDYAKLCFKEFGNRVKHWITLNEPRSVSKNGYANGWFAPANNNVHRIIPSWALCHLIILADPLFLFLLTSEGQDEYENDGFIADEDEEEDEEEDRTESDDKPQKKKKRKKREEYVLDEDDYELLEDNNINIHRWKESKKFKRLKKNRRDTEEEPSGLSDEEEFVGSGKVGRTVEEKLKRSLFGDDECMLDVSH

SEQ ID NO: 140394 - protein, 18 aa, Glycine max
  Coding DNA Sequence Number=SeqID_48709
MEEKTTGSSKMCPMVVSI

SEQ ID NO: 140395 - protein, 43 aa, Glycine max
  Coding DNA Sequence Number=SeqID_48710
MISCLARPHYKPIKVLSDPPNVNIKTGGVTSKKAKKIEEKKKI

SEQ ID NO: 140396 - protein, 245 aa, Glycine max
  Coding DNA Sequence Number=SeqID_48711
MRVRERLKLKEHQRKRRRVGFVLSECGKLSELKVTSSSSTFAVLSFVFLGGATCQLNVHVSTGPGVNSADPGVGVFIGGAATLGGFGGVVSSGGGGDCRIGGGGGGGKDVLLEDFRSRAHSKTLPYLFSLSSSCLKSLFSFSSRTKSAGNRSVDTHIVVGRTHRTPYTAGKPTLPLLEPTEPPTLPKNPYCRRSNPTEPTLSWLEENPRYTIATRVLKQSSVLKGQSFLRKAPLTCVCCWVLLIK

SEQ ID NO: 140397 - protein, 105 aa, Glycine max
  Coding DNA Sequence Number=SeqID_48712
  Homolog annotation: Hit_ID=Q6YVX5; Match level="QueryCoverage=61%, HitCoverage=9%, E-value=3e-07, Identity=51%"; Hit description =Chloride channel
MLKAMVVDMICIRGYCFNNLQVVSVQESKGKVLIMTPTSGEGAEKMDAEDEDLWDGNEESGGYWSRIYDRNKAHTKPLLMKGTNTTSQIAIVCANLCPIESLDYE

SEQ ID NO: 140398 - protein, 138 aa, Glycine max
  Coding DNA Sequence Number=SeqID_48713
MEARKRVPHVLWQHKVLEHVGGNVSQSYTVEELLKDTLHKLCKEKLETPLHNDSLIDEMRNHLRHKRYQSLLRTQVAEFCQITSFIQAFFSGFGGCCTKEYEDVGLEMVRKCERLPLAIVALVVFYIANVKVHLNGQV

SEQ ID NO: 140399 - protein, 66 aa, Glycine max
  Coding DNA Sequence Number=SeqID_48714
SPSPTRALSVQSSTGAKRGVKLEDAEPVTRAKREPRAKRAIPQKHTLSLQRALSARSERAKREVSR

SEQ ID NO: 140400 - protein, 205 aa, Glycine max
  Coding DNA Sequence Number=SeqID_48715
MASRKRRVVPTFGEASTWDSSRFTSEIAWHRYQDNIQLRNILPERNVKLGPGMFDKFLQEFQRRRWDQVLTRLPEKRIDVARVKEFYSNLYDPEDRNPKFSRVRGQVVRFDAETINDFVDTPVILADREEYPAYSQYLRTPPDHDAILSALCTLGGQFVLNGPTHIWLGDEDGPGRGQPHFSSDQLDRPVQHFQARVSSVDHNTV

SEQ ID NO: 140401 - protein, 71 aa, Glycine max
  Coding DNA Sequence Number=SeqID_48716
MKQYSTKSKLPESALQPLYREDFDVPHNATSSYTYDDQASRAEQSEEKLEESQETTRDVAIAVGKHVSPLR

SEQ ID NO: 140402 - protein, 129 aa, Glycine max
  Coding DNA Sequence Number=SeqID_48717
  Gene Ontology: Mol. function=nucleotide binding; Biological process =defense response
  Homolog annotation: Hit_ID=Q19PL4; Match level="QueryCoverage=75%, HitCoverage=10%, E-value=1e-15, Identity=45%"; Hit description=NBS -LRR type disease resistance protein
MPRLLFLILRDNAYEGETLHFQCGGFQKLKQLNLGSLDQLKCILIDRGALCSVEEIVLEGLSQLKTVPSGIQHLEKLKDLYINCMPTEFEQRIAPDGGEDHWIIQDVPRVCIWSRDALEPSHLFGRSHH

SEQ ID NO: 140403 - protein, 271 aa, Glycine max
  Coding DNA Sequence Number=SeqID_48718
  Gene Ontology: Mol. function=calcium ion binding; Cellular component =endocytic vesicle; Biological process=endosome transport
  Homolog annotation: Hit_ID=A2YGE4; Match level="QueryCoverage=77%, HitCoverage=38%, E-value=1e-109, Identity=90%"; Hit description =Putative uncharacterized protein
  Pfam annotation: Domain name=Dynamin_N; Domain location=24-164; Score= 53.1; E_value=9.5e-13; Accession=PF00350.14; Description=Dynamin family
  Pfam annotation: Domain name=GTP_EFTU; Domain location=34-234; Score=- 80.3; E_value=0.035; Accession=PF00009.18; Description=Elongation factor Tu GTP binding domain
  Pfam module annotation: Pfam domain module=Dynamin_N::GTP_EFTU; Domain location=24-164::34-234
MSVVTITATTMITSSGDHVGGDDHDVAGAHIGPEPTTDRFVVVMSGPDERSIPGNTIAVQADMPFSGLTTFGTSFLSKFECSQMPHPLLEHITFVDSPGVLSGEKQRTHRQYDFTGVTSWFAAKCDLILLLFDPHKLDVSDEFKRVISSLRGHDDKIRVVLNKADQVDTQQLMRIYGALMWSLGKVLNVPEVMRVYIGSFNDKTINDSLSGPLGNELFQKEQDDLLSDLKDIPKKACDRKSLHALYTCTAAPPTGHAASITIKKTFNTRDP

SEQ ID NO: 140404 - protein, 212 aa, Glycine max
  Coding DNA Sequence Number=SeqID_48719
MGPKSTLRLMRTLGPSLASLAQSSWSLLSNALGVCKEIKVGWMSTKEGKEEKVAAGKGCSSITSVGLSQQWKKYNEFLEIHKKNNCIKGCPLTQSISNAPDILLQILLSMPDRHMYRRKLDCVPHQNPLYTVVVVQIQLPAALMSHSQWRKNVVGSLQGNGVYVKGKQEHERTQGKGSGGRQRKKSKSRKCKKEKSVTNATKRGISIGIAQS

SEQ ID NO: 140405 - protein, 389 aa, Glycine max
  Coding DNA Sequence Number=SeqID_48720
  Gene Ontology: Mol. function=long-chain-alcohol O-fatty -acyltransferase activity; Cellular component=integral to membrane
  Homolog annotation: Hit_ID=Q84XY8; Match level="QueryCoverage=90%, HitCoverage=93%, E-value=4e-37, Identity=34%"; Hit description=Wax synthase isoform 2
MYGEIERFIKVWISAILGLCYCYYMAARIPKGFLRLLSLLPILYLFIILPLNISSPNLVGYTSFFLVQLGIFKLLLFSFNKGPLALSPPNIVHFISIASLPITPKQHPPTNKNNTTNTQKPKWLLPLKLLIFAMIARVYEYNEYFHPHFILVLYCLHLYLGLELVFALIATPVQTLFGLKIEPHFNKPYLSSPLQDFWGHRCNLMVRHGKKTHTGGYPPESFPTLTGIPDTRRVLDGYGDGIINFNPSGVGYGYGDMLGSRDKGLWRQYPYSPRPIAMSTYGFLSSTLYSIQPRKLVCTVAEVAVKKVVLRRGWRLHRAVSGPLVVAFLAISANWLFFHQLLRNEMDRKSSEEYLAKFPSRLVKGKIERHRSVAINLGSYNLLPVELQK

SEQ ID NO: 140406 - protein, 109 aa, Glycine max
  Coding DNA Sequence Number=SeqID_48721
  Subcellular localization annotation: CTP_CleavageSite=61; ConfidenceScore=5.38e-01
MKSGLRKVDHKITTCSQKRRCKAQSLRLRVHSALSYKISSQTSSFALTTNQKTELASKTKMAETAVSLAGQHALPKILEAVKMLRDLPKEVRDITDELESFQDFINDAC

SEQ ID NO: 140407 - protein, 1164 aa, Glycine max
  Coding DNA Sequence Number=SeqID_48722
  Gene Ontology: Mol. function=metal ion binding; Biological process =defense response to fungus
  Homolog annotation: Hit_ID=A7P0H2; Match level="QueryCoverage=100%, HitCoverage=99%, E-value=0.0, Identity=38%"; Hit description =Chromosome chr19 scaffold_4, whole genome shotgun sequence
MASSDDEGEAQPLSVSNYHFEDNKDAPVCFSVLPIQWSESQSPVGKKMQVFLHGFVDNGLQKFFVQVVAWRFDLSYVRPEILVLSKDGRWIKLEKPRKSYEDTIIRTILITIHFLSYVKKNPDSSAKSVWDNLSKNKEFRSYEVMPSQNDLLNHMTLMGEAAKRDTALAKSKRYFIAKFLRSAIVILSTIPAAINVVVVLLLMVLEDKDKLKIKKPSDKEVKDLARPGFIIDDIDNDMIDEFGEDSDGEDELFDSVCAICDNGGQLLWSFHANEEDGEESTCASLGFSRKEVDEIQNFYCKNCEYNQHQCFACGTLGCSDKFSGAEVFKCASATCGFFYHPHCVAKLLHGIVEDAPKELEEKIAEGGPFTCPTHYCCECKEMEDKKKHDFQFAVCRRCPRSYHRKCLPREIAFDDIEDEDIITRAWEDLLPNNRILIYCLEHEIDDELGTPIRDHIKFPNVKATVREIDAEENAKSATKERVILNKNNIDSKNLFGKKATAKVSKLPGKMSSGKVGDKKSEKISRSNISRKKINEASRCFNENKRSTISKETKKSDGAENRPSLGAKLFALKQNSSEHINSGNEADDVAKNTLVVKPTKKLSSTLPALDADSKRRLLALFKEATSSVTLENVIKEHKFAATHTHSLKSVVEKTITLGKLEGSVEAVRTALRMLEDGHNIRDAEAVCGPDVLNQIFKWKNDFNFEMRDWMTIQTKELPTGSQLIMGLNPPFGLKAALANKFIDKALEFRPKLLILIVPPETERLDEKRSPYDLVWEDKRFLLGKSFYLPGSVDANDRQIDQWNVKPPPLYLWSRPDWTDKHKAIARKHGHFISQRGLLRIESFDKEKSPASHTLDDSSGFNSMPGHDILNLTDAPINEGQTGCSPHGNVDRESQERQKYMVRKADKTSWKRKRSEENDGRRLGVTSPPNPIDGRSSVESFQLRPDMPPPDYELGDKSYRHLEPTSSSRMGGIRAAYSGTQNWPSVANPLYDSGITDVGEHHSSLPRDIANSIGYRPYVREDENYLRELETRQQTRHYGIQNPNSVMSNYLSVHDPANSHHMGPSYPALALASEPYVMNTPAMQRYAPRLDELNHARMDPLGSRLDELNHARMDPLGSRLDEPAIVGRNGAFERSALPPGYGSRMPGFAAGSHHMYSRQNSADRFN

SEQ ID NO: 140408 - protein, 96 aa, Glycine max
  Coding DNA Sequence Number=SeqID_48723
MTNSSVENAMPSTIVFDMLASKGLKVNFSKSKFGVIGVERDVVERDLKKVCGGGAQSDWCDWSMVLELGKGDAARRLAASLPQDPAAHLWQQTRME

SEQ ID NO: 140409 - protein, 301 aa, Glycine max
  Coding DNA Sequence Number=SeqID_48724
MADNTRNQTHIREIEERLNTRMEERFMDIGASLQHKIDDMFRRHENSCSSGSSSFSRPYSCNTRLAHLDFPRFNGEGIKNWIIQCDTFFSGIKPSKSTRCAWLWSILKAKLSNGTVHMGLDKFPSWNDYTKILIERFGEIQMMVRMFQPTSVMKAFSLAKMYENANATSMQAKPLSKTFKPNPVAKPPLLLNPPKTLEPMKPKTQTTKPLTPTYMSEMRAKAENFDSDEDLGPNENPHDETNPKPLISVNALTGVTKFWTMRVIAKKLGCKIEDMDPVSVTVADGARVQINTMVKGFSWLI

SEQ ID NO: 140410 - protein, 76 aa, Glycine max
  Coding DNA Sequence Number=SeqID_48725
MGGSSVCHNRVNFNKNFVPHYPEALRYAKVWGRDIVRSLTLVYAKRLFSDAKVWGRDIVRSLTLAYAKRLFPDSNP

SEQ ID NO: 140411 - protein, 193 aa, Glycine max
  Coding DNA Sequence Number=SeqID_48726
MFALSSHQTTMDLFEEAVYYFTQNLSTMTTKTLEMNAKLDVILNRLSAFTPTPSPPKSPPPVETIIMEPQNIDTNLSRLSFDFTATAFHVDNTSLQPVDTMKSPPTDDSRRSPKKRRGGAPSVDDTGCDTSSFVVVAANIDIALPVQAAPSGNETRCGASDFAGGVSHCPPTLSPRPLQHDPLQQCHPAQRCR

SEQ ID NO: 140412 - protein, 35 aa, Glycine max
  Coding DNA Sequence Number=SeqID_48727
MVKLRMDFPANLVTEFRFDSIIDLKRTEIRDDLLL

SEQ ID NO: 140413 - protein, 722 aa, Glycine max
  Coding DNA Sequence Number=SeqID_48728
  Gene Ontology: Mol. function=glycerophosphodiester phosphodiesterase activity; Cellular component=anchored to membrane; Biological process=glycerol metabolic process
  Homolog annotation: Hit_ID=Q9SZ11; Match level="QueryCoverage=97%, HitCoverage=93%, E-value=0.0, Identity=54%"; Hit description =Probable glycerophosphoryl diester phosphodiesterase 2 precursor
  Pfam annotation: Domain name=GDPD; Domain location=363-645; Score =72.2; E_value=1.8e-18; Accession=PF03009.8; Description =Glycerophosphoryl diester phosphodiesterase family
MAISRVLAILILQYSLVALVSSAGPRGGWKTLQGSPPLVIARGGFSGIFPDSSSLAYSLTLDTCGPNVTLWCDVQLTKDGVGICFPELKLDNASDISIAYPGKAKDYLVNEVSTRGWFSVDYNLAELANVSVVQGVYSRTNKFDGNKLPIRSVEDVAKLIKSPSTGLWLNIQHDSFFKQQNLSVENFLQSLPAKSVPVNYISSPDVDFLRRVKSSFSSGPTGFIFRFLEQSKLEPTTNQTYGELLKNLMLIKTFASGILVPKGYIWPVDSGLYLQPHTPLVTDAHREGLQVFVSDLTNDVPFSYNFSYDPLAECLSFIDGDDFSVDGVLSDFPVTPSAAINCFSGLGKNAKKQVDTLVITKYGASGDNPACTDLAYNQAKSDGADVLDCPVQMSKDGIPFCLSSIDLSESTTVADTQLKNRATTIPEIKYRSGIYTFSLTWDEIKTLTPSILNPYEKYILSRNPKSKNLGKLITLSDFLSLTEGSRILISIENAAYLAEKQNLRVTDAVLDALQKAKPRSHKVMIQSTHSSVLKIFKDKSKFERVYKVDENIGGAADSAIEDIKTFADAVVIGKASVFPESSAFLVNFTNIVARLKSFKLPVFVETFSNEFVSQAWDYYSDPSIEINSFVIGTKVNGIITDFPKTANRYRRNLCLKHGNEAPYMSPIEPGKLFKQISNLYLPPLPPPLPILTDSNVTEAPLPGVSGRVPTPGVGVAPAPITA

SEQ ID NO: 140414 - protein, 135 aa, Glycine max
  Coding DNA Sequence Number=SeqID_48729
  Gene Ontology: Mol. function=glycerophosphodiester phosphodiesterase activity; Cellular component=anchored to membrane; Biological process=glycerol metabolic process
  Homolog annotation: Hit_ID=A5BH21; Match level="QueryCoverage=71%, HitCoverage=17%, E-value=9e-22, Identity=47%"; Hit description =Putative uncharacterized protein
  Subcellular localization annotation: CTP_CleavageSite=25; ConfidenceScore=5.11e-01
MKTKKACSKWKYKIFNAFSIVKLFRSSTVGHSTWRFFRIFPDSSDLAYIFAVRTGLKNLIAWCDVQLTKDRQGICLPDIKLENATNINYAFPNRSQTYPVNGVPTTAYFAVDYTLEDLRSYVVCDILKGVPVDSS

SEQ ID NO: 140415 - protein, 101 aa, Glycine max
  Coding DNA Sequence Number=SeqID_48730
MGIGKPAPLKVEEKLQAQGCAPDSVPAIGLDGAILERGGNGGSVTSASVRGGAGAKAEGLTGGGLNTNDSHRVGVGTEALSALGVRVLSKLARGCSTSGIC

SEQ ID NO: 140416 - protein, 383 aa, Glycine max
  Coding DNA Sequence Number=SeqID_48731
  Gene Ontology: Mol. function=methyltransferase activity; Cellular component=cytoplasm; Biological process=fatty acid biosynthetic process
  Homolog annotation: Hit_ID=A7P0J1; Match level="QueryCoverage=99%, HitCoverage=98%, E-value=1e-173, Identity=78%"; Hit description =Chromosome chr19 scaffold_4, whole genome shotgun sequence
  Pfam annotation: Domain name=Methyltransf_7; Domain location=41-382; Score=500.6; E_value=1.8e-147; Accession=PF03492.6; Description=SAM dependent carboxyl methyltransferase
MGDNVVVSNMELERLLSMKGGKGEGSYANNSQAQAIHAKSMHHLLKEALDGVQLQAPNMPFVVVDLGCSCGSNTINVVDLIIKHIIKRYEALGLDPPEFSAFFSDLPSNDFNTLFQLLPPLANYGVSMEECLAANNHRSYFAAGVPGSFYRRLFPARFIDVFHSAFSLHWLSQVPESVLDKRSSAYNKGRVFIHGASEITANAYKNQFQTDLASFLRSRAVELKRGGSMFLVCLGRTSVDPTDQGGAGLLFGTHFQDAWDDLVQEGLISSEKRDSFNIPVYAPSLQDFKEVVEADGSFAINKLEVFKGGSPLVVNQPDDDSEVGRALANSCRSVSGVLVDAHIGDKLSEELFLRVERRATSHGKELLEQLQFFHIVASLSFAL

SEQ ID NO: 140417 - protein, 653 aa, Glycine max
  Coding DNA Sequence Number=SeqID_48732
  Pfam annotation: Domain name=RRM_1; Domain location=80-145; Score =27.7; E_value=4.3e-05; Accession=PF00076.13; Description=RNA recognition motif. (a.k.a. RRM, RB
MDRKEKPVVGMHFNNCGWDNAGDDEGVWTKVISKKTAKGLKKTLKADNQTQHLGARGKPTRYHIKWRDKDDITSYCFTHFPEEADEELLWKHFKKWGDVREVYIAKRRNREGRRYGFVRFKGVSNAKGLEVKLDNIFINEHKLFVNLPRFMRTARTEGMQQNTVIGRNLINTFPKLCDAPTDPYRRSYVEVTTMGKLSGHKRSNEAVIPSIMLTPFLGDDMILFSGVSDEKAQLIIQTEKESGNSLFYSLEKWRSGCRPNNRVVWIQVWGFPLEVWEVEHFKKAISFISNVIELDDDTEDRRTLDRARILVRTPLPPSIRREVVVRVGEFEYWVWFVEETGTHGGTKQKGLSPSDDWWEEITSDDGGDIGSADDDKDTNLSFSSELSNKPIFRNNQWSGEETDGYCREIGPTGIEEEIHDPDLAKVNLEPSRAATDNEKVFTKMATCDMAQTVAQKENSQQQGNNLNERDKVTSEIYYNGEAEGEIRCLQPHSDLYPKQSSAGVGPSHNLGPLLMSERCNKKKKFLAAQHPKETPDKYSKVYVRQRHPLNKPRNMQSVEKQLHLQEEDDDMEAITDKCDKTHNPSQLEADSRLKSKIICTTEVMEEAHQLWDVGKRIGMEAETEHSEFIQHYANMESRDRKEAMELGNRKVHT

SEQ ID NO: 140418 - protein, 370 aa, Glycine max
  Coding DNA Sequence Number=SeqID_48733
  Homolog annotation: Hit_ID=A5B5G7; Match level="QueryCoverage=61%, HitCoverage=15%, E-value=1e-09, Identity=24%"; Hit description =Putative uncharacterized protein
MTSRKRKATSSLPQEPYDTTRFTSEGAWECYSQNIHSQNILPKRNVNLFVIEYDEFRRELIRRNWHKALTQFMDRHIDVALVKEFYSNLYDPEDKSPKQVRVRGRLIKFDSTSLNAFLETPPLIQLGEQYPSYPLFCRSCTDPWKLASKLCIPGHEFVLNAEGAPWKLLRKDLTTLAQTWSVLSYSTLAPTSHTSDLNMDRARLIYGLVMKMDMDVGFLILHQISQMAQSTSSRLGFPALISHSAWPKETRKAQAQGSEGPSSSATHALAPPASAPSPAPAPSTPAPAPSAPPSSILAYMHDSDQHRPIVSMEDFMAQEAQPEPEVPHEATPEATPWTSPVTSPVLEVSEEEDGAVDANYAADMTAVQST

SEQ ID NO: 140419 - protein, 231 aa, Glycine max
  Coding DNA Sequence Number=SeqID_48734
  Gene Ontology: Mol. function=aspartic-type endopeptidase activity; Biological process=proteolysis
  Homolog annotation: Hit_ID=Q53KJ4; Match level="QueryCoverage=70%, HitCoverage=34%, E-value=8e-10, Identity=27%"; Hit description =Transposable element protein, putative
MAEEQLRRVTLEEYSSSTVPQFFISIARPEGNLFHGLPNEDLYAHLATYIEICNTIKIAGNSLKTWDKVVEKFLKKYFPESKTVEGKATISSFHQFPDESLRSKIKLKTPEEAMELIENMAASDHTILRDRTHITTKRSLLELSSQDALLHRTRGCSICGGAHESGSCIPIDDSTQEVNYMGGNQPRQADNSSSTFGANTEKNPKEKGKAIMTRSKKADIEDEERRIEDTK

SEQ ID NO: 140420 - protein, 68 aa, Glycine max
  Coding DNA Sequence Number=SeqID_48735
MRSFNGYFPPRRCSRRQRRKGEGRHHPLGNKSWKKELHHQECTLDKKLEEDALMEEKKERKGSMKLKE

SEQ ID NO: 140421 - protein, 149 aa, Glycine max
  Coding DNA Sequence Number=SeqID_48736
MVDVFPNALALHHFSCKTIEENLRQVKGSALYKMGSISPWGLSLVGPPQGVPNVVFNEVASNDFVSVHLGNPPKLADEFKHHHLGVFEKVMDATQHEVGFDDVPNILQSFNVKEVFDINSRLFSLYHDFYIKDGHGCRSCDKNRGVVLG

SEQ ID NO: 140422 - protein, 127 aa, Glycine max
  Coding DNA Sequence Number=SeqID_48737
  Homolog annotation: Hit_ID=A7Q2Z0; Match level="QueryCoverage=88%, HitCoverage=12%, E-value=1e-08, Identity=31%"; Hit description =Chromosome chr12 scaffold_47, whole genome shotgun sequence
MPRLLFLVLRDNAYEGETLNFQSGGFQKLKQLQLGFLDQLKCILIDRGALCSLEVFSLRKLSQLKTVPSGIQHLEKLQDLYIEDMPTEFEQRIAPDGGQDHWIIQDVPHVRIWSEDAEEPLHIFGRS

SEQ ID NO: 140423 - protein, 65 aa, Glycine max
  Coding DNA Sequence Number=SeqID_48738
MVATKCSVLGAKCPAKELRLSWAGYGSSLVSEVTGEVISGSGSDLLCLSPTARQASSKDDCTANS

SEQ ID NO: 140424 - protein, 382 aa, Glycine max
  Coding DNA Sequence Number=SeqID_48739
  Gene Ontology: Mol. function=nucleoside-triphosphatase activity; Cellular component=membrane; Biological process=defense response
  Homolog annotation: Hit_ID=A7PBY4; Match level="QueryCoverage=79%, HitCoverage=50%, E-value=1e-33, Identity=30%"; Hit description =Chromosome chr2 scaffold_11, whole genome shotgun sequence
MAGLVRTGGKGTVRSNDVENTGFYIDRRLTDVETSFAFNDTTFKDSRPPSLKIVFHRYLPSNVRSCLLYFGMYPEDYEVRSDRLIGHWIAEGFVKHETGKTLEEVAQQYLSGLVGIEILPKSIGKLQNLEISRLKMLRHLLADSTCSIQWKDIGGMTSLHEIPTVTIDDDGVVFREVEKLKQLRNLMVVNFRGKHLKTLCSLINDMPLLEKLAIGAADESEVIDLYLMSPMSTLRKLVLRSKLTNDALKSLKDMPRLMFLCFAHNAYEGQTLHFERGWFQKVKTLHVICLDKLKSILIDRGALCSLEEIVLRDLSQLKTVPSGIQHLEKLKDLYIVDMPTGFEQRIAPDGGQDYWIIQDVPHVGIWSRDAEEPLHIFGRSHH

SEQ ID NO: 140425 - protein, 229 aa, Glycine max
  Coding DNA Sequence Number=SeqID_48740
  Gene Ontology: Mol. function=subtilase activity; Biological process =proteolysis
  Homolog annotation: Hit_ID=Q9SUC7; Match level="QueryCoverage=44%, HitCoverage=6%, E-value=1e-14, Identity=46%"; Hit description =Putative uncharacterized protein T13K14.10
  Subcellular localization annotation: CTP_CleavageSite=54; ConfidenceScore=5.33e-01
MNFYFNFNASCSTEGSRERVRRGKDGGSSASKCGLAGGSTTSTSGTGPDRTSPCSSAPRPSPLTGVGVHNERVAGGIGPGEPGAKEGIMNGVVMVKVEEDVEGIGVIRIFNRGKRIENDYTFIQELFARLKSPTTSQESKKNLVSRGEFARFVADKKSLKSLKMEDCSNLGGPAIDSVVWYDGEVWRVPLDTHSLDDDPDCGKLANFIPLTNYRQVMMKGAWQTRGAEL

SEQ ID NO: 140426 - protein, 40 aa, Glycine max
  Coding DNA Sequence Number=SeqID_48741
MVVEEEKPLPNNLLLTATMVTNGNAGEASKKKTKTAEIKM

SEQ ID NO: 140427 - protein, 168 aa, Glycine max
  Coding DNA Sequence Number=SeqID_48742
  Homolog annotation: Hit_ID=A5AI85; Match level="QueryCoverage=100%, HitCoverage=19%, E-value=4e-11, Identity=30%"; Hit description =Putative uncharacterized protein
MAETAVSLAGQHALPKILEAVKMLRDLPKEVRDITDELESFQDFINDADKVAEAEQDDGRRHRIKERVMRLREAAFRMEDVIDEYNISSLLCEAVAFIKTQILLLQSAYKIQDVKSLVRAERHGFQTHFPLEQRQTSSRGNQDITWQKIRRDPLFIEEDEVVGLDGPR

SEQ ID NO: 140428 - protein, 283 aa, Glycine max
  Coding DNA Sequence Number=SeqID_48743
  Gene Ontology: Mol. function=nucleotide binding; Cellular component =membrane; Biological process=defense response
  Homolog annotation: Hit_ID=A7QA98; Match level="QueryCoverage=91%, HitCoverage=29%, E-value=9e-39, Identity=40%"; Hit description =Chromosome undetermined scaffold_70, whole genome shotgun sequence
  Pfam annotation: Domain name=NB-ARC; Domain location=114-283; Score= -66.4; E_value=4.9e-06; Accession=PF00931.13; Description=NB-ARC domain
MAETAVSLASEHALPKIMEGIKMVRDLPKEVRDITNVIDEYNLSCEDKQPGDPRCAALLCEVVAFIKTQILLLQNAYKIQDVKSLVCVERDGFQTHFPLEPRLTSSRGNQNVTWQKLRMDPLFIEEDNVVGLDGLRGTLKNWLTKGREKRTVISVVGIPGVGKTTLAKQVFDQVRNNFECHALITVSQSYSAEGLLRRLLDELCKVKKEDPPKGVSNMESLTEEVRNRLRNKRYVVLFDEVWNETFWDHIEYAVIDNKNGSRILITTRDVKVAGYCWKSSFVE

SEQ ID NO: 140429 - protein, 143 aa, Glycine max
  Coding DNA Sequence Number=SeqID_48744
MENNSLRCLQCNGEESAKGFTEKKKAREVLIHDMILRKVKDTEFCQYIDGRDQSVSRKDEEVSEHLVNKIPTNYMLLKVLDFEVIIDDDGVVIGEVGKLKQLRELLVLDFRGKHEKTLCSLINEKPLLEKLVIETADVSEVID

SEQ ID NO: 140430 - protein, 493 aa, Glycine max
  Coding DNA Sequence Number=SeqID_48745
  Gene Ontology: Mol. function=lipid binding; Cellular component =integral to plasma membrane; Biological process=defense response to bacterium
  Homolog annotation: Hit_ID=A7PXC2; Match level="QueryCoverage=93%, HitCoverage=92%, E-value=1e-128, Identity=49%"; Hit description =Chromosome chr12 scaffold_36, whole genome shotgun sequence
  Pfam annotation: Domain name=LBP_BPI_CETP; Domain location=37-211; Score=82.0; E_value=1.9e-21; Accession=PF01273.16; Description=LBP BPI  CETP family, N-terminal domain
  Pfam annotation: Domain name=LBP_BPI_CETP_C; Domain location=243-479; Score=64.2; E_value=4.5e-16; Accession=PF02886.8; Description=LBP BPI  CETP family, C-terminal domain
  Pfam module annotation: Pfam domain module=LBP_BPI_CETP::LBP_BPI_CETP_ C; Domain location=37-211::243-479
MAPSIVLSLLPLLLVSTCCYAQPLEEGFISGVISDKGLEYAKELLIEKGIASIVMLQLPEIENSAQVPLVGNAKVVLSDITIKDVEVNSSSVKTGESGIVLVISGAIANMSMRWRYTVSSWLIPFGISDSGNASVKVTGMQVGLTVNIRNQEGTLKLALLDYGCYVGDLSIKLDGGASWLYQLLVDVFEGDITSAVEEGISEKIKEGIMNLDHFLKSLPEQISLDKTAALNVSFVGNPVLSNSSIAIAINGLFTGKNEVLVPQRYYQKGMKISAACGGLQKMIKVSIHENVFKSASLVYYNAGKMQLIIDELPDQDILNTAEWRFIVPQLYKRYPNDDMQLNISISSPPVIQVTYQDIGATIFVDITIDVLEDGEVIPVACISVEISASCAVEIEGNNIAGWLRLQTFSAYLKWSKIGKLHVRLIQSLMSSVLKTVVLPYLNFKLKRGFPLPIIDGYGFQNAIILYNHPWIMVCSDVSFLEDYYLGQQLAYVS

SEQ ID NO: 140431 - protein, 93 aa, Glycine max
  Coding DNA Sequence Number=SeqID_48746
MLELHCPEVATRQVLRWVSNLKPFLHCHDLRGFSHYGISDGEAPGELPMAEGGHQVHVASDLDSLACKAEEWTNARVESVRGDLKFLKGFSIV

SEQ ID NO: 140432 - protein, 267 aa, Glycine max
  Coding DNA Sequence Number=SeqID_48747
MIDASWVRGPEPPKKKGTQRTEKEKITSITKMVLLPPEARQQSQQILYSLFQLSLVTHNLSVKDSIGGMTSLQKISSLIMDDEGVVIRELGKLKQGIIYTNLEEFIINFSQLQQLTKVSKGKTSYPIARRLFVMRRYGGGMLYAVLPLHMQRGCFRIRTHDQQVTKAQLYRCTRARPHTKFEELGFFEKGDNHNFPPVLSPDYVSISLQIACGNMNKKPEADNKKAETEKKMAISSKPEQRTNRAMQQQRSCLGCACLISSDKNNKF

SEQ ID NO: 140433 - protein, 364 aa, Glycine max
  Coding DNA Sequence Number=SeqID_48748
  Gene Ontology: Mol. function=oxidoreductase activity
  Homolog annotation: Hit_ID=A7PXS5; Match level="QueryCoverage=96%, HitCoverage=60%, E-value=1e-147, Identity=71%"; Hit description =Chromosome chr15 scaffold_37, whole genome shotgun sequence
  Pfam annotation: Domain name=ALO; Domain location=10-312; Score= -55.8; E_value=2.8e-06; Accession=PF04030.5; Description=D-arabinono -1,4-lactone oxidase
MIIGHLFFQITLKLEPLFKRSITYVEKDDSDLGDQAAAFGDAHEFGDILWYPSQRKVLYRVDDRVPTNTSGNGLYDIISFRPTPSNTSAFIRTREDIQESTKDANGKCIDATTTTDTFITEAYGLTNNGIIFTGYPVIGFQNRLQSSGSCLDSPQDALNTTCAWDPRVKGLFFYQTAFSIKLSFVKSFIEDVQKLVELEPKGLCVLGLYNGMLMRYVTASSAYLGHQEDALDIDITYYRSKDPMAPRLYEDILEEIEQVGIFKYGGLPHWGKNRNLAFKGVIKKYKDAKKFLKVKEKYDSHGLFSNTWTDQVLGLKDGVTILKDGCALEGLCICSQDSHCNPSKGYYCRPGKVYKKARVCTHLK

SEQ ID NO: 140434 - protein, 46 aa, Glycine max
  Coding DNA Sequence Number=SeqID_48749
MYDDDDFLSFVMMKNENDVKNFVQKLLERLVKQYQPLLLPHLLTLL

SEQ ID NO: 140435 - protein, 63 aa, Glycine max
  Coding DNA Sequence Number=SeqID_48750
MERKRKERERVMHGIFVWSQSFFVNGVVVKEKCVVVVGSFKGVLYVTETLYLGATIQNGEDEE

SEQ ID NO: 140436 - protein, 443 aa, Glycine max
  Coding DNA Sequence Number=SeqID_48751
  Gene Ontology: Mol. function=DNA binding; Cellular component=nucleus; Biological process=regulation of transcription, DNA-dependent
  Homolog annotation: Hit_ID=A7PXS8; Match level="QueryCoverage=98%, HitCoverage=99%, E-value=1e-112, Identity=53%"; Hit description =Chromosome chr15 scaffold_37, whole genome shotgun sequence
  Pfam annotation: Domain name=NAM; Domain location=15-144; Score =301.4; E_value=1.7e-87; Accession=PF02365.6; Description=No apical meristem (NAM) protein
MPENMSISVNGQSQVPPGFRFHPTEEELLQYYLRKKVSYEKIDLDVIRDVDLNKLEPWDIQEKCKIGTTPQNDWYFFSHKDKKYPTGTRTNRATAAGFWKATGRDKVIYSNGKRIGMRKTLVFYKGRAPHGQKSDWIMHEYRLDDNNTSDINIVSNVMGDAAQEEGWVVCRIFKKKNHLKTLDSPLASGEGRRSHMFDSCDEGALEQILQQMGRGCKEESSYEGNYNSYGRFAMGLNNGGGGGYNDRFMKLPSLESPKSASMENHHNTNNNCNNNMKSNNNNNNNNNGYHPIIPVEMGTDNEGTFTTHQVSGGDPNNNNNNSNIVHPLEVGSGGGGLTNWAALDRLVASQLNGQTDASRQLGCAFNDPTMYCTSVDHHDLHHQIPTLRSSSTSANTRPSPAPAFINPPTQDFTSEIDLWNFSRSTSSLLASSEPLCHVSNTSV

SEQ ID NO: 140437 - protein, 142 aa, Glycine max
  Coding DNA Sequence Number=SeqID_48752
MHSSLSHKSIENVMKKCFSRGHLPPIHGVLNERNIDVEEIEQGHFGIVKVRVGVKVVGKKLRGVYFSGYFRGKGLKGSVLKEGANNNLLILVILVYSPVASPAQRKPGLAFTRHSTPWHLLLACPYLLPALPNFFNISKLPF

SEQ ID NO: 140438 - protein, 199 aa, Glycine max
  Coding DNA Sequence Number=SeqID_48753
  Homolog annotation: Hit_ID=A7PXS9; Match level="QueryCoverage=98%, HitCoverage=98%, E-value=3e-55, Identity=62%"; Hit description =Chromosome chr15 scaffold_37, whole genome shotgun sequence
MGNCVFRGLNHGVSEDMMVKVVTSNGGIMELFSPITVECITNEFPGQGIFRSRRDMFSEPLPKNEELHGGEVYYLLPLNPSSSRKSLTRQFSDTAATLTPYRMSTFEKNNNNNNNNVYSEPPELISRYNSSGVWKVKLVISPEKLSEILSQESRTEALIESVRTVAKCGNGAPSSVANSDQWSVASSWKGSMSEKMGLQ

SEQ ID NO: 140439 - protein, 109 aa, Glycine max
  Coding DNA Sequence Number=SeqID_48754
MPRSTSSTNPSAMTVSHSELEDVLALLVDPSLSGADGVGVIGEEWGWRIEIGGQGGGTMTRHCGWGVEAEVGEVLIGGNTKSEGGLDGEVVEMLKVIEATVGWIDIREW

SEQ ID NO: 140440 - protein, 492 aa, Glycine max
  Coding DNA Sequence Number=SeqID_48755
  Homolog annotation: Hit_ID=A7PXT3; Match level="QueryCoverage=19%, HitCoverage=15%, E-value=6e-29, Identity=65%"; Hit description =Chromosome chr15 scaffold_37, whole genome shotgun sequence
MELDLRSFLHSPTSSDDAPHRTIDDILNDCDTSSSSPSPPSSPSHSLSNNSHPQNSTLQPAPDSFSRFKPTEFSDRARVSRPFSSLLHSVRSNAKPGAALAAAAAASRSVPTPHAAAIISRRKSAAAISVESSLIAANGDDSSAVSAKGELGEPSEKFDPVPPMIPPPSESASAIGERFESDVEIATDLKAGSDDIQVHSDNNINANVNDDDDDENDNDSSIVSEEKRDLDKVDCDHEKDMNSAPFDEDDDRGFDGNDDDDERITATYAAVETEEEEEEEEVVNNGSSSMEDVRNEVSVGGGDDDGSSLGDVAELVEERLEELENRRAAKRAEKKRESLMKPLELAEELEKKRASTGLHLEEGAAAQPMRLEDVRRGSMTLGYFDVDADNAFTRAISSQTFRREQGSARTLAVHANYIAVGMSKGLIVVFPSKYSIHHADNSDGKVAAIVICIAEFLRFAILTPSAIAAAMGVEVVAWVLHPLVISGKSQAN

SEQ ID NO: 140441 - protein, 245 aa, Glycine max
  Coding DNA Sequence Number=SeqID_48756
  Gene Ontology: Mol. function=nucleic acid binding; Cellular component= ribonucleoprotein complex; Biological process=metabolic process
  Homolog annotation: Hit_ID=A7PXT7; Match level="QueryCoverage=60%, HitCoverage=55%, E-value=2e-39, Identity=53%"; Hit description =Chromosome chr15 scaffold_37, whole genome shotgun sequence
  Pfam annotation: Domain name=RRM_1; Domain location=100-171; Score =67.8; E_value=3.5e-17; Accession=PF00076.13; Description=RNA recognition motif. (a.k.a. RRM, RB
  Subcellular localization annotation: CTP_CleavageSite=65; ConfidenceScore=5.79e-01
MPPNSNTLFHTHAFVVTPSSSYSSVHTLKLQKPQVKRFVLLFAYPRRSRTFLEPSTSSSSFSPVRKTKEVAEEYVYPPENDDVLEDEEEREKRLGKACEVYVCNLPRSCDAAYLLDMFRPYGTILSIEVCRNAENNESKGCSYVTLGSIHSARNAVAALDGSDVGGCELRVRFSIEMNSRRRSFNKMNSSTKRISYYESPHKLYVGNLAKTVRPEQLRDLFCRFGNIEFYGRTLIVKEGVERSED

SEQ ID NO: 140442 - protein, 362 aa, Glycine max
  Coding DNA Sequence Number=SeqID_48757
  Gene Ontology: Mol. function=oxidoreductase activity; Cellular component=cytoplasm; Biological process=flavonoid biosynthetic process
  Homolog annotation: Hit_ID=A7PXU9; Match level="QueryCoverage=66%, HitCoverage=69%, E-value=1e-109, Identity=76%"; Hit description =Chromosome chr15 scaffold_37, whole genome shotgun sequence
  Pfam annotation: Domain name=2OG-FeII_Oxy; Domain location=109-208; Score=167.8; E_value=2.9e-47; Accession=PF03171.11; Description=2OG -Fe(II) oxygenase superfamily
  Pfam annotation: Domain name=Methyltransf_2; Domain location=220-362; Score=-9.0; E_value=5.4e-08; Accession=PF00891.9; Description=O -methyltransferase
  Pfam module annotation: Pfam domain module=2OG-FeII_Oxy::Methyltransf_ 2; Domain location=109-208::220-362
MVNVSKEFFGLPESERLKNYSDDPTKTTRLSTSFNVKTEKVSNWRDFLRLHCHPLEDYIQEWPGNPPSFREDVAEYSRKMRGLSLKLLEAISESLGLEKDYIDKALGKHGQHMAINYYPPCPEPELTYGLPAHADPNAITILLQNQVPGLQVLHDGKWLTVNPVPNTFIVNIADQIQVISNDRYKSVLHRALVNCEKERMSIPTFYCPSPDALIKPAPQLVDKEHPAQYTNFTYREYYDKLAKTKASVSIIQRYQLKDAILEGGSPFNRIHGKHVFEDFNMNSSFNQLFMATMTNHATLIMNKIVESYKGFENINKLVDVGGGLGVTLNIITSKYPHIKGINFDLPHAIEHASPSPRTISNS

SEQ ID NO: 140443 - protein, 107 aa, Glycine max
  Coding DNA Sequence Number=SeqID_48758
  Gene Ontology: Mol. function=DNA binding; Cellular component=nucleus; Biological process=response to salicylic acid stimulus
  Homolog annotation: Hit_ID=Q8L5P7; Match level="QueryCoverage=49%, HitCoverage=7%, E-value=1e-22, Identity=94%"; Hit description=LHY protein
  Pfam annotation: Domain name=Myb_DNA-binding; Domain location=24-56; Score=18.0; E_value=0.035; Accession=PF00249.22; Description=Myb -like DNA-binding domain
MDAYSSGEEVVVKTRKPYTITKQRERWTEEEHNRFLEALKLHGRAWQRIEGYMMIGFGGELFPSLVASVFRENDDFEGGKVMGTYIRGGSGIVVESELGVDGEDTQM

SEQ ID NO: 140444 - protein, 502 aa, Glycine max
  Coding DNA Sequence Number=SeqID_48759
  Gene Ontology: Mol. function=protein serine/threonine kinase activity; Cellular component=cytoplasm; Biological process=protein amino acid phosphorylation
  Homolog annotation: Hit_ID=A7PXV1; Match level="QueryCoverage=96%, HitCoverage=76%, E-value=1e-91, Identity=41%"; Hit description =Chromosome chr15 scaffold_37, whole genome shotgun sequence
  Pfam annotation: Domain name=Pkinase; Domain location=1-134; Score= -28.9; E_value=6.8e-07; Accession=PF00069.16; Description=Protein kinase domain
  Pfam annotation: Domain name=Pkinase_Tyr; Domain location=1-134; Score=-170.1; E_value=0.054; Accession=PF07714.8; Description =Protein tyrosine kinase
  Pfam module annotation: Pfam domain module=Pkinase::Pkinase_Tyr; Domain location=1-134::1-134
MQNLLLATTAATPVMKIGDFGFARSLTPQGLADTLCGSPYYMAPEIIENQKYDAKADLWSVGAILYQLVIGRPPFDGNSQLQLFQNILASTELHFPPDALKVLHSDCLDLCRNLLRRNPDERLTFKAFFNHNFLREPRPTVNVEQFQLHQSERLTDHQLGVSASEKISQSHSKYHVVDNPVVVSSAADETMLLQRKDGKITAGTKSAKGSTPTIASDKLGKAVDAGAHLSNQPLGLIVSGYCVAFSHLMESIEKDYVFVNSHFASFEAFSDYFEASVQNISSHRISLFSSKRTNMEVGHAKQTKDLPFSSTEVLENLKSNKQEACVASCEFAALRKENGISSLLPSNRLQLLHQYVRILAELSQEKYNTGLYLESLAVELVVLAIWKKTLEICSFWMASITKRAAEMPDAMEIIFQKALLIGTSGAVDEYMEIRDRAAASYSKAMLLLSFIVTEAENLPLNPPFSLVSTNKERILQYIHSLQSRKKSSAESSSEKAHTLLSK

SEQ ID NO: 140445 - protein, 392 aa, Glycine max
  Coding DNA Sequence Number=SeqID_48760
  Gene Ontology: Mol. function=rRNA binding; Cellular component =nucleolus; Biological process=embryonic development ending in seed dormancy
  Homolog annotation: Hit_ID=Q2V9A2; Match level="QueryCoverage=89%, HitCoverage=95%, E-value=1e-128, Identity=66%"; Hit description =Putative RNA processing factor 1-like
  Pfam annotation: Domain name=Brix; Domain location=166-363; Score =227.0; E_value=4.2e-65; Accession=PF04427.9; Description=Brix domain
MGGKRRKSDDDDDVEAEASASGWKKKTRTTEKEEKEKKEPLRPSMIKNKEKRSELHAKLKQQKKLDKRAKAKARDAALKRALDLGEEPPEKKVPRTIENTRELDETVCKPDDDELFAGNDADEFGSILNQQQTPKILITTCRFHSTSYEARTPQSLAVSGVRHASMSVSDTDMTPRGPAFISELLSVIPNAHYFKRGTYDLKKIVEYAKKKDFTSVIVVHTNRREPDALLIIGVPDGPTAHFKLSKLVLRKDIKNHGNPTGHKPELVLNNFTTRLGHRVGRLIQSLFPQDPEFKGRRVVTFHNQRDFIFFRHHRYIFETKEVKKTESKGKKDKEGKSENVPEQKTIARLQECGPRFTLKLISLQHGTFDTKGGEYEWVHKPEMDTSRRRFFL

SEQ ID NO: 140446 - protein, 443 aa, Glycine max
  Coding DNA Sequence Number=SeqID_48761
  Gene Ontology: Mol. function=hydrolase activity; Cellular component =cytoplasm; Biological process=traversing start control point of mitotic cell cycle
  Homolog annotation: Hit_ID=Q9M3Z3; Match level="QueryCoverage=86%, HitCoverage=93%, E-value=1e-177, Identity=79%"; Hit description =Putative PTS protein
  Pfam annotation: Domain name=Metallophos; Domain location=47-309; Score=80.4; E_value=5.7e-21; Accession=PF00149.19; Description =Calcineurin-like phosphoesterase
MGIDFMVLVLSVSWFCLTSICVSATKQAYPPTPQPNQNLRFDQNGEFKILQVADMHYANGKTTPCLDVLPSQNFSCSDLNTTVFLNRMIKAEKPNLIVFTGDNIFGFDSSDSAKSLDAAFAPAIASNIPWVAVLGNHDQEGTLSRAGVMNHIVGMKNTLSKFNPPEVHIIDGFGNYNLDVGGVQGTDFENKSVLNLYFLDSGDYSQVSTIFGYDWIKPSQQLWFQRTSAKLKKAYISKPVPQKDAAPGLAYFHIPLPEYASFDSSNMTGVKQEPDGNGISSPSVNSGFFTTLLAAGDVKAVFTGHDHINDFCGNLMNIQLCYGGGFGYHAYGKAGWPRRARVVVASLEKTGKGSWGDVKSIKTWKRLDDQHLTGIDGEVLWSKSTGAQETRGLVDMEEYRAVHRKIFKELRKTVLEVQSEFKSILLWQSKLYTWKKMNVKKRC

SEQ ID NO: 140447 - protein, 22 aa, Glycine max
  Coding DNA Sequence Number=SeqID_48762
MEEGEGGRGGHKGVRNQYVCFV

SEQ ID NO: 140448 - protein, 241 aa, Glycine max
  Coding DNA Sequence Number=SeqID_48763
  Gene Ontology: Mol. function=small conjugating protein ligase activity; Cellular component=endoplasmic reticulum membrane; Biological process=regulation of protein metabolic process
  Homolog annotation: Hit_ID=Q94FU3; Match level="QueryCoverage=90%, HitCoverage=87%, E-value=9e-94, Identity=76%"; Hit description =Ubiquitin conjugating enzyme 2
  Pfam annotation: Domain name=UQ_con; Domain location=9-168; Score =95.0; E_value=2.4e-25; Accession=PF00179.17; Description=Ubiquitin -conjugating enzyme
MAEKSCIKRLQKEYRALCKEPVSHVVARPSPSDILEWHYVLEGSEGTPFAGGYYYGKIKFPPEYPYKPPGISMTTPNGRFMTQKKICLSMSDFHPESWNPMWSVSSFILMFSISECSILTGLLSFMMDNSPTTGSVNTTTAEKQRLAKSSLSFNCKNATFRKIFPEYVEKYNQQQLSEQAAPERVSLDTSPDKSSRPVLEKKLESNGEDMKRVDGLKEVTLHVLLGYIMLFRMGKLYQIKP

SEQ ID NO: 140449 - protein, 532 aa, Glycine max
  Coding DNA Sequence Number=SeqID_48764
  Gene Ontology: Mol. function=protein binding; Cellular component =cytoplasm; Biological process=protein transport
  Homolog annotation: Hit_ID=A7PZJ4; Match level="QueryCoverage=89%, HitCoverage=53%, E-value=0.0, Identity=80%"; Hit description =Chromosome chr15 scaffold_40, whole genome shotgun sequence
  Pfam annotation: Domain name=Sec10; Domain location=104-532; Score =183.4; E_value=5.6e-52; Accession=PF07393.2; Description=Exocyst complex component Sec10
MREPRDGANNKPSKAAAAAAASPPQSFPLILDVDDFKGDFSFDALFGNLVNELLPTFKLEESESDGGDALPNGHLRVPSTDGSKYSQGIVSPLFPEVEKLLSLFKDSCKELLELRKQIDGRLYNLKKDVSVQDSKHRKTLAELEKGVDGLFDSFARLDSRISSVGQTAAKIGDHLQSADAQRETASQTIELIKYLMEFNSSPGDLMELSPLFSDDSRVADAASIAQKLRSFAEEDIGRHGIPVPSAMGNATASRGLEVAVANLQDYCNELENRLLSRFDAASQKRELTTMAECAKILSQFNRGTSAMQHYVATRPMFIDVEIMNADTKLVLGDQAAQASPSNVARGLSSLYKEITDTVRKEAATITAVFPSPSEVMSILVQRVLEQRITALLDKLLEKPSLVNLPSVEEGGLLLYLRMLAVAYEKTQELARDLQAVGCGDLDVEGNELTLNMPVFLHCILVNSSLKGTLVWNIDANGLTESLFSSHKDEYPEYEQASLRQLYKVKKSCDDSKSTTKIAIYSYTALIIKTMLE

SEQ ID NO: 140450 - protein, 208 aa, Glycine max
  Coding DNA Sequence Number=SeqID_48765
MDKYYKQQTRNNTSCQSTKQPDPSNKAIDKQTRENGTWNKPCTLKRNSKDGRAMIGGIVIEIHNQRLDELIVKRRNLQVILHDESELVIGIGPPGLQPLGLQAHIGRSVMHNLIPKLPIEAIDELQNSMRLEELGVDVGSVVGGEMVNVEMEVDAVGEVVGGGEGAEAAGERGEAVEGEELDEESERNRVGKSGGLRKGERSGGRCRR

SEQ ID NO: 140451 - protein, 691 aa, Glycine max
  Coding DNA Sequence Number=SeqID_48766
  Gene Ontology: Mol. function=protein binding
  Homolog annotation: Hit_ID=Q55F46; Match level="QueryCoverage=65%, HitCoverage=54%, E-value=5e-10, Identity=24%"; Hit description =Putative uncharacterized protein
  Pfam annotation: Domain name=zf-C2H2; Domain location=41-63; Score =18.8; E_value=0.02; Accession=PF00096.17; Description=Zinc finger, C2H2 type
MLKGEVQENVEKVQQQAPNEPPPPSPPPPPPPPPPGDNKSFRCWYCNAKLDSNNAVRRHMKFHQEQIEAEMMRIHIEGGGSSHQQPLVSYSEASSSSSRSLPHPGNQAYGESTSPQTPQFLSVMAHQVISGSSHQPLVSYSVGNHGQERINTSILSQARNTAMHQFQSLSDQEFGPENSSIWHLARNIAIHHRLQLFRAQRNTGSSHQPLVSYSSQNFGQETSSNASILPQTQNISMRQFQSLMAQGISGSSHQPLLSNSAVPVRVQGLPSSRSHPNGNFGQESSNNASILPQTQNISMHEFQSLMARGISGPSHQPFLSNSAVPVRVQGLPSSRSHPDGNFGQESRNNASTLPQTQNISMHEFQSLMARGISGPSHQPFLYNSAVPVRVQGLPSSRSHPNGNFGQESSNNASILPQTQNISMHEFQSLMARGISGPSRQPFLSNSAVPVRVQGLPSSRSHPNGNFGQESRISSIRPQIASIGSASHQQYHNSHQPLVTSSSRSHPSLSYEGSSGQESDSSAIRPQNASIEWRCDKRKFGQERSPADSNADKRLKPLCDDREFDQIRSSSVIVPQNEITEGEGPDYDLNVKPSCNDENSALEFGQESSNSSICRERNPADLNVKLLKPLCDERKFDQASNSSVTPQNAIIEGLDLNVKPSCDDQNSDQQVSSSSTPLNEEEEEKLDLNLKL

SEQ ID NO: 140452 - protein, 174 aa, Glycine max
  Coding DNA Sequence Number=SeqID_48767
  Gene Ontology: Mol. function=protein serine/threonine kinase activity; Biological process=protein amino acid phosphorylation
  Homolog annotation: Hit_ID=A7PXR1; Match level="QueryCoverage=72%, HitCoverage=21%, E-value=3e-29, Identity=53%"; Hit description =Chromosome chr15 scaffold_37, whole genome shotgun sequence
MGQCYGKTNLAPENDATAATTDETTAVVARSGEVPPSPLPGKGTPPRDSLWSSPYPHGGGGVTPSPARGTPRRFFRRPFPPPSPAKHIRASLAKRLGHAKAAPKEGPIPEEEAAAAAAERSLDKSFGYGKNFGAKFEIGKEVGRGHFGHTCYAKGKKGELKDQPVAIKIIPRPR

SEQ ID NO: 140453 - protein, 45 aa, Glycine max
  Coding DNA Sequence Number=SeqID_48768
MEEGRTWIGDQGGGGYDMLRKGERREKLVVLTLIHEVALTGVESS

SEQ ID NO: 140454 - protein, 119 aa, Glycine max
  Coding DNA Sequence Number=SeqID_48769
MEQYLRHLVRQQAANHRAHVQTHDCLYQMSLSMQSQGFTSFSCPTPDQFRAEVAWPGDWPEAQAGEAPPEVPGDGEEAHEDEEMTDLLDFLGGSGASWLGDPRIHVFLSYFFYHFYVMT

SEQ ID NO: 140455 - protein, 745 aa, Glycine max
  Coding DNA Sequence Number=SeqID_48770
  Gene Ontology: Mol. function=ATPase activity, coupled to transmembrane movement of substances; Cellular component=integral to membrane; Biological process=transport
  Homolog annotation: Hit_ID=Q5PFM8; Match level="QueryCoverage=100%, HitCoverage=73%, E-value=1e-156, Identity=54%"; Hit description =Putative ABC transporter ATP-binding membrane protein
  Pfam annotation: Domain name=ABC_membrane; Domain location=378-651; Score=116.6; E_value=7.5e-32; Accession=PF00664.14; Description=ABC transporter transmembrane region
  Pfam annotation: Domain name=ABC_tran; Domain location=172-334; Score= 86.9; E_value=6.6e-23; Accession=PF00005.18; Description=ABC transporter
  Pfam module annotation: Pfam domain module=ABC_membrane::ABC_tran; Domain location=378-651::172-334
AAFSSVNDQTQESLTSIRMIKAFGLEDHQSSQFADIASDTGRKNLHVARVDARFDPIIYIAVGFSNLLAIGGGGWMVWHGSLTLGQLTSFVMYLGLMIWPMLALAWMINIVERGSAAWSRIRALLAEAPAVEDGNQLLPAEAGVLQVAIRAFHYPASSAPVLSNVHFQLQPGQMLGLCGPTGCGKSTLLSLIQRHFDIDQGEICYHAIPLPQLRLDSWRSRLAVVSQTPFLFSDTVANNLALGRPEATQEEIERVAQMACVHDDITASAAGKQRIAIARALLLNAEILILDDALSAVDGRTEHEILHNLRLAQWYSAAITIRWRRSRAGIAICIAISSWKPRWMRTSQNREPTMAKSQRLWPTLKRLLAYGKPWRKSLWLAVGMLWIAAAAEVTGPVLVSYFIDNLVAKHQMPWGIVAGLLVGFVLLQLLAAGLHYFQALLFNRAAIGVVQQLRVDVMNAALRQPLSAFDTQPVGQIISRVTNDTEVIKDLYVTVVATVLRSAALIGAMLVAMFALDWRMALVALVIFPLVLTVMMIYQRFSTPIARRVRSYLAEINNGFNEVINGMSVIQQFRQQARFGERMGEASRSHYLARMETLRLDGFLLRPLLSLFSAMILCGLLMLFSFATPGVFEVGVLYAFITYLGRLNEPLIELTTQQSMLQQAVVSGERIFELMDAEQQGYGSDSLPLASGSISLRDVSFAYRDNRDVLSHINLEVPARHFVALVGHTGSGKSTLANLLMGYYP

SEQ ID NO: 140456 - protein, 63 aa, Glycine max
  Coding DNA Sequence Number=SeqID_48771
LWHAETPDGNPHTPFAIQRPESLVACEDTLRLSAPRHLETPSPIDKQRPMWSSTPFLEMSASS

SEQ ID NO: 140457 - protein, 126 aa, Glycine max
  Coding DNA Sequence Number=SeqID_48772
  Homolog annotation: Hit_ID=Q6VPE8; Match level="QueryCoverage=58%, HitCoverage=10%, E-value=2e-07, Identity=31%"; Hit description =Putative gag-pol polyprotein
MEGQNKIKGVKLNVPPFEGRSDPGTYLDWEMKIAHVFSCNDYTEEQKAVWVEQQLKRKIATRRNSSNNFNQNWTDRSNKEGGNSSSPHGKSTVFSAKTKHNSASSSNTSTRNIKCFKCLGRGHIAF

SEQ ID NO: 140458 - protein, 114 aa, Glycine max
  Coding DNA Sequence Number=SeqID_48773
MGGELIKMRVQIEIFKFSNLAHSRIFSKLGKLGGNLLPFFPINRRKEAVPNIPQPPWLCILAILGVKNYFREENSSRGAFVKLLRRFREQIREGFPSFFTVLHPFFVRSSFFNG

SEQ ID NO: 140459 - protein, 58 aa, Glycine max
  Coding DNA Sequence Number=SeqID_48774
MACLDFRYCHHQKGGDCRQRIKLKVLMMPKDYMNHMLLKDLLKTKQLELIKMDDQDSL

SEQ ID NO: 140460 - protein, 155 aa, Glycine max
  Coding DNA Sequence Number=SeqID_48775
MAPKKLSTKRSRRDATGEGSSAASEFDSHHFRSAEHQRRFEAIRGWSFHRERRVQLREDEYTDFQEEIAHRRWTPLVTPMAKFDPEIVLEFYASAWPTKEGVRDMYSWVRGQWIPFDADALSQFLGDPVVLEEGQQCEFSQRRSRADGFDEEAIS

SEQ ID NO: 140461 - protein, 143 aa, Glycine max
  Coding DNA Sequence Number=SeqID_48776
MGDPISRLSFPGRRIVCHSKKAYAALISWNICLFAKACLHFSGENTETFSSLTSYPELRRSEFLIGGYVGARASLLSTTPPFVAMTQELVARGGTLRLSAPRHSVTPSVIDEQRPIWVICALSGDVSIFRWRLFKSHKLSRTT

SEQ ID NO: 140462 - protein, 143 aa, Glycine max
  Coding DNA Sequence Number=SeqID_48777
  Gene Ontology: Mol. function=helicase activity; Biological process =viral genome replication
  Homolog annotation: Hit_ID=A2YRS6; Match level="QueryCoverage=95%, HitCoverage=27%, E-value=4e-28, Identity=44%"; Hit description =Putative uncharacterized protein
MNTNQVFVEGQSLTYSEFVTKFVYNQKQRCWQLRKKGYTTGRLQWVPPTTGELFYLRMMLTVCRGPISFENIRTVDGVEYSTYREACFAMGFSQDDREFIVAIQEAKDWGSAPYLRNLFVLLLLTGLHIDDSNMMNLVLLEVE

SEQ ID NO: 140463 - protein, 38 aa, Glycine max
  Coding DNA Sequence Number=SeqID_48778
MAVCVCVGFWLCVCVFLCVCVSGSMIKLDTTQQKADMT

SEQ ID NO: 140464 - protein, 99 aa, Glycine max
  Coding DNA Sequence Number=SeqID_48779
MALRTPNLQNKLDLTKSTTSASSSGGFGFHPFETVIQQQGEYKHNNISTKESLEEISQQTINIAHKLILCGILNLLVAPQAGSVVDHPACSFDKVNPKC

SEQ ID NO: 140465 - protein, 58 aa, Glycine max
  Coding DNA Sequence Number=SeqID_48780
MFQHICYTVVDSQNRPDNYLKGRINSALKGLDDTPQPKSKASVRWIVVKEVSGIIGKR

SEQ ID NO: 140466 - protein, 98 aa, Glycine max
  Coding DNA Sequence Number=SeqID_48781
MEITIYKLRVEVNQSNFQLSKGARDNSFMNKKINENPINNHPELVFAHPGLVQARHEPLEWPHEVPPAVVEAPGLRKPHLPPPPPKEKVGLLARPPEN

SEQ ID NO: 140467 - protein, 112 aa, Glycine max
  Coding DNA Sequence Number=SeqID_48782
MRICPSNRLCNLAFEVWELLEDGSAKAGGGAEVEDARMPAIGAKEEGTSATLSLVLLGEAKLHGESKKSSQKVQDRIKKNSRLKKKVKSQESKIQGSRSQESISRFKNQEKA

SEQ ID NO: 140468 - protein, 139 aa, Glycine max
  Coding DNA Sequence Number=SeqID_48783
  Homolog annotation: Hit_ID=Q84VH5; Match level="QueryCoverage=66%, HitCoverage=13%, E-value=2e-33, Identity=80%"; Hit description =Envelope-like protein
MLSQHPNMLNYTDSVMKRESPLSLHYKLFEGTHVPDIVSTSGKAAASGAVSKDALIAELKDTCKVLEATIKATTEKKMELERLITRLSESGIDDEEAAEEEEEAAEEDKEAAEEEEEAAEEEEDTAEETESDDDSEATP

SEQ ID NO: 140469 - protein, 41 aa, Glycine max
  Coding DNA Sequence Number=SeqID_48784
MGTSKGGKRVVVAAQLAQASWDASTRRHRLLLEDPRRPKWA

SEQ ID NO: 140470 - protein, 177 aa, Glycine max
  Coding DNA Sequence Number=SeqID_48785
  Homolog annotation: Hit_ID=Q0KIL1; Match level="QueryCoverage=59%, HitCoverage=11%, E-value=5e-07, Identity=31%"; Hit description =Gag/pol polyprotein, 3'-partial, putative
  Pfam annotation: Domain name=G-patch; Domain location=47-91; Score =16.5; E_value=0.0019; Accession=PF01585.14; Description=G-patch domain
DILMSCPSSMPYVEAAEGSLEILFQALEFVNNAYMESPPIQPRLSGASLMVAQVMLKDGYEPRMGLGRNNDGTTSLLKFAENHGRFSLGYKPTNADKRRISLERKERSLARLQGRGPQVERVPICHINESFVSTGSDNEFCESSDTEDSDVDFERPVNQAKEEENKDWGLPPDLRRM

SEQ ID NO: 140471 - protein, 128 aa, Glycine max
  Coding DNA Sequence Number=SeqID_48786
  Gene Ontology: Mol. function=metal ion binding; Biological process =histone H3-K9 demethylation
  Homolog annotation: Hit_ID=Q6K7P0; Match level="QueryCoverage=51%, HitCoverage=6%, E-value=3e-26, Identity=86%"; Hit description =Putative DNA-binding protein PD3, chloroplast
  Subcellular localization annotation: CTP_CleavageSite=25; ConfidenceScore=5.08e-01
MFGCFLSLPHFAVFALPAQTFLVALASFVAADFCISLLRNNCLSFAEFISSLPFKEYTDPHKGSLNLAVKLPNGSLKPDLGPKTYIAYGFPQELGRGDSVTKLHCDMSDAVCSICLFLSWAVIFKDFF

SEQ ID NO: 140472 - protein, 266 aa, Glycine max
  Coding DNA Sequence Number=SeqID_48787
GHALRRPYRTRAGARVMGEVEEIQEKMKADMEAIKEKMATMMEAMMSVKKIMEANAVAIAATSVVAKVNPTSPSGLKQMNHPTSNMVGKDLGSTGGPHDVQIQNEHAFPSYGLPLNYTPPKVAYTPNKNVNNSTPIPIESQQPQTDHAHGKQLVVYPYKTLWRALSITHNCTSCIPQRLKTLMTMAGMGKVGSSRGRLRAIEGGEDYAFANLEELFLIPKHGHSQSSRCRTLASTRGLLAPKNHLKMYCRKMGAYAKDEKLLIHFS

SEQ ID NO: 140473 - protein, 162 aa, Glycine max
  Coding DNA Sequence Number=SeqID_48788
MGKAEKVQEKVKADMEAIKEKMATMMEAMMSMRKIMEANAVAVAATSTVAKVNPMPPSGLNQMNHPTSAMIWETHEIPHHNLADFEPCLGYATEGQAVGGIPLQNTSEGPQYHPQPHPSHSIASKNPHVVAEMGKLDHLEERLRAIEGGEDYAFANLEELFL

SEQ ID NO: 140474 - protein, 24 aa, Glycine max
  Coding DNA Sequence Number=SeqID_48789
RHFKEKMSQEQAHHHKKPWKKAGR

SEQ ID NO: 140475 - protein, 121 aa, Glycine max
  Coding DNA Sequence Number=SeqID_48790
  Subcellular localization annotation: CTP_CleavageSite=69; ConfidenceScore=5.01e-01
MKRVRMKEKPMLRLPFLHGNFPPAKQCHYSANISPSHYPPPSHPQRPSLNQPQSLSTTLPIMNTTFCTNQNTNEGRNFAAKKPIEFTLIPVSYDDLLPYPLDNSMIAITPTKVPQPPFFQG

SEQ ID NO: 140476 - protein, 90 aa, Glycine max
  Coding DNA Sequence Number=SeqID_48791
FTLYASGSYNAQWNAPGLLHDKHMLRSSRILRKVEVEEPWLGWSSSLEVRNDIVGFGGKLGRIGMAVTAWVSPSFSPSSFAPVFSVVLVG

SEQ ID NO: 140477 - protein, 83 aa, Glycine max
  Coding DNA Sequence Number=SeqID_48792
  Subcellular localization annotation: CTP_CleavageSite=38; ConfidenceScore=5.36e-01
TYQGNPCGFYPDLSSFTGSGVYPDLSSFTGSGVYRDLSSFTGSGVCPDLSSFTGSGVIQISVACIKRSAPRKVHIIWYQSFGS

SEQ ID NO: 140478 - protein, 96 aa, Glycine max
  Coding DNA Sequence Number=SeqID_48793
MLFLLSSPKTLSFSRRPPNLSQKNDDPGLVHCWIVVKFEHHVRNPITKRNTPRIVAFSFPAETQSYLGILSEQIEEKNWKNLREPLEMLLSLAEDT

SEQ ID NO: 140479 - protein, 138 aa, Glycine max
  Coding DNA Sequence Number=SeqID_48794
AEHQQRFEAIKGWSFLRERRVQLRDDEYTDFQEEIVRRRWASLVTPMAKFDPDIVLEFYANAWPTEEGVRDMRSWVRGQWIPFDADAIGQLLGYPLVLEEGFCPDCCQETGADHAHQHDHPDSDLDDFAAQQHLAQRP

SEQ ID NO: 140480 - protein, 109 aa, Glycine max
  Coding DNA Sequence Number=SeqID_48795
MADKTRLKELSTNMSRVLEMLEADRKDKKARFESLEVVVESLLKQNSGSSENHNLPHPPFQAEQFFYYYNTLDPQRLMIAIIHMEKEGVTSEALIDCFIGGLKPDIQHD

SEQ ID NO: 140481 - protein, 113 aa, Glycine max
  Coding DNA Sequence Number=SeqID_48796
  Pfam annotation: Domain name=G-patch; Domain location=1-37; Score =7.6; E_value=0.023; Accession=PF01585.14; Description=G-patch domain
MLGHGYEPRMGLGRNDNGMASLVEFTGNRGRFGLGYEPTHIDVRRIALERRVRSMGQRQRLQVKGVPLCHINESFVSMGWMCKGWVTMIHKETPQEQPNWVRPCPLEFELGNW

SEQ ID NO: 140482 - protein, 43 aa, Glycine max
  Coding DNA Sequence Number=SeqID_48797
MAKTMIKINRKQEEMFNTVHIKNQVLCSKMERSTRAYLTSARQ

SEQ ID NO: 140483 - protein, 170 aa, Glycine max
  Coding DNA Sequence Number=SeqID_48798
SNMALGFLALITGLCQSFGVPVTPSKVIRPPITRAFIEKYCTQRQIQGDAPQAADAPPPHQAGPAGLFDTEQYLRHLVRQQAANHRAHVQTHDCLYQMSLSLQSQGFTSFLCPTPDQFRAEVTWPGDWPEAQAGEAPAGAPAEAPNEADEAREDEEMTDLLDFLGGSGAT

SEQ ID NO: 140484 - protein, 135 aa, Glycine max
  Coding DNA Sequence Number=SeqID_48799
MSVFTRDSPQISASPHQLDLAPYASEPYNAQWNALGLLRDKHTLRSSRILGEMEVDEPWLGLWLPLKLSSRYGSKDCLCGITGRWGKEKVCYWLSNDIVGFGGKLGRIGMAVTAWVSPSFSPSSFAPVFSVVLVG

SEQ ID NO: 140485 - protein, 190 aa, Glycine max
  Coding DNA Sequence Number=SeqID_48800
RGGRCKTQGASPGGAVVGADLGGTGEARLIALCARTPKGNRPAHPGKRLSREVRVQRLERAPHVAWCPGAPPGGPLKNPEDRVPPHARVVLITASGSPKVNSLLGAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 140486 - protein, 262 aa, Glycine max
  Coding DNA Sequence Number=SeqID_48801
  Homolog annotation: Hit_ID=Q84VH5; Match level="QueryCoverage=93%, HitCoverage=37%, E-value=2e-91, Identity=72%"; Hit description =Envelope-like protein
  Subcellular localization annotation: CTP_CleavageSite=21; ConfidenceScore=5.24e-01
MATSPKETSSPGSPSVPSSPSSTKAPSNQEQPEFNIQPIQMIPGPAPVPEKLVPKRQQGVKTSENPSLATSPREVDTEMDKKIRTDKDVPTSSTPNVSVPDADKDVPTSSTPNTEVLPSPSEEESTEEEDQATEETPAPRAPEPAPGDLIDLEEVESDEEPIANKLAPGIAERLQSRKGKTPITRSGRIKTMAQKKSTPITPTTSRWSKVAIPSKKRKEISSSDSDYDVELDVPDIKRAKKSGKKACFRKRTGKNALVARRS

SEQ ID NO: 140487 - protein, 32 aa, Glycine max
  Coding DNA Sequence Number=SeqID_48802
ERQKLETYHPPGYTELFGKISMKKSPLLDTHN

SEQ ID NO: 140488 - protein, 123 aa, Glycine max
  Coding DNA Sequence Number=SeqID_48803
MEESNRENNKDHVSQSRGSAVDGVEHIGEWINPIGKITKITFPSQEGSVLGGEEHIGEWRNPIGKITNITFPSQKGPLLAVKNTLENGGINRENNKDHVSQSRGSTFDGEEHIGEWRNPNRGK

SEQ ID NO: 140489 - protein, 83 aa, Glycine max
  Coding DNA Sequence Number=SeqID_48804
MELMRLNQHEENDKKKKGITLKASSSIQEGSDKEDLNEIDEDDDFSFFVKRFNKFLRNKGNQRKEQKIHPLFQNVMNAINQDI

SEQ ID NO: 140490 - protein, 140 aa, Glycine max
  Coding DNA Sequence Number=SeqID_48805
MAPRKLVSKRSRKDKAAEGTRGRARYVILGEGSVDPVRCGCSQPVPGIPFSAGGGPGMRVWPEEEPVRRDFAWTAAGRRVRIMRTNMTTLTQIWMTLLLSNIQPSDHNSDLPLPKYQLVWRLPGSLWTRISPAGPLDFPP

SEQ ID NO: 140491 - protein, 254 aa, Glycine max
  Coding DNA Sequence Number=SeqID_48806
  Gene Ontology: Mol. function=siderophore-iron transmembrane transporter activity; Cellular component=cell outer membrane; Biological process=siderophore transport
  Homolog annotation: Hit_ID=A4W7R0; Match level="QueryCoverage=66%, HitCoverage=23%, E-value=2e-86, Identity=89%"; Hit description=TonB -dependent siderophore receptor precursor
DAIGQIYFIDRIAAIGTTVTATCTGLVGTVIPANSIAQDTSGYRSRRAARARRGDLQRAEAGGQGAVRPRSAVLIPTVSAIPSAVNVGYSAMTKNEKIAWKMSATADNPTTNIYHNTGVAMPDSSNFNGSGGKYSDPLTSGRTRTQGWLLSDTLGVLDDKLLFTAGARHQKVVIRGYNKITGAENDADGFDGSRWMPTYGVVYKPWEEISLYANHTEALQPGKTAPNTATNYGQSTGIVHSKQNEVGVKADFGR

SEQ ID NO: 140492 - protein, 229 aa, Glycine max
  Coding DNA Sequence Number=SeqID_48807
MRGEEQSVVNEQLEAYVANIYNRPPQQQNQQQQNNYDLSSKKYNPGWRNHPNLRWTSPPQQQQPVPPFQNAAGPSKPYVPPPMQQQQRQQATEAPPQTSLEELLRQMTIQNMQFQQETRASIQSLTNQMGQMATQLNQAQSQNSDKLPSQTVFGNQIQVPPPVATPAPEPVKLHSTPEKEDELAAQKRKLPDHEGANTNFHAGDLGDLQKVEVNISSARCPSSRFQDMP

SEQ ID NO: 140493 - protein, 264 aa, Glycine max
  Coding DNA Sequence Number=SeqID_48808
  Gene Ontology: Mol. function=motor activity; Cellular component=cell projection
  Homolog annotation: Hit_ID=UPI00016621D1; Match level="QueryCoverage =78%, HitCoverage=40%, E-value=2e-16, Identity=29%"; Hit description =UPI00016621D1 related cluster
  Subcellular localization annotation: CTP_CleavageSite=35; ConfidenceScore=5.01e-01
MPSPSEGCTPSPSEGCTPSPLEGYTPSPSKGCTPSLQRAARLAFKGLLALAFKGLHILAFRRLHALSFRELHPLDFRRLHVLACRRLHVLAFRGLHVLSLGGLHVLAFRGLHLLAFKGLHILAFGGIHVLAFRGLHALAFRGLHALDVRGLHVLTFRGPHVLAFGGLHILDFRGLHIIDFRGLHVLTLRGLHVLTFRGLHTLAFRGLHVLAFKGLQVLAFRGLHALAFKGLHVLTFSVLHVFTFRGLHALAFRGLHVLAFRRLQ

SEQ ID NO: 140494 - protein, 47 aa, Glycine max
  Coding DNA Sequence Number=SeqID_48809
MMQSYPARELDRRLQVDWVRDPREGPRVLMSLKLSSSFSSQGGELSY

SEQ ID NO: 140495 - protein, 106 aa, Glycine max
  Coding DNA Sequence Number=SeqID_48810
MSEFTSGSPQISASPHQLDFAPYALGSYNAQWNALELLHDKHMLRSSRILRKKEVEEPWLGLWLPLNYRVDMGARWCLALGVRQASFVADLGMAFVDDWVVGNEKG

SEQ ID NO: 140496 - protein, 229 aa, Glycine max
  Coding DNA Sequence Number=SeqID_48811
  Homolog annotation: Hit_ID=Q84VH5; Match level="QueryCoverage=100%, HitCoverage=35%, E-value=1e-111, Identity=84%"; Hit description =Envelope-like protein
  Subcellular localization annotation: CTP_CleavageSite=15; ConfidenceScore=5.22e-01
KGKTPKTRAGRIKTTAQKKSTPITPTTSRWSKVAFPSKKRKEISSSDSDDDVELDVPDIKRAKKSGKKVPGNVPDAPLDNISFHSIGNVERDALDCKEIMDLIKAAGLLKTVTKLGDCYESLVREFIVNIPSDITNRKSDEYQKVFVRGKCIRFSPAVINKYLGRPTEGVVDIAVSEHQIAKEITAKQVQHWPKKGKLSAGKLSVKYAILHRIGTANWVPTNHTSTVAT

SEQ ID NO: 140497 - protein, 178 aa, Glycine max
  Coding DNA Sequence Number=SeqID_48812
  Homolog annotation: Hit_ID=A5CA85; Match level="QueryCoverage=57%, HitCoverage=16%, E-value=1e-14, Identity=41%"; Hit description =Putative uncharacterized protein
MTRGNPSDLQPFDPEIDRTFHRLVRHYFVPFEHPEHSIIGESEHFVVDNFEHPDFEHYSFEHSENMAQPPPRERTLREMATPDFTYKSLCIQYPDEDVPYVLKTGLMHLLPKFHGLAGEDPHKHLKEFHIVCSTMKPPDVQKDHIFLKAFPHSLEGVTKDWLYYLAPQSITSWDDVKR

SEQ ID NO: 140498 - protein, 119 aa, Glycine max
  Coding DNA Sequence Number=SeqID_48813
MKLAKYRLKAQVEKDKAPEKGEGNPCGVYLDLSSFTGSGVYPDLSSFTGSGVYPDLSSFTGSGVIQISVACIKRSAPLKTQVEKDESLSGEGQSPRVEKDEGPEAETLSRQLIVAKGPN

SEQ ID NO: 140499 - protein, 188 aa, Glycine max
  Coding DNA Sequence Number=SeqID_48814
QGAPFEGTIVDDWKFDYSSHDARHMVCNDQAEMTAQASKEDLILMWAFLIGRQIDWAHLVRYRMLKALRANAPLPYPQLITLFLRHFQIPLDDEPFVQVKRSFAIGAGVVTSFGYRKDRNGQWLKKDALPPQDERTPSPPPQRDDSALMNEVLTELRGLRSYVGERFDSLDKRFAGMDIRLTQLEEDV

SEQ ID NO: 140500 - protein, 50 aa, Glycine max
  Coding DNA Sequence Number=SeqID_48815
MEEPRGIPLSIVGPEAGIWVQAIGLFAQATYAPEFGLPRPFNQKLLVLHI

SEQ ID NO: 140501 - protein, 107 aa, Glycine max
  Coding DNA Sequence Number=SeqID_48816
GGHMNENTIHGAPKKGLRMENCTKQSLRMAPNTKMEDILMKTQFMGLRKGVMNGELHRAITTDGSKLEGGGHMNENAIHGAPKKGLRMENCTKQSLRMAPNPKVEDT

SEQ ID NO: 140502 - protein, 161 aa, Glycine max
  Coding DNA Sequence Number=SeqID_48817
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=53%, HitCoverage=72%, E-value=4e-24, Identity=67%"; Hit description=LacZ protein
  Subcellular localization annotation: CTP_CleavageSite=33; ConfidenceScore=5.64e-01
MTMITPSSKLTLTKGNKSWYRAPPRAPPATWTSLALRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 140503 - protein, 124 aa, Glycine max
  Coding DNA Sequence Number=SeqID_48818
MDKLDIFVPHPLTNASLLIQLSPRCGCKPLVCLLKRPALLSMDFQDRSIRNYSCYTFGEGAGGPLGTSTLTFRGLHVLTFRRLHALTFRGLHALAFRGLHVLAFRGLHVLAIRGEHVLAFRGLH

SEQ ID NO: 140504 - protein, 229 aa, Glycine max
  Coding DNA Sequence Number=SeqID_48819
EESFEAPEEDEEVQALKSELGKARLAKEKFKLAATHIRKECARLREENATTARALEQETKRARKEEYGRNKFRGALWGSNSELKLRREERDQSRAHSMVLKEELVACSRSKRSLSQRLCETETDMLAIIAKYQEELGLATAHEHRIADEYAQIYAEKEARGRVIDSLHQEATMWMDRFALTLNESQELPRLLAKAKAMADTYSAPEEIHGLLGYCQHMIDLMAHIIRNR

SEQ ID NO: 140505 - protein, 52 aa, Glycine max
  Coding DNA Sequence Number=SeqID_48820
MRACSPLKARTCSPLKIDCPFERGDSPCNLILSFANLSENSLRVCVLFDLVI

SEQ ID NO: 140506 - protein, 92 aa, Glycine max
  Coding DNA Sequence Number=SeqID_48821
RVYEGSIAVHNIPLFHGQVKVGVEEVKDAEAPVPIPTEEVAMSSAKPPDKPDHEVDDPLHLMTLTIPQLFLKPLQVMWDATMFGVFNEHFLL

SEQ ID NO: 140507 - protein, 39 aa, Glycine max
  Coding DNA Sequence Number=SeqID_48822
MALYGSVFAYSNPLKDTRLLPSGAFRLSRAGHGMTIYRS

SEQ ID NO: 140508 - protein, 146 aa, Glycine max
  Coding DNA Sequence Number=SeqID_48823
  Homolog annotation: Hit_ID=A5C922; Match level="QueryCoverage=67%, HitCoverage=36%, E-value=6e-13, Identity=37%"; Hit description =Putative uncharacterized protein
  Pfam annotation: Domain name=Retrotrans_gag; Domain location=83-146; Score=11.3; E_value=0.0043; Accession=PF03732.8; Description =Retrotransposon gag protein
MTRGNPSDLQPFDPEHFVIGDFEHYCFEHYDFEHFENMAQPPPRERTLREMAAPDFTCESLCIQYPDEDVPYVLKTRLIHLLPKFHGLAEGVAKDWFHYLAPRSITSWDDLKTVFLEKNFPASRTTTIRKDISRIRQLNGESLYEY

SEQ ID NO: 140509 - protein, 202 aa, Glycine max
  Coding DNA Sequence Number=SeqID_48824
  Homolog annotation: Hit_ID=Q6UUU1; Match level="QueryCoverage=29%, HitCoverage=40%, E-value=2e-18, Identity=78%"; Hit description =Putative uncharacterized protein
AAQLLGRAIGAGLFAITPAGERGMCCKAIKLGNARVFPGELELHSGGGRSRTSGSPGLQEFDPLTTVPHPHGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140510 - protein, 104 aa, Glycine max
  Coding DNA Sequence Number=SeqID_48825
MRRQNLVIPHPFAIQTQSCPMARRDKIWSFCTLCHPEAAGPMTCGDKIWSFRTPLPFRHSPCPMARRDKIGHSAPFVIVGGGPDDTQRQIWSSSAPLFTRSVSY

SEQ ID NO: 140511 - protein, 68 aa, Glycine max
  Coding DNA Sequence Number=SeqID_48826
MVGRGRDALGNTNSPHLGYTRSAYPYSLPSNFTAPAMEENMDHAIPFTFKGQPPQPVGGAREKPQERA

SEQ ID NO: 140512 - protein, 194 aa, Glycine max
  Coding DNA Sequence Number=SeqID_48827
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=7e-23, Identity=96%"; Hit description=LacZ protein
MNTLENGGIHSGKITKIAFPCQEGPLLTVKNTLEKEIHGKITNITFPSQEGPVFTVKNTLENGESIRENNKDSCSPGDPLVLERPPPRWSSNSPYSESYYNSLAVVLQRRDWENPGVTQLNRLATHPPFASWRNSEEARTDRPSRQLRSLNGEWDAPCSGALSAAGVVVTRSVTATLASADVRRCFCRYAPPRQ

SEQ ID NO: 140513 - protein, 83 aa, Glycine max
  Coding DNA Sequence Number=SeqID_48828
  Subcellular localization annotation: CTP_CleavageSite=72; ConfidenceScore=5.39e-01
MLKSCLGLHAVSLVPVPRVSLHPSGPVFEIPSGVANCRNLPFGGRATRGLTGASSMGGRCAESPPTFIREKRQKNRKGVVYEL

SEQ ID NO: 140514 - protein, 75 aa, Glycine max
  Coding DNA Sequence Number=SeqID_48829
MSLKDDDKCSSDKNSKKGPPAKTMQKTLHDMQMRETVMECSSILLIPASGKRLIVCIQISTKRREILVLDLPLME

SEQ ID NO: 140515 - protein, 132 aa, Glycine max
  Coding DNA Sequence Number=SeqID_48830
MVKEECKEVSVSSKRLAKKEIHFAIKTNIKETSLLRQPPHLLLCKRTLLSTVTPLKLKVIPQVKELLDEDLVRKSLNPCALLVPKICIMRHQIPKIGGVEGRSPEFQKPLDLRSNPFQGAWDDAIIHPKGIG

SEQ ID NO: 140516 - protein, 143 aa, Glycine max
  Coding DNA Sequence Number=SeqID_48831
  Homolog annotation: Hit_ID=Q6WAY6; Match level="QueryCoverage=51%, HitCoverage=12%, E-value=2e-07, Identity=41%"; Hit description =Putative uncharacterized protein
RRDASRLGTSKWYRLLNNLRRYLDALLGEENRIFFSRFLSSLSKIAAVVRDLARELDHMKQTRNGVVGLPWKYLEGKARDMASQEKWVSFADILALLIFGVVLFPNVDSLVDLAAIDAFLAYHHSKESPVVAILADLFDTFDR

SEQ ID NO: 140517 - protein, 325 aa, Glycine max
  Coding DNA Sequence Number=SeqID_48832
MRVRKIGGQLPGRGRSQDQVQATPGVFLATPVAVGGGVDRGAAMQVAHDAVCVHVALGDAATCVGQAQIAAVLVPVALGVFEVEIHFNHVIGPPLQGSELALAVVALLLEPVDAAAGHQVVRCAVGDGLRGHFIAVGIAHVLRAIAGIPGGTAGDALFRIGAVQALETQRNAQLLPVAELELVDVAGGAAVADAVVVAVLLVILGPAATQIDLRRPLAVLQWAHCFQADGAGHAAFDDVGALGLVDGDRIDQLGGEHVEVHRAVATAVGDLAAIEVGAAEEGAQATDGDFRGPGLVAGRGGAGQGLDRVGQRGRRQVADVIGREH

SEQ ID NO: 140518 - protein, 219 aa, Glycine max
  Coding DNA Sequence Number=SeqID_48833
  Gene Ontology: Mol. function=motor activity; Cellular component=cell projection
  Homolog annotation: Hit_ID=UPI00016621D1; Match level="QueryCoverage =83%, HitCoverage=40%, E-value=7e-20, Identity=37%"; Hit description =UPI00016621D1 related cluster
GGPLGTSTLTLRGLRALAIRGLRALTFRGIHILTFRGLHVLTFRGLHVLPFRGLHALTFRGLHVLAIRGLHALTFRGLHVLAFRGLHTLTFRGLHVLATRGMHALTFKGLHVLAFRGLHDLTFRGLLALTLRGLHVLAFKGLYVLTFRGLHALTFKGLHVLAIRGLHTLTFRGLHVLAFRGLHVLTFRGLYVLAFIGLHALTFKGLHVLAIRGAARPHL

SEQ ID NO: 140519 - protein, 83 aa, Glycine max
  Coding DNA Sequence Number=SeqID_48834
MVLMKTRLYSLIYQQRRVLEPPSLKPQRTMTVSSPPTLTYYQTTSVPLTLYSCITKTGPRMTDVVVVDKKKDIWNPPPPQGPS

SEQ ID NO: 140520 - protein, 159 aa, Glycine max
  Coding DNA Sequence Number=SeqID_48835
MWDATIFGVFNQNFLLYIKHEDLSEIAHGGQCLSISVIQFWILHLTETSVRAGNSDVYGFLEPQSIQRSGQSQFESESYIKSWIQSSKRDVYLGAYLNGQKGITECGYYVMHWMSTIILGSFRNSWETYFNEVRPLEAERFKALRIQWAQYYLKVRNQT

SEQ ID NO: 140521 - protein, 37 aa, Glycine max
  Coding DNA Sequence Number=SeqID_48836
MDMLLNRHRLFCSNRTYCFGDGKAVDDGQVSKVSKNL

SEQ ID NO: 140522 - protein, 260 aa, Glycine max
  Coding DNA Sequence Number=SeqID_48837
  Subcellular localization annotation: CTP_CleavageSite=56; ConfidenceScore=5.53e-01
LPSLGTGVWGANTFPVRKYNSRTFHQKVRRSRLFRFFRRFPQINVGGDSARIPFVEHASRESRVALPPKGRLRQGPNVKTNPLASHGGASVNAVVEDGPSRTKRLGDVATSRCFIYQSLQAACMVSRDGDERDECLFHLGESHDMETCPVVEELLQRLMDCGQLEVFIGGKEEPQICMQSEEKKGTGSTPIYPRAAPKPTPFAYQSNKAVPWKYTPPTSSERVVTEVDSLSAKVTNITGLSGVTRSGRVFASSHPAELPS

SEQ ID NO: 140523 - protein, 147 aa, Glycine max
  Coding DNA Sequence Number=SeqID_48838
MTPRENIFCELRQLQCRKRSDFRRFKEKASMFQPASSGPNPDSGRSIHSTDRFATPVAPSPLSASTTDSMMDRGGSIGQCPALKPSIATDIGNQCRHYVMIEHNSSGLPAVLTKRLPVSPSVCMFGNNVSAFSVNIRREFSALSGSS

SEQ ID NO: 140524 - protein, 217 aa, Glycine max
  Coding DNA Sequence Number=SeqID_48839
MTNSIYQPITLNDPRLLQFAEQLNPGASPIYLPVIDKPGPEGNAYWNVSAAIEQVGGKMLLGWEINYWPGCFLVATHHAALQADDGGVYDVTQRSQAAAVPTVNLFIPDDSIAIDLDKTPAVKSRFYILHSAAQITDYLRAYDNLNAFEKKLSDKLYEIGYRCETNKALASGIVGTTPAFVEGSSVDIDEIKMNISELSWILKDKIKKLKQYSDALQ

SEQ ID NO: 140525 - protein, 67 aa, Glycine max
  Coding DNA Sequence Number=SeqID_48840
MVPFIAQCRALRIHKRLSSISANPHQLDFAPYASGPYNAQWNAPGLLHDKHMLRPSCILRKMEVEET

SEQ ID NO: 140526 - protein, 99 aa, Glycine max
  Coding DNA Sequence Number=SeqID_48841
  Subcellular localization annotation: CTP_CleavageSite=70; ConfidenceScore=5.23e-01
MAGTPQPGHTLSTRSLDGTFLLPGIPGSYPNPYLYGFPLISTMSAFLRPSLPRPILGSNPFLSITRVTIMAALEREGSNGLWFHKGAAHHLEGLESRFQ

SEQ ID NO: 140527 - protein, 35 aa, Glycine max
  Coding DNA Sequence Number=SeqID_48842
MPIQQGPNIFQRTTKLEETLTQFMQNRIPRRNAKL

SEQ ID NO: 140528 - protein, 85 aa, Glycine max
  Coding DNA Sequence Number=SeqID_48843
  Subcellular localization annotation: CTP_CleavageSite=31; ConfidenceScore=5.11e-01
MASGNRLPRVGFHILKLCNSSLASGNRLPMRCNRLPKMKSLEISLLLACSGHGTHCVATAVRSLVKESTSFLFFLVDRDGGAKNP

SEQ ID NO: 140529 - protein, 90 aa, Glycine max
  Coding DNA Sequence Number=SeqID_48844
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTSTCRSTSHFAKSWPRASRYQQGHQDLFILRSDLPSQVLQWLLFLSAVPPVQLLTGWCVTAKAPPDISAGKCSGHAARNHHTRRA

SEQ ID NO: 140530 - protein, 141 aa, Glycine max
  Coding DNA Sequence Number=SeqID_48845
MELIENMAASDQAILRDRSYVPTKRSLLELGTQDATLAQNKLLTRQIEALTETLSKPPQQLQAVEGCPTCGGTHEPGQCVSQQDTSREVNYMGVPNRGYQGYNQGNSSGFHQGGAGFNHGPPGFNQGRNFTQGSSGGSGIL

SEQ ID NO: 140531 - protein, 208 aa, Glycine max
  Coding DNA Sequence Number=SeqID_48846
MRLLLYPPLVKVKKQKGEESSEEIYPQEEGQPLMVKEECKEVSVSSKRLAMKERHFEIKTNIKEISFLRQPPHFLLCKKTLVSIATSLRLEFIPQVKELLDEGLVRKRLNPCALLVPKIGIIRHQIPKIGGVMNALGGATLFCKITRAPNIFMICVHRDSLGRNNQHENTEKGMFYCFTFLNFLNCEQGVPMNPKRINVIPEWPAPPS

SEQ ID NO: 140532 - protein, 117 aa, Glycine max
  Coding DNA Sequence Number=SeqID_48847
  Gene Ontology: Biological process=transposition, DNA-mediated
  Homolog annotation: Hit_ID=Q1J7G7; Match level="QueryCoverage=25%, HitCoverage=42%, E-value=2e-10, Identity=100%"; Hit description =Transposase
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSMYDHIRRMLLICR

SEQ ID NO: 140533 - protein, 68 aa, Glycine max
  Coding DNA Sequence Number=SeqID_48848
MEVEEPWLGLWLPLNYRVDMGSSLAYDNGIWGFVVDLGMAFVDNWVVGKEVCYWLSNDIVGLVGNLAV

SEQ ID NO: 140534 - protein, 30 aa, Glycine max
  Coding DNA Sequence Number=SeqID_48849
MTGTPQRRRHFKEKMSLEEAHHHRRPWIRA

SEQ ID NO: 140535 - protein, 143 aa, Glycine max
  Coding DNA Sequence Number=SeqID_48850
MEGLVDLAAIDAFLAFHHGKESPLGYPMRGAPLDESITPFIARGFSDHNARDKELRGSSNRIISSYHKWLRVRTQGLDWLPNLKTVRDDEVKASEESDEVQALKAELERARVVEEKFKSIAIKGSNSKLKLRRGERNHHRSKA

SEQ ID NO: 140536 - protein, 132 aa, Glycine max
  Coding DNA Sequence Number=SeqID_48851
MVREGIGHILKTHSHRREKERKPQEANINLPYFHGKDNVEANLVWEIRVEQQLKKKSTSKSYGSHSYPKKDQGQGILGVTPSKPKDDKGKTIEKQAPKASMQEKTSSIKCFKCLGRGPRVLMSLRVDFEPMG

SEQ ID NO: 140537 - protein, 142 aa, Glycine max
  Coding DNA Sequence Number=SeqID_48852
  Homolog annotation: Hit_ID=Q7XG75; Match level="QueryCoverage=88%, HitCoverage=23%, E-value=4e-10, Identity=37%"; Hit description=Zinc knuckle family protein
MAQPPPREMTLREMAAPDFTYESLCIQYPDEDVPYVLKTGLIHLLPKFHGLVGEDPHKHLKEFHIVCSTMKPLDVQEDHIFLKAFNHSLEGVAKDWLYYLAPRTHNMERSMIDAASGGALGDMTPAEARNLIEKDGFKLPTI

SEQ ID NO: 140538 - protein, 240 aa, Glycine max
  Coding DNA Sequence Number=SeqID_48853
  Homolog annotation: Hit_ID=A7MPZ5; Match level="QueryCoverage=55%, HitCoverage=79%, E-value=7e-54, Identity=76%"; Hit description =Putative uncharacterized protein
DPARYNLQFQAHPQINRSAPLKVRVLVLKSDAEFMSADFYSLQNNAQKVLAGNLLNSDEFFLMPGQLAKKLSGQSSPEARYIGVMAEYQSLDGKKWRISLPLPTPGETPFWQFWKLSADQLQANLYLDVNGIRVRSWLWGFLEIELDDAMLRQGCIALSYASGLLPDGTFFQFRDARQGPAPLQIPDNVTGEKVVLALPVRRGGREEVIFSEEKDSLARFTAFEQDVEDDNALSVGDATV

SEQ ID NO: 140539 - protein, 93 aa, Glycine max
  Coding DNA Sequence Number=SeqID_48854
MGLRSRIVLGDGQMPGQIQRQRQIKVNGNAATVCCAMSFPALRYLGTDASRGYAHDRWIIVPCPASDKREAQLGGNLVSFKFPVIITVVSLRE

SEQ ID NO: 140540 - protein, 40 aa, Glycine max
  Coding DNA Sequence Number=SeqID_48855
NSSEGEGVQPSEGEDVQSSEGEPIGQVPKDFNLREARKEE

SEQ ID NO: 140541 - protein, 26 aa, Glycine max
  Coding DNA Sequence Number=SeqID_48856
MVESVQPNVPYDHEALYSRGVSGLYF

SEQ ID NO: 140542 - protein, 196 aa, Glycine max
  Coding DNA Sequence Number=SeqID_48857
LHVLALRGLHVLTIRGLHALTVRGVHSLTLKGLHVLASRGLHALISRGLHLLALRGLHALTFRGLRVLIFRASSFLLTVPGPPPDIGGGPTVRAQPEREAITQLLCIPGQDFTRACKETNIDDIATSQHSAQRPQCQSPPAKVSVGLCRPNMGIAPKRHPVDPEKSNRALGFPALVTGLYQSYRVLVPPRQGHIII

SEQ ID NO: 140543 - protein, 109 aa, Glycine max
  Coding DNA Sequence Number=SeqID_48858
  Homolog annotation: Hit_ID=Q84VH5; Match level="QueryCoverage=56%, HitCoverage=9%, E-value=3e-16, Identity=74%"; Hit description =Envelope-like protein
GTHVPDIVSTSGKAAASGAVSKDALIAELKDTCKVLEATIKATTEKKMELERLIKRLSESGIDDGEAAEQEDEAAEEEVEAAEEEEEAAEEEEDAAEDTESDDDSEATP

SEQ ID NO: 140544 - protein, 87 aa, Glycine max
  Coding DNA Sequence Number=SeqID_48859
  Homolog annotation: Hit_ID=Q84VH5; Match level="QueryCoverage=45%, HitCoverage=5%, E-value=6e-13, Identity=95%"; Hit description =Envelope-like protein
DALIAELKDTCKVLEATIKATTEKKMELERLIERLTDSGIDDGETAEEEEDPAEEEEAAVEEEEAAEEEEDAAEDTESDDDDSQATP

SEQ ID NO: 140545 - protein, 192 aa, Glycine max
  Coding DNA Sequence Number=SeqID_48860
  Gene Ontology: Mol. function=chitin binding; Cellular component =extracellular region; Biological process=chitin metabolic process
  Homolog annotation: Hit_ID=UPI00006A17C9; Match level="QueryCoverage =90%, HitCoverage=100%, E-value=2e-10, Identity=27%"; Hit description= UPI00006A17C9 related cluster
  Subcellular localization annotation: CTP_CleavageSite=79; ConfidenceScore=5.13e-01
MLVRVIRTRLFAAARVKSCPGMHSSCVIASLSGCARTVGPPPISGGGSGTVWIWSPLKVRTRSLLKARACSPLKFRTCRLSKARECSPMMARTCNPLKVRACSPTKVKAHDPLTARTCSPLKLKVHDPLKARTCSPLKVKVRACSPLMVRTCSPLKARTCSPLTVRVRACSPLMVRTCSPLKARTCSPLNGE

SEQ ID NO: 140546 - protein, 82 aa, Glycine max
  Coding DNA Sequence Number=SeqID_48861
MDKSLKVGEYEWGERERKSKKFCASNKVILMMPKNQELSKVSSKDSRIKNNQDQDSRLNIQESREDSIKISTKKFFKTLSNT

SEQ ID NO: 140547 - protein, 47 aa, Glycine max
  Coding DNA Sequence Number=SeqID_48862
DFIYRATKDAKYLKAANQRLHVIKGFALDNGRHMNSARQKHSWGSEK

SEQ ID NO: 140548 - protein, 65 aa, Glycine max
  Coding DNA Sequence Number=SeqID_48863
  Subcellular localization annotation: CTP_CleavageSite=24; ConfidenceScore=5.03e-01
MMHAPDSTLRCNVGTVLSLSRPPGCARNSPPPIGDQPGSPKGVPLLGSPLVQSTLGHSYSISCVV

SEQ ID NO: 140549 - protein, 59 aa, Glycine max
  Coding DNA Sequence Number=SeqID_48864
MKDCRNTSSGDVSSTSRTSQSLTKDQADVLMMPKDHMRLKALFKTKQLKIFKIDDQDSL

SEQ ID NO: 140550 - protein, 24 aa, Glycine max
  Coding DNA Sequence Number=SeqID_48865
MSDCVPWYIETIKLIDTVDLEGGP

SEQ ID NO: 140551 - protein, 54 aa, Glycine max
  Coding DNA Sequence Number=SeqID_48866
MWTTTGEVVAAQLAQASSARPGEPGCFLQKQQPSGGNILEGPSGPGCYLHPHFY

SEQ ID NO: 140552 - protein, 223 aa, Glycine max
  Coding DNA Sequence Number=SeqID_48867
  Gene Ontology: Biological process=transposition, DNA-mediated
  Homolog annotation: Hit_ID=Q6UUU1; Match level="QueryCoverage=26%, HitCoverage=40%, E-value=2e-18, Identity=78%"; Hit description =Putative uncharacterized protein
YDGVFEVLQWLLFLSAVPPVQLLTGWCVTAKAPPDISAGKCSGRVPFAIQAAQLLGRAIGAGLFAITPAGERGMCCKAIKLGIRSDHQALDSDKKHTTWIPHMLRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140553 - protein, 155 aa, Glycine max
  Coding DNA Sequence Number=SeqID_48868
MGQKRHLSLCQNHGSLVRWDSNKSEQAEIVFPDSEFSYFRVIKIHAVCKLGHLKSWKADLKENSTYVMHNFKVVKNDVPIVREADLHELPFKEFRFVEFANVVAGNFMAGLLVVVKFYLAHFGRITISFGVAVFGIYRKLSSFSEQFLQGVKTID

SEQ ID NO: 140554 - protein, 63 aa, Glycine max
  Coding DNA Sequence Number=SeqID_48869
MIFRGLDLNQGGEGALMDSSECRPWGSPGFECSFKPMLIPYGWSILAKHRDPDWSPYDLTFSV

SEQ ID NO: 140555 - protein, 119 aa, Glycine max
  Coding DNA Sequence Number=SeqID_48870
MDRVTSLLRLLPNTFRTVDVPVTSSFTLTKMSCTIKEHALRCPYQTRAIARVMGEVEEVQEKMKADMEAMKEQMATMMEAMMIMKKIMEASAVAVAATSTVAKVNPMPPSGLNQMNHPT

SEQ ID NO: 140556 - protein, 110 aa, Glycine max
  Coding DNA Sequence Number=SeqID_48871
MASKKLSAKRSRRDAVAEGTSAAPEFDSHRFQSAAHQQHFEAIKGWSFHRERCVQLRDDEYTDFQEEITRRHWTSLATLMAKFDPEVVLEFYANAWPTAQGVQDIRSWVR

SEQ ID NO: 140557 - protein, 140 aa, Glycine max
  Coding DNA Sequence Number=SeqID_48872
MQQPGTIEQLKAYAANIYNRPPQPQQQNQPLTIMISPATDTTLDGRITLISDGLALTRSNISPLFLPKCCWLQADHTFLHTINNMATRPRKPHLNQEVKELHGRKCFSALIGKSVPQIPEKCKDPGRISQGHSHHSRADF

SEQ ID NO: 140558 - protein, 145 aa, Glycine max
  Coding DNA Sequence Number=SeqID_48873
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=58%, HitCoverage=72%, E-value=8e-24, Identity=68%"; Hit description=LacZ protein
MHENLTFFIYRCGPIPFRKTVFYVSFNRQGYHYLSNSCSPGDPLVLERPPPRWSSNSPYSESYYNSLAVVLQRRDWENPGVTQLNRLAAHPPFASWRNSEEARTDRPSQQLRNLNGEWDAPCSGALSAAGVVVTRSVTATLASAD

SEQ ID NO: 140559 - protein, 153 aa, Glycine max
  Coding DNA Sequence Number=SeqID_48874
  Homolog annotation: Hit_ID=Q84VH5; Match level="QueryCoverage=75%, HitCoverage=17%, E-value=2e-42, Identity=73%"; Hit description =Envelope-like protein
MATSPKETSASGSPSVPSSPHQEQPEFNIQPIQIIPGSAPVPEKLVPRRQQGMKTSENPSLATSPREVDMEMDKKIRSIVSRILKDASVPDADKDVPTSGTPNVSVPDADKDVPTSSAPNAEALSSPSEEESTEEEDQASEETPAPRAPEPAP

SEQ ID NO: 140560 - protein, 93 aa, Glycine max
  Coding DNA Sequence Number=SeqID_48875
MVKKPTRVGELIALALNFSSPGRAAFAPSAHFPINRHAREAEEGFQGSEGEGIERREKEEEERRGNEAEALPNRDHDHSLLHFLFCVLCATVD

SEQ ID NO: 140561 - protein, 24 aa, Glycine max
  Coding DNA Sequence Number=SeqID_48876
MEFLELKQGSMTVAEGKLGRGPNA

SEQ ID NO: 140562 - protein, 195 aa, Glycine max
  Coding DNA Sequence Number=SeqID_48877
GGGPDDMQRQIMVIPHTSPFRHSRVRWHVETNVIFCAFCHPEAADPMTCGDKLWSFRTLHHSDTVMSDGTGGGPDDMQRQIMVIPHTFSPFRHNRVRWNAETNVVFCAFYHPEAASPMTCGNHLVPHFLLLSSRGGGLDDRSNKLSDKRAETNYGHSAPFVIQGRYMAPIVRRFMKLRDMPEVKRKHCCTIRKVP

SEQ ID NO: 140563 - protein, 41 aa, Glycine max
  Coding DNA Sequence Number=SeqID_48878
ENGRIGEQRYAMTSRGSELEGGGHMNSARLEGGGHMNSARH

SEQ ID NO: 140564 - protein, 120 aa, Glycine max
  Coding DNA Sequence Number=SeqID_48879
MELMRLHHHEENDIKRKGITLRTSSSFIQEESDKEDLTETEEDDDDFRLFVKRFNKFLRNKRNKRKSNINTKKKEEDSFLAPSCYESNQPWHMRSDYLVFERRIEKSDKRNLKEKKEKKA

SEQ ID NO: 140565 - protein, 233 aa, Glycine max
  Coding DNA Sequence Number=SeqID_48880
MRSWVRGQWIPFDADALSQFLGDPLVLEEGQECEFSQIRNRADGFDEEAIAQLLCIPGQDFTRTAAGRRVRIMRTSITTLTQMWMTLLLSNVLPSDHNSDLPLPKCMPPTRHPLDPDKSNRALGFPELITGLCQLFGVPVTPSKVIRPPITRAFIEKYCTPRQVQGDAPQAADAPPPPHQADPAGSLGMEWYLQHLVRQQAANHRGQVQIHECLYQLSLSQQGCPTLDQFRAE

SEQ ID NO: 140566 - protein, 62 aa, Glycine max
  Coding DNA Sequence Number=SeqID_48881
  Gene Ontology: Mol. function=helicase activity
  Homolog annotation: Hit_ID=Q9LW42; Match level="QueryCoverage=100%, HitCoverage=3%, E-value=5e-09, Identity=48%"; Hit description =Helicase-like protein
MVESERLNYIRNNQKKLRVDKYCCLQNSLDAGTSQGLNKRKRVILPPTFVGSPRYMDQLYFD

SEQ ID NO: 140567 - protein, 203 aa, Glycine max
  Coding DNA Sequence Number=SeqID_48882
  Homolog annotation: Hit_ID=Q9AVH2; Match level="QueryCoverage=23%, HitCoverage=16%, E-value=8e-20, Identity=97%"; Hit description =Putative senescence-associated protein
MARHKVTRTHTHTHSRRHKGEEGLGRPSARAHTYLAPGRQNEREPTNGSLFWPNIVEEERDTGLIGFLGGTGFVGDLEGRDESKRQGLNLSGSWQQGHSATYNTPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 140568 - protein, 87 aa, Glycine max
  Coding DNA Sequence Number=SeqID_48883
MQSLLLIPAFPRGKHTELNFFAFDVHPNRTIFIAEAKETLSCFVTAFSLTLLCHGLDANAGPLTNFEVLDFLRSKGASKDPTSVIAK

SEQ ID NO: 140569 - protein, 69 aa, Glycine max
  Coding DNA Sequence Number=SeqID_48884
MGDQATSMFQQNSPTERLSLRLQLPSFYLDAILPRKGPITRTMSKRLQEDWARAAEEGPRVLMNLRVDF

SEQ ID NO: 140570 - protein, 118 aa, Glycine max
  Coding DNA Sequence Number=SeqID_48885
  Subcellular localization annotation: CTP_CleavageSite=55; ConfidenceScore=5.80e-01
MAAKSTKPSTFGKRTTPKINKANISANGPHFSWLAISLALPSRCFRGRPTTPLRVCFMRSNSFAESPTTAAILLKEGRNPEKRYGFLPSRGHPSISSNSSIVGTIWKSPSMKHLNGWS

SEQ ID NO: 140571 - protein, 71 aa, Glycine max
  Coding DNA Sequence Number=SeqID_48886
MAYGDISAMVKSKIFPYVLRKACIWRGPINCPNSLMLHVCFVPVFKGPRWERAKRVFSDNPQGGHISLDGL

SEQ ID NO: 140572 - protein, 43 aa, Glycine max
  Coding DNA Sequence Number=SeqID_48887
MSKRLQEDWARAAEEGHRVLTNLRVGYPRNIGFFSPCILGHLD

SEQ ID NO: 140573 - protein, 26 aa, Glycine max
  Coding DNA Sequence Number=SeqID_48888
WGHLEMAEFWTKLGYAIFRCTNFCTE

SEQ ID NO: 140574 - protein, 54 aa, Glycine max
  Coding DNA Sequence Number=SeqID_48889
MASFLLIMGEVGRFMMQSYPPRALDRRLQEDWAKDAREGPRVLMSLRVDFRPMG

SEQ ID NO: 140575 - protein, 171 aa, Glycine max
  Coding DNA Sequence Number=SeqID_48890
MIESFHQQDQMSVLELYIEKDVADGFMFHSANSLTSCENNLSDNEAEPPRNVSNLHGDEDDDDYLMSNSYVEESLDEDDSVVGISDTDDEVTNMIQPVRIVHPAQGVEQIQNPFWNDALHYNNINWSYPDEEDIYGLEMPSSFNVGQESYVGMDFDSNDTVKNALKQYVMK

SEQ ID NO: 140576 - protein, 308 aa, Glycine max
  Coding DNA Sequence Number=SeqID_48891
  Homolog annotation: Hit_ID=UPI00006A2D9E; Match level="QueryCoverage =68%, HitCoverage=87%, E-value=4e-14, Identity=16%"; Hit description =UPI00006A2D9E related cluster
RTTCPRLQRVARSRLQRATHPRLQRTGRPLLQRATRPHLQRTILPHLKRTARPHIQRAAYPRLQRTTRPHLQRATRPHLQRTTRPHLQGLHALAFRGLDVLTFRGLHALTFRGLYVLTLKGLHVLRTTRPHLQRATRPHLQRTTHPHLQGLHALAFRGLDVLTIRGLHALTFRGLHVLPFRGLHALAFRGLHVLTFKGLHALAFKGLHALAIRGLHGLTFRGLHVLTFRWLHALAFRGLHVLAFKGRHVLNFRGLHTLAFRGLHTLAFKGRRALNFRGLHALAFRGLRVLTFSGLHIHTLRGFKVLYP

SEQ ID NO: 140577 - protein, 417 aa, Glycine max
  Coding DNA Sequence Number=SeqID_48892
  Homolog annotation: Hit_ID=Q84VH5; Match level="QueryCoverage=100%, HitCoverage=68%, E-value=1e-169, Identity=70%"; Hit description =Envelope-like protein
SSTPNVSVPDVDKDVPTSSAPNDEVLSSSSKERSAEEDDQATEETPAPRAPEPAPGDLIDLEEVESDEEPIANKLAPGIAERLQSRKGKTTIKRSGRIKTMAQKKSTPITPTSSRRSKVAIPSKKRKEISSSDSDYDVELDVPDIKRTKTSGKKVPDNVPDAPLDNISFHSIGNAERWKFVYQRRLALERELGRAALDCKEIMDLIKAAGLLKTVSKLGDCYEGLVREFIVNIPSDITNRKEPTDGVIDIDVSEHQIAKEITAKRVQHWPKKGKLSAGKLSVKYAILHRIGAANWVPTNHTSTVATESFAVKLPIAFPTVLCGIMLSQHPNMLNYTDSVMKRESPLSLHYKLFEGTHVPDIVSTSVSTSGKAAASGAVSKDALIAELKDTCKVLEATIKATTEKKMELELLIKRLSE

SEQ ID NO: 140578 - protein, 149 aa, Glycine max
  Coding DNA Sequence Number=SeqID_48893
  Homolog annotation: Hit_ID=Q9C8B0; Match level="QueryCoverage=34%, HitCoverage=2%, E-value=3e-08, Identity=53%"; Hit description =Putative uncharacterized protein F10O5.11
MTQSDIHRDEHQIPTNTTQDDQFVGDDNSDSTDNDVNMTQENINIEYSSNDPTIDDLDDYDEQTFLSASSAYQNTGGTYIDIGDPIWECPHCKAMMWYDEKINKDKQTNKPRFSLCCSDGKIQLPLLHEPPHPLNHLLFNNQDPKAKNF

SEQ ID NO: 140579 - protein, 331 aa, Glycine max
  Coding DNA Sequence Number=SeqID_48894
  Homolog annotation: Hit_ID=Q6WAY6; Match level="QueryCoverage=97%, HitCoverage=54%, E-value=4e-33, Identity=31%"; Hit description =Putative uncharacterized protein
MVEVSIESIASLAQYYDQPLRCFTFGDFQLSPMVEEFEEILGCPLGGRKPHLFSGFYPSLARISKIVQISAHELDRQKKVENGVVGIPRKYLEAKARILAGKDEWAPFIDILTLLIFGGVLFSNVDGLADLAAIDAFLAYHNHKESPVVAMLADLYDTFDRRCEKSSTRIFCCTPTLYVWLVSHLFRQEVRHACPLESHRSCTEKGGVNWDQLLASKERAYVNWFPRWKEGRTRVLISCGGFPNVSLMGTKGCISYNPVLAIRQLGYPMRGAPLEEELTPVISRGFSETNVETLRKVRKAWEVVQKKDKELKGSNNGPIGGYRKWLKAHVQ

SEQ ID NO: 140580 - protein, 178 aa, Glycine max
  Coding DNA Sequence Number=SeqID_48895
MTWKYDLLIDVGNALACACCVCSWGALCTDLSGSLALAFGHVHTLDVVRTPFRHPKTIESYGTQTQIMVILHLLSSRGSEPNDMWRQIVVIRAPFRHSDTIESDGTQRQIMVILHLLSSRGETIKFDSTRRQILVIRTLLLSGQRVGWWAEIPYGHPHLSSTERNEFSSIRMMLVVQC

SEQ ID NO: 140581 - protein, 248 aa, Glycine max
  Coding DNA Sequence Number=SeqID_48896
  Pfam annotation: Domain name=MAP7; Domain location=2-167; Score= -81.8; E_value=0.071; Accession=PF05672.2; Description=MAP7 (E-MAP -115) family
MSHHSSSVNGKGTSHKDPLSRILDELSSLKLWKEKQERKEKGKKRVEEISQDERKKIREEERRKVMKEMKREKYASYSSHNSCKSLSEELRDYYEGRHRSHLRPHFHRREKERKPQEANIKLSYFHGKDNVEANLDWEIRVEQQLKKKSTSKSYGSHSYPKKDQGQGILGVTPSKPKDDKGKTIEKQAPKAKDTLVLNAPPQKTMIMRGKTFIVAKMRLLLHLPLVKVKKQKGKNPVKKSTPEKKDNL

SEQ ID NO: 140582 - protein, 349 aa, Glycine max
  Coding DNA Sequence Number=SeqID_48897
  Gene Ontology: Mol. function=signal transducer activity; Cellular component=integral to membrane; Biological process=signal transduction
  Homolog annotation: Hit_ID=A4WA59; Match level="QueryCoverage=100%, HitCoverage=48%, E-value=1e-158, Identity=81%"; Hit description =Periplasmic sensor diguanylate cyclase/phosphodiesterase precursor
  Pfam annotation: Domain name=EAL; Domain location=98-334; Score =355.5; E_value=9e-104; Accession=PF00563.11; Description=EAL domain
  Pfam annotation: Domain name=GGDEF; Domain location=1-84; Score= -57.1; E_value=0.011; Accession=PF00990.12; Description=GGDEF domain
  Pfam module annotation: Pfam domain module=EAL::GGDEF; Domain location=98-334::1-84
MLARMGGDEFAMTIGGDNAEARAAAFAVSVLDAFATPIQLGERTIHMGASIGIASGTLIECTSSELFRRADIAMYHSKMSGKGRITHYDAELNSARERKLAIENQIRNGLERDEFEVWYQPIIDAHSQKMSSVEALVRWPRRPEGPLGPDTFITIAETSGLIYKLGQFVLQRACQDLQPYSDLTLSVNISPAQFRDPAFEEKVASVLEITDFPANRLQLEVTESYVLENPERARMAIANLKALGIAVALDDFGTGYSSIGYLRRFNFDTIKIDKSLAGLVDNDEQAAALVSGTVRIANALGMAVVAEGVETERQMKLLRLAGCDQLQGFWFSQPMPIESIRALHQVRRC

SEQ ID NO: 140583 - protein, 146 aa, Glycine max
  Coding DNA Sequence Number=SeqID_48898
  Gene Ontology: Mol. function=RNA-directed DNA polymerase activity; Biological process=regulation of transcription, DNA-dependent
  Homolog annotation: Hit_ID=A5C5B9; Match level="QueryCoverage=89%, HitCoverage=8%, E-value=2e-24, Identity=45%"; Hit description =Putative uncharacterized protein
  Pfam annotation: Domain name=MP; Domain location=1-124; Score=-36.3; E_value=0.029; Accession=PF01107.9; Description=Viral movement protein (MP)
MNTVKNTNTYTRCVQVAIKPLIDMSIDATVLMCLRDIRHNKFEDSLIGTVETSLGQGLVYFNCYPNKIVSLMDRNILDSLFLNIHFHGLDMKEGSILAALIYRIQYKVMNTYASRVLLKPQRGETTLFITDMTKANVSLPRTINGM

SEQ ID NO: 140584 - protein, 74 aa, Glycine max
  Coding DNA Sequence Number=SeqID_48899
RTTRPRLERTTRPHLQRADVLTSRGLHVLAFRGLHVLAMRGLYALAFRGLHVLTFRGLHVMHPTPQGHWLEDSK

SEQ ID NO: 140585 - protein, 486 aa, Glycine max
  Coding DNA Sequence Number=SeqID_48900
  Gene Ontology: Mol. function=sorbitol-6-phosphate 2-dehydrogenase activity; Cellular component=cytoplasm; Biological process=metabolic process
  Homolog annotation: Hit_ID=P05707; Match level="QueryCoverage=52%, HitCoverage=98%, E-value=1e-122, Identity=88%"; Hit description =Sorbitol-6-phosphate 2-dehydrogenase
  Pfam annotation: Domain name=GutM; Domain location=369-477; Score =176.2; E_value=8.3e-50; Accession=PF06923.2; Description=Glucitol operon activator protein (Gu
  Pfam annotation: Domain name=PTSIIA_gutA; Domain location=1-117; Score=188.5; E_value=1.7e-53; Accession=PF03829.4; Description=PTS system glucitolsorbitol-specific IIA component
  Pfam annotation: Domain name=adh_short; Domain location=105-275; Score=87.9; E_value=3.2e-23; Accession=PF00106.16; Description=short chain dehydrogenase
  Pfam module annotation: Pfam domain module=GutM::PTSIIA_gutA::adh _short; Domain location=369-477::1-117::105-275
TTITRIGQSAADALSDQMLITFREGAPADIEEFCFIHCHGELKGELKAGSQLELGEARYAVTAVGDVAEQNLRELGHITLRFDGQPQAEYPGTVHVDGPEIDMSQVAVVIGGGQTLGEFLSRGLAAEGYRVAVVDIQSEKAARVADSINTEFGEGMAYGFGADATSEQSVMALARGVDEIFGRTDLLVYSAGIAKAAFISDFELGDFDRSLQVNLVGYFLCAREFSRLMIRDGIQGRIIQINSKSGKVGSKHNSGYSAAKFGGVGLTQSLALDLAEYGITVHSLMLGNLLKSPMFQSLLPQYATKLGIKEEEVEQYYIDKVPLKRGCDYQDVLNMLLFYASPKASYCTGQSINVTGGQGEGIQQGADMVTALITVAALAWICQMAFGGWQIHQFNRAFDALCQKGRVGVGRSGGRFKPRVVVAVALDENNNVCDSLIMRGMTVFARPVKIQAINGISLQELRPDVIFPHDPLCQNALSLALNLKHG

SEQ ID NO: 140586 - protein, 97 aa, Glycine max
  Coding DNA Sequence Number=SeqID_48901
  Subcellular localization annotation: CTP_CleavageSite=60; ConfidenceScore=5.14e-01
MDRVTMLLHLLPNTFRTVDVLVTSSFTLTKMSRTIKEHTLQRPCRTHARAKVMSEVEEVQEQMKADMKAMKEKMATMMEANMSMKEIMEVNSAALLR

SEQ ID NO: 140587 - protein, 56 aa, Glycine max
  Coding DNA Sequence Number=SeqID_48902
MKQSYQSAFGLTLNSLEDEDAGFHDKDTALEDETKVEELEQSKEIIVTPPKDLPRE

SEQ ID NO: 140588 - protein, 62 aa, Glycine max
  Coding DNA Sequence Number=SeqID_48903
MKIKKSDQGLPVDLKRIKVIPEWPTPPSVEDRIHEFQETLDSRSNPFQGGGNDAILPPKGIE

SEQ ID NO: 140589 - protein, 97 aa, Glycine max
  Coding DNA Sequence Number=SeqID_48904
  Homolog annotation: Hit_ID=Q6WAY6; Match level="QueryCoverage=45%, HitCoverage=7%, E-value=8e-10, Identity=61%"; Hit description =Putative uncharacterized protein
MEGLVDLAAIDAFLAFHHGKESPEGRIKILSSCEGFPNVPLMGTRGCINYNLVLAIRQLGYPMRGAPLDESITPFITRGFSDPNAKVLQGVRKACDA

SEQ ID NO: 140590 - protein, 40 aa, Glycine max
  Coding DNA Sequence Number=SeqID_48905
MASIIAAICSFMASMSASIYSCTSSALPFTLALARVWTWG

SEQ ID NO: 140591 - protein, 169 aa, Glycine max
  Coding DNA Sequence Number=SeqID_48906
  Homolog annotation: Hit_ID=A0ST23; Match level="QueryCoverage=15%, HitCoverage=55%, E-value=2e-08, Identity=100%"; Hit description =Putative reverse transcriptase
DLPFTAVPPVQLLTGWCVTAKAPPDISAGKCSGRVPFAIQAAQLLGRAIGAGLFAITPAGERGMCCKAIKLGNARVFPVTTLVTFKRVIRKKSTEEFSCMPYIKLIDTVDLEGGPVGKPVVPAALMNRPTRGERRFAYWALAECILAYYVGTDEGVSEVLHVAGEKRLH

SEQ ID NO: 140592 - protein, 87 aa, Glycine max
  Coding DNA Sequence Number=SeqID_48907
  Subcellular localization annotation: CTP_CleavageSite=67; ConfidenceScore=5.07e-01
MTKLGLCLSSGPPPLDDKRVRITVRMTKLGLCLSSGPPPLDDKRVRITVTSPRMQRLWVPRMTNLVSARARRLQWDDKRGYVVLDNL

SEQ ID NO: 140593 - protein, 76 aa, Glycine max
  Coding DNA Sequence Number=SeqID_48908
MVVDVGQKDDLSRSKKKNHRKTTIEHFLIDIVQILSGDGIEKNNSRHWSLIAPIDIYLSTLWNFISKRWPIIFFTV

SEQ ID NO: 140594 - protein, 103 aa, Glycine max
  Coding DNA Sequence Number=SeqID_48909
MVEEEPQLFVVLVVTAVVVLEEEHMACLDQQHSKKEGQAVVVVEDLSISDLDDSSNLDCIYCLKGHNYSVVVDFAVEEIATKKDRDLYGDLQKNIDHRLLQQV

SEQ ID NO: 140595 - protein, 184 aa, Glycine max
  Coding DNA Sequence Number=SeqID_48910
  Homolog annotation: Hit_ID=A1IW39; Match level="QueryCoverage=17%, HitCoverage=80%, E-value=3e-09, Identity=91%"; Hit description =Putative uncharacterized protein ophh-69
EVGGAETTRRFALEAAPLERMRNSSLIGRFLRRKMNGAKRSAEAGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 140596 - protein, 243 aa, Glycine max
  Coding DNA Sequence Number=SeqID_48911
DGKVEYIGGEFDVWEDMSADCLNAFILYDLVKACKKYSNIGECFWLIDKDLDFNHGLRSCTTDGDILHLVRDAFENENEINVYFHHEVDPILEGVPQMLYLECDPIPEVVENEDDLDDVPIAGHEEDAGEQRDADAGEQRDGGEQRDADVGEQRDGGGEERDVGDSEEEKEVDSDEWFTNFSCMMNEVEAEVETNDEDVEVYPQYSQSSGVGEQKLELGMEFDTLDEFKSALREYSILMGREF

SEQ ID NO: 140597 - protein, 220 aa, Glycine max
  Coding DNA Sequence Number=SeqID_48912
  Homolog annotation: Hit_ID=Q84VH5; Match level="QueryCoverage=100%, HitCoverage=32%, E-value=3e-97, Identity=83%"; Hit description =Envelope-like protein
MATSPKETSAPGSPSVPSSTKAPSIQEQPEFHIQPIQMIPGQAPVPEKLVPRRQQGVKIAENPSLATSPREVDTEMDKKIRSIVSSILKDASVPEADEDVPTSSTPNVSMPDVEKDVPTSSGPNDEVLSSPSKERSTEEDDQAAEETPAPRAPEPAPGDLIDLEEVESDEEPIANRLAPGIAERLQSRKGKTPIKRSGRIKTMAQKKSTPVTPATSRRSK

SEQ ID NO: 140598 - protein, 96 aa, Glycine max
  Coding DNA Sequence Number=SeqID_48913
MKETTKEESFVNPRLGLGAHEKRKVSAKEIKAQQRGDGHFKCLKELNECLQIDSRSIIYPPSTLDFVLGLPKTSNGRDSIFVVVDRFSKNVSFYSM

SEQ ID NO: 140599 - protein, 209 aa, Glycine max
  Coding DNA Sequence Number=SeqID_48914
MVSRGGGERDECLFHLGESHDIETCPAVEELLQRFMDWGQLEVSIGGREEPQICLQSEEKKVPLTPKALVICFTRKGTGSTPIYPWAAPKPTPFAYQSNKAIPWKYIPPASSERVAIEVDSLSAKVTNITGLSGVTRSGRVFVSPHPAELPSKGKAPMVQEPTDIATPSKEVDPPVARGAEKKEGLQGKTVTLEEAHEFLRLIQQSEFK

SEQ ID NO: 140600 - protein, 78 aa, Glycine max
  Coding DNA Sequence Number=SeqID_48915
MPLTVVATLPLSRASEARLTGASSKGGKCAESPPTFICGKCRKNRRKPVMKNIPDSGVVFTFEEGTNTSHVCPKGQQP

SEQ ID NO: 140601 - protein, 190 aa, Glycine max
  Coding DNA Sequence Number=SeqID_48916
MVIDAEVWKAIAGTNMSGVHKFEESADGYNKMQAYRGMLLDQTRILRNKLGVSGLTAEDKMSVYIITYILAPRSNNHAQVIDGDLQIIYGLKSDIMLKSLRLVDYEFPYAVLASRFIDYFNINFSNEIVDFTKASNEIIERHLKKLGMTYVDHEWIMAGEQPSTANDNQMEEEAQQEPTQQRNPFESLMI

SEQ ID NO: 140602 - protein, 122 aa, Glycine max
  Coding DNA Sequence Number=SeqID_48917
  Pfam annotation: Domain name=zf-CCHC; Domain location=10-27; Score =30.0; E_value=8.9e-06; Accession=PF00098.14; Description=Zinc knuckle
MENPKKKSKITCYNCGKQGHISKYCRLKKKLRNLNLEPAIEEQINNLLIETSEEETETSSSVLSDEDLNLIQQDDQLSSTDDDDGQINTLTREQDLLFEAINSIPDPQEKKVFLEKLKKTLE

SEQ ID NO: 140603 - protein, 44 aa, Glycine max
  Coding DNA Sequence Number=SeqID_48918
MASPSSFGIFESEGEVLGEENGRHKYALSTGRCSLTRTPFRVDE

SEQ ID NO: 140604 - protein, 158 aa, Glycine max
  Coding DNA Sequence Number=SeqID_48919
  Subcellular localization annotation: CTP_CleavageSite=35; ConfidenceScore=5.17e-01
MAHEMVLRIESGCSGSRNGSCSTTFAARGFGTRPYAAGGGSGGEAGSRSTFAESTESTARSTDSTMSFFIDCFHQQNRRNQPALLKQLLTLDLLLEDMNIGIGKDTLVIDMDETDLPNALHHHYTIDRYIGSGNTGRTFPSGNNGREPLTCLTKGEEE

SEQ ID NO: 140605 - protein, 90 aa, Glycine max
  Coding DNA Sequence Number=SeqID_48920
MVREGDARAHECVFQGRKTRGVATNVYSRKTSEKLERCGLRTLIVKGSRVVFTHGKGGEMLRRWTINDLLGRSTKAVKLHVDFMLLKGPG

SEQ ID NO: 140606 - protein, 62 aa, Glycine max
  Coding DNA Sequence Number=SeqID_48921
MKIFQIPRECIYDLRKVDKSGALALTPLPLKPGNQTYVVLSKGRINAILLLGRWSFKAKLGP

SEQ ID NO: 140607 - protein, 50 aa, Glycine max
  Coding DNA Sequence Number=SeqID_48922
MTTIPHVRLSDAILPRKGPVTRAMSKRLKEDWARAAEEGSRVLMSLRVDF

SEQ ID NO: 140608 - protein, 85 aa, Glycine max
  Coding DNA Sequence Number=SeqID_48923
MTERAMRRALLLRHGERGMCILAYYVGHCEGVPVKCFMWQEKKAAPDSLCPHSALTRYRSVVDCGEREMAYPNGAEFDSAEKILT

SEQ ID NO: 140609 - protein, 30 aa, Glycine max
  Coding DNA Sequence Number=SeqID_48924
METQHNSASSKLLVKGLKNAREEATYTTNR

SEQ ID NO: 140610 - protein, 136 aa, Glycine max
  Coding DNA Sequence Number=SeqID_48925
AHSVFASCPYFRDIMGGTKRLLVITPKVVISLLMVSRGIIPFEKHIAAVGTTSNNMLSKRKTLDEGSLLSSKLETQHDHKFTSTPYVPMDPVESPTVATYPSAGGRCGAHGCVFHGRKMRGVTTNVYSRKTSKNPE

SEQ ID NO: 140611 - protein, 160 aa, Glycine max
  Coding DNA Sequence Number=SeqID_48926
MSVHVGQVIADATYLFACMVPTRHPLDPNKSNRALGFPALITGLYQSYGVSVTPSKVIRPPITRAFIEKYCTPRQAQGDAHQAAGAPPPPRQADPTGPLGMERYLQHLGSAPFVCPTPEQFGAEVAWPRDWPDAQAGEEPAGSPGEADESHMDEDMTDLL

SEQ ID NO: 140612 - protein, 78 aa, Glycine max
  Coding DNA Sequence Number=SeqID_48927
MKIPNRRVGESKKGKEGKFPIKEWEKAKKEGKQAPDQGSKENRRNVQKGNDLQSQVVTYLWFRIRDETLTCARLIHSE

SEQ ID NO: 140613 - protein, 73 aa, Glycine max
  Coding DNA Sequence Number=SeqID_48928
MAQVVEGKVEAQHPKFGQTQVVVGGSSMMDKRSSVTRDDLGRNNSRDGDGDNIESCKVCETLRWRWTVSLSYY

SEQ ID NO: 140614 - protein, 122 aa, Glycine max
  Coding DNA Sequence Number=SeqID_48929
MVQKGFQKIKQGKSPLARHQEPPINCLASSWANMHGIKATRIKPRVLAKQRQYGENIHQIFLMMMDGIRNSHERKLITFKLELSKLSMTVEENRKRFQVTKFMKIFYFQKQLPISWQNIIIH

SEQ ID NO: 140615 - protein, 128 aa, Glycine max
  Coding DNA Sequence Number=SeqID_48930
  Homolog annotation: Hit_ID=Q6WAY3; Match level="QueryCoverage=58%, HitCoverage=3%, E-value=5e-07, Identity=43%"; Hit description =Gag/pol polyprotein
MNFAATKPVEFTPIPVSYADLLPYLLDNSMVAITLAKVHQPPFLREYNSNTTCACHGEAPGRSIEHCRALKRKVQGLIDMGWLKFEENRVIFNFHRNWVQAIGLFAQATCAPEFGLPRPFNQRYSHAH

SEQ ID NO: 140616 - protein, 59 aa, Glycine max
  Coding DNA Sequence Number=SeqID_48931
MKNGGKALRNRPQKRLGSVTEAPREKREVVATHLAQASRVASTKRHRLLLEDLGRPKWV

SEQ ID NO: 140617 - protein, 119 aa, Glycine max
  Coding DNA Sequence Number=SeqID_48932
MPEPVVVPMLVVDNKPKVRPLVFLATRWDSTSSAVKQQVLVQWTGLAQKTPHGRTGGDEDKARNKDKEPLEGLGGPMARARTKKANEALQQVLTMLFEFRPKLQVEKLQIVNCTMFQEE

SEQ ID NO: 140618 - protein, 93 aa, Glycine max
  Coding DNA Sequence Number=SeqID_48933
  Homolog annotation: Hit_ID=A7PII8; Match level="QueryCoverage=100%, HitCoverage=24%, E-value=2e-28, Identity=68%"; Hit description =Chromosome chr13 scaffold_17, whole genome shotgun sequence
MDIDYAIRKDEPPTIKTSEPDAVDLYEKWKRSNRLSNMFIKTNISACIRGSVDQHDKVRDLLKAIDEQFTTSEKSLASTLSMQFSSIKLTGTR

SEQ ID NO: 140619 - protein, 55 aa, Glycine max
  Coding DNA Sequence Number=SeqID_48934
MTTTLKTWCVKLDGGLVGEGGDAVERLVVLIRWSIDDVMEVKGGDAGICYFYHIL

SEQ ID NO: 140620 - protein, 171 aa, Glycine max
  Coding DNA Sequence Number=SeqID_48935
MIVCLCMRLRSTGSITLGSRSFGDEGSRGDATPKSEGDESDEREQGRTLIRLLRGGCRRGWWGKVVEVSEVEDNEGFRDKVEVGEGFHNKGRGGCGKEVGGAVELEVDEDVEGEALVMWREEEVVGLGLGLGLVEEVEEGALVGLGIEENVRSCFRSEVRREGYESLRVAF

SEQ ID NO: 140621 - protein, 138 aa, Glycine max
  Coding DNA Sequence Number=SeqID_48936
MGSPTQESTTKVVLSVETKLRTMLLTCVEVEAAAVRVNENWGVDALENWQKSHYTMLNHLTEANTLNQLKGRIKPKLNHQEKKLNMGFLTRLNPRDCNYFKDKDKEEVAGQQDQQMTYNRVLDQIEPLGLLDKWPQIS

SEQ ID NO: 140622 - protein, 269 aa, Glycine max
  Coding DNA Sequence Number=SeqID_48937
MVYVVYVHGGAVTMMDISSGGNTVGNTCTWGHVTRFGTPLRVRLITMGRVVSVQQDDIDTCYLVFLSKSVVWTRLGYFLTNGTTLHLRVELKGYDPVLTVSICRRCPLAAAVKFSGKTRVCASFLAREGHAPPSRPRNLARPHSVTSSASHGYGPIVGTFQSLFSGIDSLIISNLAFPSPSPLGLRLLDQKWPLLIMRSPSLMSATIPLFLLLLVVYHCQPPSLAAQTSPFSPSSLSTELWHALVLFKAPSGFLALSCVINNNIVTKLE

SEQ ID NO: 140623 - protein, 123 aa, Glycine max
  Coding DNA Sequence Number=SeqID_48938
  Gene Ontology: Cellular component=mitochondrion
  Homolog annotation: Hit_ID=Q3E8C4; Match level="QueryCoverage=60%, HitCoverage=18%, E-value=6e-08, Identity=37%"; Hit description =Uncharacterized protein At5g52065.1
MSDFASTFNNYHLNIFHGCVSIQFGKFQEVKWRYLFKGNMARPRARFILWMACHERMATKDRLMRFGMLNDDTCCYCKEKETIQHIFFQCNVLSQFWKHTLKWLEVPHSPGVWNEELDWIIKK

SEQ ID NO: 140624 - protein, 185 aa, Glycine max
  Coding DNA Sequence Number=SeqID_48939
MEQEESEHLEDAKSMEHEGNPFQEEDGEINGTSKKRTRGPMQWMKIHSRNVQDREEVVLDDDGESIGPNASKEEQRRGSHLSKNKRLQDSTTSAEQAFKLLLGKEKFGRVGCFGRIVTPSHLKRKEEIFALKEHANEWNNWARRFEGLESLLICFMKQNNRNLDDEALDDMIRNVVANENSNAAM

SEQ ID NO: 140625 - protein, 117 aa, Glycine max
  Coding DNA Sequence Number=SeqID_48940
MRCNNLSGMMTVYHAPLSHLKEEAYHLLLLKVALHTTILLWTTNHLKNTKANIVLETHSETAGEEKILSTSLQRKVPLWQMNRKFFTDRDNSPSIMFNYVSKDEKKEIDKLNSSMLC

SEQ ID NO: 140626 - protein, 185 aa, Glycine max
  Coding DNA Sequence Number=SeqID_48941
  Gene Ontology: Mol. function=ARF GTPase activator activity; Cellular component=intracellular; Biological process=regulation of ARF GTPase activity
  Homolog annotation: Hit_ID=Q1RU67; Match level="QueryCoverage=87%, HitCoverage=100%, E-value=1e-74, Identity=87%"; Hit description=C2
  Pfam annotation: Domain name=C2; Domain location=31-110; Score=108.0; E_value=2.8e-29; Accession=PF00168.21; Description=C2 domain
MYVPTFTATLGELLFLVHKSLQGMVEFVGLIKVNVVKGTHLAIRDVMTSDPYVILSLGHQSVKTRVIKSNLNPVWNESLMLSIPENIPPLKVLVYDKDTFSTDDFMGEAEIDIQPLVIAAKAYEKLNINESMQLGKFVASKDNTLVRDGIISLDEGKIKQEISLRLQNIERGELELELECVPLTQ

SEQ ID NO: 140627 - protein, 56 aa, Glycine max
  Coding DNA Sequence Number=SeqID_48942
MEARTQKGECAYLNVDRAAQLEEEHARSNNHAAGSKNTQSPVEVVEARITHRRKKN

SEQ ID NO: 140628 - protein, 352 aa, Glycine max
  Coding DNA Sequence Number=SeqID_48943
  Gene Ontology: Mol. function=protein binding; Cellular component =cytoplasm; Biological process=postreplication repair
  Homolog annotation: Hit_ID=A4Q377; Match level="QueryCoverage=45%, HitCoverage=27%, E-value=6e-81, Identity=76%"; Hit description=WD40 -like
  Pfam annotation: Domain name=WD40; Domain location=190-228; Score =3.1; E_value=13; Accession=PF00400.23; Description=WD domain, G-beta repeat
  Pfam annotation: Domain name=WD40; Domain location=232-270; Score =25.1; E_value=0.00026; Accession=PF00400.23; Description=WD domain, G-beta repeat
  Pfam annotation: Domain name=WD40; Domain location=274-309; Score =9.6; E_value=2.1; Accession=PF00400.23; Description=WD domain, G -beta repeat
  Pfam module annotation: Pfam domain module=WD40::WD40::WD40; Domain location=190-228::232-270::274-309
MMYNDQQHQHQQHQYQQQQQQQQQPFHQPPGPEFHRGPPPPSHPPPMMRQGSASSTNLAPEFHHPGPGGPPPPHYDGSVSLPLPPIASHSFGKWNEGVDCELELWTGTLGLKGFGLIRECIAYDLSWMGEIEKCFREMFGSKVVTRLEDKCSSDEKLRMLSDSHGAKRIRKLTQRKAVDYTSTVVRYMQRDSRDRTVLQPTPAAAIDWTPTGRRLITGSQTGEFTLWNGQSFNFEMILQAHDQAIRSMVWSHNDNWMVSGDDGGAIKYWQNNMNNVKANKSAHKESVRDLRTDLKFCSCSDDTTVKVWDFARCQEECSLSGAAGIEEDINVPKKEGWRGGCENHAKGGDGEW

SEQ ID NO: 140629 - protein, 104 aa, Glycine max
  Coding DNA Sequence Number=SeqID_48944
MALDTIFDKLSENGRENEKDKADIIAQKKKLNELDTTEIMIRTRDLGRALGMVIERALWREVSCDADDAPQQQRPTASARRQQEVALITKDVHDMDHANDEVHE

SEQ ID NO: 140630 - protein, 64 aa, Glycine max
  Coding DNA Sequence Number=SeqID_48945
MNPGRKLNEALLKKRFNHHAAVADDADQKPHTCSSMHDAVMDLLHDICFQVSKMQAGSQISNRC

SEQ ID NO: 140631 - protein, 237 aa, Glycine max
  Coding DNA Sequence Number=SeqID_48946
  Gene Ontology: Mol. function=protein serine/threonine kinase activity; Cellular component=cyclin-dependent protein kinase holoenzyme complex; Biological process=protein amino acid phosphorylation
  Homolog annotation: Hit_ID=Q8LG64; Match level="QueryCoverage=26%, HitCoverage=20%, E-value=3e-16, Identity=68%"; Hit description =Cyclin-dependent kinase B2-2
MVGETVVYGRHNNKGINFNWLISKIYLLGMGETLLSQHLYKGPRIEGEFDFKAWACVSYEFDKAPEVLLGATCYSEGVYMWSIGCIFAKLVTKQTLFKGDSNLQLLESIFRILGPPNEDELPSESFKYCKLVVKVDDTFLIGKYHATLLTSIAQDENQNMFPLAFAVVKELSLAHQWAKRASTAKRSFNALSATKESGRASISRPRAKRKISALSAAVVFSQAKRTTGAKLKSNYLR

SEQ ID NO: 140632 - protein, 86 aa, Glycine max
  Coding DNA Sequence Number=SeqID_48947
  Subcellular localization annotation: CTP_CleavageSite=22; ConfidenceScore=5.45e-01
MQIKQRKLNSTSVPPAIADQTRSGASTNPYLPWMSSAPPLSPTGMTAMPHHARDVCTRDARPLAWRGVVVILVRESGSAKGIHGGH

SEQ ID NO: 140633 - protein, 163 aa, Glycine max
  Coding DNA Sequence Number=SeqID_48948
MEDQGIALGVATTAISHGEHLKFFEVILENVVGNQVSGPLNQNKSINFGALVVPMVESTRSKASSDRLEDAIAKLTSHHLSLTETVHTMTLKLDELIQKLAQPEASSPSPSASNSTPPMPTSTPHSLRLDVPRFDGTEPLGWIFKINQFFDYHDVILPPKDIG

SEQ ID NO: 140634 - protein, 472 aa, Glycine max
  Coding DNA Sequence Number=SeqID_48949
  Subcellular localization annotation: CTP_CleavageSite=53; ConfidenceScore=5.20e-01
MWCPFYGKIAPIPLPEASVSTVKGTSKSRRDNTGAVRCNNGSIATEKMTAEIRQAQEASNGPYGLRHRPNELAVYKDLKHSCQVGQMPFKNTVYEDVVEEDDNKAVEVQNEVVSECGGHVVWTAARLGVHERGCGIGLKGFKLVMEVGGWHSLPASGQYGGAGVSHDRSKGLEPLHTQNHIGTTQGQDMKVHHKLNALDSNGDCFTKVITMKLLTIPDHDAKRSSGASSEAQFPHQWFLNKVVGVASINQDNQLGRDNVTQETQGLRCQMTREIVECDLGLRRVSGVGRFTGTSVGGFGGARSKGVAIVDKGRGGGVARGGGQTLVCLDFLANLQGQPRDKETQKERWRQADNLLRKIFKLRKVLGDCGSLGKLARAPEAMLSLSCSSVAWYDVRSIGACRPRIFFINGFLCFLEDEWQRNGERKRERRRHFKEKMSLEEAHHHRRPWIRAWRKKEMNEGRGREDHEILCSN

SEQ ID NO: 140635 - protein, 39 aa, Glycine max
  Coding DNA Sequence Number=SeqID_48950
MVMCVGRRRWGGESKQGVIDTGVVGRLHGGKEGEATQTI

SEQ ID NO: 140636 - protein, 369 aa, Glycine max
  Coding DNA Sequence Number=SeqID_48951
  Gene Ontology: Mol. function=calcium ion binding; Cellular component =mitochondrion; Biological process=embryonic development ending in seed dormancy
  Homolog annotation: Hit_ID=A7R460; Match level="QueryCoverage=68%, HitCoverage=92%, E-value=3e-67, Identity=36%"; Hit description =Chromosome undetermined scaffold_621, whole genome shotgun sequence
  Pfam annotation: Domain name=PPR; Domain location=101-135; Score=6.3; E_value=1.4; Accession=PF01535.11; Description=PPR repeat
  Pfam annotation: Domain name=PPR; Domain location=136-170; Score =31.6; E_value=2.9e-06; Accession=PF01535.11; Description=PPR repeat
  Pfam annotation: Domain name=PPR; Domain location=171-205; Score =32.0; E_value=2.2e-06; Accession=PF01535.11; Description=PPR repeat
  Pfam annotation: Domain name=PPR; Domain location=206-240; Score =16.1; E_value=0.096; Accession=PF01535.11; Description=PPR repeat
  Pfam annotation: Domain name=PPR; Domain location=244-278; Score =22.1; E_value=0.002; Accession=PF01535.11; Description=PPR repeat
  Pfam annotation: Domain name=PPR; Domain location=279-312; Score =17.7; E_value=0.043; Accession=PF01535.11; Description=PPR repeat
  Pfam module annotation: Pfam domain module=PPR::PPR::PPR::PPR::PPR::PP R; Domain location=101-135::136-170::171-205::206-240::244-278::279 -312
MDMFGCDSKNQYMIFILIDEYNKKIFREVDSATKKKCGVNAEDCLSNDDSFGADGNGRHAVFNALDTLLKDSLERLKMMSENLCLVKTGLTIGYACESKYAEDTATIRRLCLDGKLEAAVWLQGKMVQKGVVPDVFTHSHIVNGLCKIGLPDKADLVVREMLEFGPCPNCATYNTLIKGYCAVNGVDRALYLFSTMAYAGILPNRVTCSILVCALCEKGLLMEAKSMLVEILKDDDEKGIPDLVTSSIFMDSYFKNGAIIQALNLWNQMLQNCTKVDVVAYNVLINGFCKSQLMNLAYGYACEMFKKDKVQEAVQVDTALEKVLDKVGADPNSKSGYTRAGHVGEWRREIHESWNEREKWLNGGGGGSN

SEQ ID NO: 140637 - protein, 225 aa, Glycine max
  Coding DNA Sequence Number=SeqID_48952
MEDNVLLDKEDIVAEEEVGEEEARPCRCGGKTLVVLCEVKSFSSNVCEVNVIFTWLKVLPNSLVECVPRVDLGFLCSCIPAQLKGSPRVNLGFNEPWTGNVFALSFDKPVELHRGLPWTNPEFCEPVKLTNGGPWRTCQAITYMSLVEWYILEMWCRALAYMSLVEWHTLETNDTYWRRGGMLLHVSLMEWHVLETWWREPGGLTKGKPWVLQALWRNNQKRVGP

SEQ ID NO: 140638 - protein, 260 aa, Glycine max
  Coding DNA Sequence Number=SeqID_48953
  Homolog annotation: Hit_ID=A5AE14; Match level="QueryCoverage=41%, HitCoverage=9%, E-value=1e-14, Identity=36%"; Hit description =Putative uncharacterized protein
MLKELEVLFVNIMRRENCFLMRIMKLVKYRLKTQVEKDEGPSGEGQSPRVEKDEGPSNPCGVYPDLSSFTGSGVYPDLSSFTGSGVYPDLSSFIGSGVYPDLSSFTESGVIQISVTCIKRSAPAQCDRLAIAIVTEERKKVVVDEVIRGKVGQQGNTYGARGHGAVSKANATQASTLELEPNIMITDADKSTVSGLNGEQWQTLVNLLNNFKIGPAEKLTSMRNFVQWIIDISVSCHMKGKIKCLTDVRTVLECLIGILD

SEQ ID NO: 140639 - protein, 174 aa, Glycine max
  Coding DNA Sequence Number=SeqID_48954
  Gene Ontology: Mol. function=DNA-directed RNA polymerase activity; Biological process=transcription
  Homolog annotation: Hit_ID=A5BGS4; Match level="QueryCoverage=44%, HitCoverage=7%, E-value=6e-32, Identity=83%"; Hit description =Putative uncharacterized protein
MVVCLKDSSQVFDHSLQALEYLPLANIGTIRNPIGFQRKNKVVNRGPVLHSNANASQSRTLQYTNTWVRNPYKSSNGELALDIILEKEAVKQSGDAWRVVLDACLPVLHLIDTRRSIPYAIKQIQELLGISCTFDQAIQNLREGKNKFFILNIMFYILGTSKTNILAELELHAL

SEQ ID NO: 140640 - protein, 162 aa, Glycine max
  Coding DNA Sequence Number=SeqID_48955
MRTNLTPPNSDLKKKGAWVSQLHGNHAPRWDDCGDDGEEVLERPQRLELGANPAYGAVENNTAPQHFTAAEKKRRKQGIKARTEILKGCAAVREAVATVVEGTGGEANLGKVDGGELEEPTGLAGVAVYDNEGECGEGRDLWKSEKRRRRGGRRGRGKRGFF

SEQ ID NO: 140641 - protein, 72 aa, Glycine max
  Coding DNA Sequence Number=SeqID_48956
MVFQTTLFDIKQGNFKINTDINGRILNSYVGRLLNLTMFNKLYNACALVSSDMAKMKCIGEDLMLISGVKGE

SEQ ID NO: 140642 - protein, 229 aa, Glycine max
  Coding DNA Sequence Number=SeqID_48957
  Gene Ontology: Mol. function=hydrolase activity, acting on carbon -nitrogen (but not peptide) bonds
  Homolog annotation: Hit_ID=A7Q5F6; Match level="QueryCoverage=89%, HitCoverage=35%, E-value=9e-64, Identity=59%"; Hit description =Chromosome undetermined scaffold_53, whole genome shotgun sequence
MDFVVLLHIFVFSPILFCITFLSLLLPNPTYFWAWKSQLSQPVADLVLRNGVIYTSDDSLPFADSMAVANGRVLRVGNRSFFQELEGYGTQVLDLGGKVVVPGFLDSHVHFIDGGLQMMQVKLRGVNKKEEFIRRIKDAAQSTKQGSWILGGGWNNDLWGGDLPAASWIDDVTPNNPVWLSRVDGHTGLVNSVALVLAGITNLTDDPRGGTILRTANGVFLTWYQTHYD

SEQ ID NO: 140643 - protein, 168 aa, Glycine max
  Coding DNA Sequence Number=SeqID_48958
  Gene Ontology: Mol. function=structural constituent of ribosome; Cellular component=ribonucleoprotein complex; Biological process =translation
  Homolog annotation: Hit_ID=P49208; Match level="QueryCoverage=34%, HitCoverage=27%, E-value=5e-22, Identity=93%"; Hit description=50S ribosomal protein L1, chloroplast precursor
  Pfam annotation: Domain name=Enolase_N; Domain location=1-148; Score=- 2.3; E_value=0.087; Accession=PF03952.7; Description=Enolase, N -terminal domain
  Pfam annotation: Domain name=Ribosomal_L1; Domain location=15-143; Score=-102.3; E_value=0.0088; Accession=PF00687.12; Description =Ribosomal protein L1pL10e family
  Pfam module annotation: Pfam domain module=Enolase_N::Ribosomal_L1; Domain location=1-148::15-143
MTSSKRSLEIQQLRERKKEYDLKTAISLVKETAKTKFGETVEAHFRLNIDPKYNDQQLRATDICVIQICHHEQVRTTTGFEEDISVIQICHHEQVREEDICVIQICHHEQVKTTTGFEELGANAILAVSLAVSRAGATILKVPLYKVQDPHGIKYNGTIQGLKYIWRT

SEQ ID NO: 140644 - protein, 152 aa, Glycine max
  Coding DNA Sequence Number=SeqID_48959
MVFNRFVTGLGRGIDKERDARFTSDEIRELRVLVKQILCCVPTSEVDNVIVGGAKVDTNGAAEDEDGNEAVDNGDLDVVESLLDLPVIGKHVFVVALRVVGWQAHASAALTMEPNESPTPMISSGGVPKLSHPVRPELQRYPLVVLTKVVKV

SEQ ID NO: 140645 - protein, 306 aa, Glycine max
  Coding DNA Sequence Number=SeqID_48960
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9LJN4; Match level="QueryCoverage=66%, HitCoverage=21%, E-value=1e-55, Identity=58%"; Hit description=Beta -1,4-xylosidase
MIQRLMLSHPEVERIWWMDSDAFIADMVFELLMSKYDEHNLVLHVGVPVDDKNWPPIFPIIHDDIANEIPVGAWPRNSRGGSLGEKVEDETSAKADRLKVSSCCKHYTAYDLDNWKGFDRFHFDAKVLLYHYSNFGSVCCHIIGLVASDKARLGGLVPTSVNSCVVEGHVNGIPTCADPGLLKWIIRGQRGLERYIVSDCDSVEVYYDVIHYIATPEDAMALALKVAFNMNWGDFLKKYTANAVNLKKSRCSNCRLGLALVYNYIVLMRLGFFDDPKSLPFANLGTSDDSKHHKGSKCIPGSVLDG

SEQ ID NO: 140646 - protein, 396 aa, Glycine max
  Coding DNA Sequence Number=SeqID_48961
  Gene Ontology: Mol. function=methyltransferase activity; Biological process=metabolic process
  Homolog annotation: Hit_ID=Q9FY51; Match level="QueryCoverage=94%, HitCoverage=98%, E-value=1e-135, Identity=61%"; Hit description =Putative uncharacterized protein T6I14_30
MGRASLLLIVFLVLGSSFATYNVVTMIRHYGSSEGVAVDDGALFFDPITEMPDHVKNRKTSKAPFHVALTATDAPYNKWQCRVMYYWYKQQKKLPGSEMGGFTRILHSGNPDNLMNEIPTVVVDPLPAGLDRGYIVLNRPWAFVQWLEKTKIEEEYVLMAEPDHIFLRPLPNLAFGGHPAAFPFFYIRPDQNEKTIRKFYPEELGPVTNVDPIGNSPVIIRKDLIAKIAPTWMNISLKMKEDPETDKAFGWVLEIRGIGTDNLIHYANGFFLVEPRYAYAVASAVHGVRHILRKDFMLQPPWDLETNKKYILHYTYGCDYNMKGELTYGKIGEWRFDKRSHLRGPPPKNLPLPPPGVPESVIFPNDLLEARTFKMPVNFLVSLIYLIYFLHFHWRK

SEQ ID NO: 140647 - protein, 75 aa, Glycine max
  Coding DNA Sequence Number=SeqID_48962
MDFVGVDNNLDFIEVFLYRSSTIVRHWRTIYVELKIKFKASLEEMRKLVKALNEKNSLIKKIEIIDGLHQKIVDH

SEQ ID NO: 140648 - protein, 325 aa, Glycine max
  Coding DNA Sequence Number=SeqID_48963
  Gene Ontology: Mol. function=protein dimerization activity; Cellular component=nucleus; Biological process=regulation of transcription, DNA-dependent
  Homolog annotation: Hit_ID=A7Q5E4; Match level="QueryCoverage=92%, HitCoverage=95%, E-value=1e-83, Identity=57%"; Hit description =Chromosome undetermined scaffold_53, whole genome shotgun sequence
  Pfam annotation: Domain name=Arm; Domain location=168-209; Score =19.7; E_value=0.011; Accession=PF00514.14; Description=Armadillobeta- catenin-like repeat
  Pfam annotation: Domain name=Arm; Domain location=210-253; Score =18.9; E_value=0.019; Accession=PF00514.14; Description=Armadillobeta- catenin-like repeat
  Pfam annotation: Domain name=Arm; Domain location=37-77; Score=23.4; E_value=0.00084; Accession=PF00514.14; Description=Armadillobeta -catenin-like repeat
  Pfam module annotation: Pfam domain module=Arm::Arm::Arm; Domain location=168-209::210-253::37-77
METNPRTIRSLVSKLSSVSEAARVDALSQLRLMSKQSPETRPLIADAGAIPFVAETLYCSSHPPQENAAATLLNLSITQKEPLMSTRGVLDAIAHVISHHNTTSSPAAVQSAAATIHSLLSSVDSYRPVVGSKREIVYSLIDILRCHVSSPPRTIKDSLKALFAIALHPLNRSTMINLGAVPALFSLVAKDGRVGIVEDATAVIAQVAGCEDAAEAFFKASGVGVLADLLDLATAASMRTKENAVSALLNLVRCGGDKVAADVRDAVAFGALDGIADVRDGGSGKGKNKAAELLKVLLGENNGDVVALNSDTCSSFGSSRNHDSE

SEQ ID NO: 140649 - protein, 200 aa, Glycine max
  Coding DNA Sequence Number=SeqID_48964
  Gene Ontology: Mol. function=aspartic-type endopeptidase activity; Biological process=DNA integration
  Homolog annotation: Hit_ID=Q69FA4; Match level="QueryCoverage=68%, HitCoverage=12%, E-value=3e-30, Identity=47%"; Hit description=Gag -pol polyprotein
MAEAAKPINNVDTSNPTPPTTTFAKSLPNILKIEEHVHTLLDMHGVVFVQANKEKTSSYKSMNYKLLESLKTKNISLPDEFIYELLIERLSKSLIDYKQQLKHRHKEMSLSDLITHFIIEDTNRKESVAARTKAMPATENMIKDKLFHKGDVNKNDHNNKKKYRVMRNDNPPKLRANLVEGDDIIVAVISQVNVVTNVKK

SEQ ID NO: 140650 - protein, 253 aa, Glycine max
  Coding DNA Sequence Number=SeqID_48965
RQWTQLAGPMAKYDPEIVMEFYANAWPTEEGVRDKRSWVWGQWIPFDEDTINQFLGLLLVLEEGQRCKFSQRRSQASGFDEEAISQQLCVPGDHTSQTPNGPRKVQQSTGVSGLDHGPLPVLWGFGKAVRSGTTVARGGPMHGHMQHVTDQQAANHRGQMQLNESFYQYTLHQQRQDPSPYPWPTPKQFGAMVAWPGYKPNFQARAGPTGTPKDEDGTQEDDVMADGASTRLFKENKGGYITCGSLLVKGFLQ

SEQ ID NO: 140651 - protein, 52 aa, Glycine max
  Coding DNA Sequence Number=SeqID_48966
MASNVQANSSTLLHMPPLLPLITLALALSSGKNAMSNATELKRRAVNDCGTV

SEQ ID NO: 140652 - protein, 62 aa, Glycine max
  Coding DNA Sequence Number=SeqID_48967
  Subcellular localization annotation: CTP_CleavageSite=38; ConfidenceScore=5.13e-01
MPISPCGSISWSVPSRHRDRTHRTPSGPGKVQQGPGVSSSDYGPLSVLRSARHPQQGHQAPY

SEQ ID NO: 140653 - protein, 32 aa, Glycine max
  Coding DNA Sequence Number=SeqID_48968
MCRDAGAFKLLCILLLRVEKSHRFGTRMGTGL

SEQ ID NO: 140654 - protein, 172 aa, Glycine max
  Coding DNA Sequence Number=SeqID_48969
MGSSQKPSLKKRFYQVKIKSLEVTSLRELGQLMGQLQQQAFRKAYGVLFPNMEGLVDLAAVDAFLAFHHGKESPVVAIFSMYDTFDRGCEKSSARIVCCALALYVWLVSHLFLQQGRPVYPLQRHRSRVEQGKANWDQLLASMEGRLLICSLARRKEESGFYLHAKDVQMFP

SEQ ID NO: 140655 - protein, 175 aa, Glycine max
  Coding DNA Sequence Number=SeqID_48970
  Homolog annotation: Hit_ID=UPI00006A2D9E; Match level="QueryCoverage =99%, HitCoverage=82%, E-value=3e-09, Identity=14%"; Hit description =UPI00006A2D9E related cluster
GIHSLAFRGLHVLTFRGLLALTIRGLLALTIRGLHVLTFRGLHVLAFIGLHALAFRGLHVHAFRGLHVLAFRGLHVLTFRGLLALTIRGLHVLMFRGLHVLAFIGLHALALRGLHVHAFRGLRLLAFRGLHVLPIRELHVLAIRELHALAYRGLHVLAFIGLHTLALKGLHVLAF

SEQ ID NO: 140656 - protein, 108 aa, Glycine max
  Coding DNA Sequence Number=SeqID_48971
MGAKYLKVVKRESHPNHGCESEEAKGEESSKEIYPQEEGQTLMVKEECKEVSVSSKRLAKKERHFEINTNIKKISPLRQPPHFLLCKKTLVSIATPLRLEFIPQVKEL

SEQ ID NO: 140657 - protein, 127 aa, Glycine max
  Coding DNA Sequence Number=SeqID_48972
MTRGNPYDLQPFDPEIDRTFHRLVRHHFIPFDHSEHSITGESVHSVIGDFEHPDLEHYNFEHSDSEHSDFAHSENMAQPPPRERALREMAAPDFTYESLCIQYPDEDVPYVLKTGLIHLLPKFHGLA

SEQ ID NO: 140658 - protein, 42 aa, Glycine max
  Coding DNA Sequence Number=SeqID_48973
MVTPMSTAYYLDKDEIGQSIDLKKYRDINQIPKNLTLVSLKE

SEQ ID NO: 140659 - protein, 67 aa, Glycine max
  Coding DNA Sequence Number=SeqID_48974
DSFEEQPHRDPSSPMDVRMFSPLLLDVQSTLDVSVLLEPVSPSSNTLDQLHGRPAALPPCLPKNCNS

SEQ ID NO: 140660 - protein, 249 aa, Glycine max
  Coding DNA Sequence Number=SeqID_48975
  Gene Ontology: Mol. function=oxidoreductase activity; Cellular component=integral to membrane; Biological process=ubiquinone biosynthetic process
  Homolog annotation: Hit_ID=A6TGL5; Match level="QueryCoverage=98%, HitCoverage=45%, E-value=1e-134, Identity=94%"; Hit description =Probable ubiquinone biosynthesis protein ubiB
RNHPEDPQYIGIDCGIVGSLNKEDKRYLAENFIAFFNRDYRKVAELHVDSGWVPADTNVEEFEFAIRTVCEPIFEKPLAEISFGHVLLNLFNTARRFNMEVQPQLVLLQKTLLYVEGVGRQLYPQLDLWKTAKPFLESWIKDQVGIPALVRAFKEKAPFWIERMPEIPELVYQSLQQSKQLQTSVDTIVRDFQVRHVRQGQSRYLFGIGAVLLLSGTLLFIHRPEWGMMPGWLMAGGVVTWLIGWRKTR

SEQ ID NO: 140661 - protein, 309 aa, Glycine max
  Coding DNA Sequence Number=SeqID_48976
  Gene Ontology: Mol. function=acetyl-CoA C-acyltransferase activity; Cellular component=cytoplasm; Biological process=fatty acid metabolic process
  Homolog annotation: Hit_ID=A8ACZ3; Match level="QueryCoverage=100%, HitCoverage=79%, E-value=1e-155, Identity=89%"; Hit description=3 -ketoacyl-CoA thiolase
  Pfam annotation: Domain name=Thiolase_C; Domain location=261-309; Score=-13.9; E_value=3.2e-05; Accession=PF02803.9; Description =Thiolase, C-terminal domain
  Pfam annotation: Domain name=Thiolase_N; Domain location=1-254; Score= 488.5; E_value=8e-144; Accession=PF00108.14; Description=Thiolase, N -terminal domain
  Pfam module annotation: Pfam domain module=Thiolase_C::Thiolase_N; Domain location=261-309::1-254
MEQVVIVDAIRTPMGRSKGGAFRNVRAEDLSAHLMRSLLSRNPSLEASAIDDIYWGCVQQTLEQGFNIARNAALLAEIPHSVPATTVNRLCGSSMQALHDAARMIMTGDASVCLIGGVEHMGHVPMSHGVDFHPGLSRNVAKAAGMMGLTAEMLARLHGISREMQDQFAARSHARAWAATQSGAFKAEIIPTGGHDADGVLKSFNYDEVIRPETTVEALAALRPAFDPVTGTVTAGTSSALSDGAAAMLLMSESRARELGLKPRARVRSMAVVGCDPSIMGYGPVPASKMALKKAGLSTSDIDVFEMNE

SEQ ID NO: 140662 - protein, 46 aa, Glycine max
  Coding DNA Sequence Number=SeqID_48977
SVASAANVSAQVNNIPMLNETNFKVWKEAVEIILGWMDLDLTLRAE

SEQ ID NO: 140663 - protein, 183 aa, Glycine max
  Coding DNA Sequence Number=SeqID_48978
  Gene Ontology: Mol. function=protein dimerization activity
  Homolog annotation: Hit_ID=A7PEU5; Match level="QueryCoverage=39%, HitCoverage=31%, E-value=3e-23, Identity=65%"; Hit description =Chromosome chr11 scaffold_13, whole genome shotgun sequence
MDKAKEIIIKSFNNNESNASGCERNWSVFEQIHSKKRNRLEHKRLHDLVFVKYNQQLRQRYNARDEINPISLNDIDVCNEWPVGEMDQDDDNDVGNDLQKTTSVVAAQTSKKHAMVVGSSSRKQKEVQENDEDLDFEENINLESEEEDIMVNFEASDGEEGEGDAPLPYDNNEDDYVGIGEDD

SEQ ID NO: 140664 - protein, 73 aa, Glycine max
  Coding DNA Sequence Number=SeqID_48979
  Subcellular localization annotation: CTP_CleavageSite=15; ConfidenceScore=5.20e-01
MKNGGKSSRNRSRKRLGSVTEAPRLGFSSRNQFFSLISREKREVVVAQLAQASWVASTRRHRLLLEHPGRSKW

SEQ ID NO: 140665 - protein, 79 aa, Glycine max
  Coding DNA Sequence Number=SeqID_48980
MASKRCWCTALLKRWLSYSGAEPVPSAALSFLDLFEASFLGDIPAKANIWKVFSMLPRCKVFLMGQPNLNSNNNLSNMS

SEQ ID NO: 140666 - protein, 45 aa, Glycine max
  Coding DNA Sequence Number=SeqID_48981
MGDQEETQEQMKVDMSALKEQMASMMEAMLGMRLLMENNVVIAAT

SEQ ID NO: 140667 - protein, 127 aa, Glycine max
  Coding DNA Sequence Number=SeqID_48982
  Gene Ontology: Mol. function=helicase activity; Biological process =protein amino acid phosphorylation
  Homolog annotation: Hit_ID=Q9C925; Match level="QueryCoverage=99%, HitCoverage=11%, E-value=2e-19, Identity=35%"; Hit description =Putative uncharacterized protein F14G24.23
  Pfam annotation: Domain name=DUF889; Domain location=1-126; Score= -29.1; E_value=1.7e-09; Accession=PF05970.5; Description=Eukaryotic protein of unknown function (DUF889)
MRLQGNAQSIDDQETIKFAKWILDIGDGVIGNQNDGYATIEIPEYLLITEYNDPIDAIVKSRFPDLYQHQSNPEFFKSRAILASTNETVEEVNDYILSLIPAEIISSKNLGDNVYIPRMSMSPSQSP

SEQ ID NO: 140668 - protein, 73 aa, Glycine max
  Coding DNA Sequence Number=SeqID_48983
KAVASGGSNPARLGELGGNHLPYFAINRGGNEEGRAEALPKRFRNVFREESRKAFNRSSTFFIRSSSFFDLQR

SEQ ID NO: 140669 - protein, 261 aa, Glycine max
  Coding DNA Sequence Number=SeqID_48984
MVLEEGQECEYGQRRNRSDGFDEEAIAQLLCVPGQDFARTAAGRRVRIMRTNMTTLTQIWMTLLLSNILPTDHNSDLPMPKCQLVYAILTRMSIHVAQLIADAIYIFAGMAPTRHPLDPDKSNRALGFPALITGLCQSFGVPVAPTKRQAQGDAPQAAGAPPPPHQAGQAGSFDIEQYLRHLVRQQAANHRAHVRTHDCLYQMSLSMQSQGFASFSCPTPDQFRAEACGDWPPEAPGDGEEAHEDEEMADLLDFLGGSGAT

SEQ ID NO: 140670 - protein, 279 aa, Glycine max
  Coding DNA Sequence Number=SeqID_48985
  Gene Ontology: Cellular component=cell surface
  Homolog annotation: Hit_ID=A8XZZ5; Match level="QueryCoverage=72%, HitCoverage=56%, E-value=1e-19, Identity=23%"; Hit description =Putative uncharacterized protein
  Subcellular localization annotation: CTP_CleavageSite=30; ConfidenceScore=5.36e-01
RAARTHHQRTSRPHLQRATPPHLQRTTRPRLQKAARPHLQRTACPHFQRTTRPHLQRTASPHFQRTTRPHLQRTACPHFQRTTRPHLQRASRPRLQRVACPHHQRMSRPHLQRATPLHLQRMSRPHLQRATPPHLQRTTRPRQQRAARPHLQRITSPHFQRTTRPHLQRTACPHFQRTTRPHLQRTACPHFQRTTCPHLQRDTRPRLRRLHVLILRGLHVLAVRGLHALTFRGLHVLIFRGLHVLTFRGLHALGSEDYMSSSSEDYMSSPSEGYTPSPS

SEQ ID NO: 140671 - protein, 43 aa, Glycine max
  Coding DNA Sequence Number=SeqID_48986
MEERRPKKKVLEIAYPLSVNLALSAISSHAKSSLLELSAKTPD

SEQ ID NO: 140672 - protein, 170 aa, Glycine max
  Coding DNA Sequence Number=SeqID_48987
  Homolog annotation: Hit_ID=A5AWV0; Match level="QueryCoverage=51%, HitCoverage=5%, E-value=2e-08, Identity=32%"; Hit description =Putative uncharacterized protein
MTLTIQELFLRPYQIRWDATVFGVVNPDFPLYIKHEDLSEIAHGGQCLSISVLQLWILFHCSRHWQMVVILPKEHLVVWFCSLHNRPGNSFKGIINSAIKGLDDAPQPKSMASARWIVVKCNRQKGSTECGYYVMHWMSTIILGTIRNNWEAYFNDPRPLEPERLKALQI

SEQ ID NO: 140673 - protein, 163 aa, Glycine max
  Coding DNA Sequence Number=SeqID_48988
  Gene Ontology: Mol. function=nucleic acid binding; Biological process= DNA integration
  Homolog annotation: Hit_ID=A5C3T2; Match level="QueryCoverage=93%, HitCoverage=17%, E-value=2e-35, Identity=49%"; Hit description =Putative uncharacterized protein
  Pfam annotation: Domain name=zf-CCHC; Domain location=127-144; Score =22.9; E_value=0.00053; Accession=PF00098.14; Description=Zinc knuckle
MDIDYAISKDEPPAITETSEPDAIDLYEKWERSNRLSVMFIKTNISTSIRGSVDQHDKVRDMLKAIDEQFTTSEKSLASTLIMQFSSIKLTGTREEERLIMEEGEKEEAVGTNKGKIPTQPTIKKESKCFFYKKKGHMKKDCPKFKSWFEKKGYGKPKEASGK

SEQ ID NO: 140674 - protein, 74 aa, Glycine max
  Coding DNA Sequence Number=SeqID_48989
MEKDEDRSGKGRSPQVKRRMKAQVEKDEGPSNPCGVYPDLSSFTGSGIIQISAACIKRSAPSPDYIIWYQSFSS

SEQ ID NO: 140675 - protein, 86 aa, Glycine max
  Coding DNA Sequence Number=SeqID_48990
MKLVLFKCDWFDNTPYIGTRVDKKYEIVDVRRITNNIVSETEQEAPYQDDELVGLQEVLEVDPDVINESLADVDGGGEEIDADLLK

SEQ ID NO: 140676 - protein, 126 aa, Glycine max
  Coding DNA Sequence Number=SeqID_48991
MAELRDVNKATTKALERETKRARREEYGRNKFEGLYGADELKVCLRSKRSLSQHLCETETNMLAIISRYQEELNLATTHEQKVADEYARVYMEKEARGRVIDSLHQKATMWMDQFALTLNGSQELP

SEQ ID NO: 140677 - protein, 196 aa, Glycine max
  Coding DNA Sequence Number=SeqID_48992
MVIAQSHFYDLTQLSSKGVPFEGTLNDDWKFDFSVHDARRLVCTNQADMTERLLPSSLAFESHILHYLIVQILLPRSSNLAQVSEEDLIVMWAFHKGRQIDWAHLVQYRMHKALRLNAPLPCPHLVTLFHKHYNIPLDYEPYVSIKRSFLIGATVIASFACGSNKGGYIPYGSLLVKDFTRLKRNLKDCRSLGDWK

SEQ ID NO: 140678 - protein, 223 aa, Glycine max
  Coding DNA Sequence Number=SeqID_48993
  Homolog annotation: Hit_ID=Q6WAY6; Match level="QueryCoverage=89%, HitCoverage=34%, E-value=3e-08, Identity=26%"; Hit description =Putative uncharacterized protein
MGTRGCISYNPVLAIRQLGYLMRGAPLEEELAPKVPKAWEVVQRKDKELRGSNNGPLGGYRRWLKAHVQGLYWLPSLRTVKREEVEAPEEDEEVQALRVELEQAQAVKERFKLAALKIRKENAELRDINIATTKALEQETKRARREEHSRNKFRGALWGSNCELKLRREKKDQSQVHSMILKEELAACSRSKKSFGPTLRSHRAKHASYNRAVQRRVKPVFDP

SEQ ID NO: 140679 - protein, 118 aa, Glycine max
  Coding DNA Sequence Number=SeqID_48994
MGLGKDKAGITSLIKTQGNRGKYGLGYKPTQADMKRSIAGRKNSGQSSRWRQESEGSPPCHISRSFISAGLGDEGQVVAICEDNVPSTLDLVRPCPPDFQLGNWRVEERPGIYATSIM

SEQ ID NO: 140680 - protein, 96 aa, Glycine max
  Coding DNA Sequence Number=SeqID_48995
EKSCDLVGVLAEFSAFALFCLAVIAVLFDRCFSWMLWKLGRIDGDPVLRETRIWATWEYVSSVGGGQQGMETLGTLGGVLLPKTKLDQSRPNPGIV

SEQ ID NO: 140681 - protein, 102 aa, Glycine max
  Coding DNA Sequence Number=SeqID_48996
LKHPSKLLIQGSSWWRSSFFHGLFPSGWRLLSPLLLCLPLHLHGGKSPLKDLIEAQRSILHRSPTSKLPSSGNQSTRASRNWKEDWCHPLKNLSQEERGQPP

SEQ ID NO: 140682 - protein, 105 aa, Glycine max
  Coding DNA Sequence Number=SeqID_48997
  Homolog annotation: Hit_ID=A0ST23; Match level="QueryCoverage=47%, HitCoverage=100%, E-value=9e-12, Identity=72%"; Hit description =Putative reverse transcriptase
MEISWCDSIEEIVSSAEEGDESDENEIIFQQLNCLKLDGLGKLRRFYKGSLSFPSLEEFTVMGCGYRARIRNHVGKPVVPAALMNRPTRGERRFAYWALFRFLAH

SEQ ID NO: 140683 - protein, 133 aa, Glycine max
  Coding DNA Sequence Number=SeqID_48998
MRRYLTVIHTFCQLEAREPIDTQRLTSSSALLSSRDSKSDDMQRYLMVIRTFCQLEPSEPIDTQRLTSSSALLSSRDGKSDDMRRYLMASEPVDMLTLTSSSAPFPEISASFGRDCEKVSFAILQTQGSSSMQ

SEQ ID NO: 140684 - protein, 500 aa, Glycine max
  Coding DNA Sequence Number=SeqID_48999
  Gene Ontology: Mol. function=transferase activity, transferring glycosyl groups; Cellular component=membrane; Biological process=UDP- glucose metabolic process
  Homolog annotation: Hit_ID=A8G819; Match level="QueryCoverage=86%, HitCoverage=56%, E-value=1e-159, Identity=64%"; Hit description =Cellulose synthase subunit B precursor
  Pfam annotation: Domain name=BcsB; Domain location=1-460; Score =141.9; E_value=1.8e-39; Accession=PF03170.4; Description=Bacterial cellulose synthase subunit
MVFSGQPDVQQQRAAGLLASWFGSQAQWRGQSFPVLYNQLPEGQHAVVFATNDRRPDFLQTLPPVDKPTVEMVSQPDNPYQKMLLILGRDDNDLITAVEGIAQGELLLRGERATIDSVKLLAPRQPYDAPNWVRTDRRTTFGELTQYQNQLQADGLQPNPISLTLNLPPDLFLVRARGIDMDLIYRYTSPVQQDGSRLAVHLNNQFMQDYPLTSKDGAGQQLMRIPLMQGLQDNSRQLTIPALRLGVVNQLRFDFDYANTFIGGTADGRCETVPPVAHHAVIDDRSSIDFSGYRHYIEMPSLGAFASAGFPFSRFADLAQTLVLVPAKPESGEVSTLLDALGAIGAQTGYPALRVQMSDDWRNAKDHDADLLLIGSIPPDLQADTAINLLVDRTRSTLNMPSRPGSAPNVPLSASERTAESQTGISSRGPIGALHRPGVRRQQRARGRYLLCRASAVVGAVVESAGHPSGMAGRVCRAGGDPVRPDGLAPDAHGEPSSPG

SEQ ID NO: 140685 - protein, 45 aa, Glycine max
  Coding DNA Sequence Number=SeqID_49000
MDPAPFIIQEQQAEWEQQAEWEQQAEWVNAQRQILCPLSFRSSEA

SEQ ID NO: 140686 - protein, 105 aa, Glycine max
  Coding DNA Sequence Number=SeqID_49001
MRAGISDLYGFLEPQSIQRSRQSQFETKSYIKSWIQSSKRDVYLGAYLNGALKGLDDAPQHKSKVPARWIVVKRNRQKGSTECGYYVMHWMSTIILGSFRNNWEA

SEQ ID NO: 140687 - protein, 295 aa, Glycine max
  Coding DNA Sequence Number=SeqID_49002
  Pfam annotation: Domain name=Transposase_23; Domain location=165-235; Score=-7.1; E_value=0.0072; Accession=PF03017.5; Description =TNP1ENSPM transposase
AQTIQKQNTAPHVLSRGGYEYLEQKLLAEKTKKKLEEAAQSGIVDGVIDPSSPDSFEEQAPQGSFIPYGRQDVLTATIGHPEHPGRVRAAGAGVTIKQYFGSAPRTSLLPYEELQLLTQQIRDQLEESITEKGLALPPEPLVGPSDPRVSTKESYVDPLGNNPETGDSDRCGLYIEANPAHLVALGRVYEGSTVVHNTPLLPGQVKVGVEEVKDTDALVPVPTNQVSLVGQTIHTFLAWSTHLVKSLSQQVDVSPAKPLQKPDPEVDDPVYLMTLIIPELFLRPYQVTWDATMFE

SEQ ID NO: 140688 - protein, 84 aa, Glycine max
  Coding DNA Sequence Number=SeqID_49003
MNFPKNLIVEEDLLRIRDIGLKREPNKDLSGIILHNLECYQFRYFRSNRKKSNDWSGRVRVEKRIPHFFLSFKTVHETFISHGS

SEQ ID NO: 140689 - protein, 148 aa, Glycine max
  Coding DNA Sequence Number=SeqID_49004
MLAWGAPVIEDFCIYVPYVPVCTIVTEEWLTGIILGRWMLSSMLDPWGVLVAVGGIAHIAILILKVFANRLQNCTCVLPFSVVVRHNQHFIFLIWSACLFLNAQMCDQRLQREFFGLVSEKVFEILPARRQFVYDNSNLKLLIQCHTL

SEQ ID NO: 140690 - protein, 147 aa, Glycine max
  Coding DNA Sequence Number=SeqID_49005
  Homolog annotation: Hit_ID=A4WFI3; Match level="QueryCoverage=98%, HitCoverage=56%, E-value=1e-27, Identity=45%"; Hit description =Putative uncharacterized protein precursor
MSADTLCFDYAQDTFSSTFHVTAAQNNEVETLLTLAKTLRLRLATITPDASALKNLLPAVAPAQCVVWRDERQWLWAMRHQWGRRVAAEAENVAELSALLAVEPADIALFDSRRNPWETLQRCHAPLPECGADYTVALALAMSEVPA

SEQ ID NO: 140691 - protein, 111 aa, Glycine max
  Coding DNA Sequence Number=SeqID_49006
ITSRPHSCSREKERKPQEANINLPYFHWKDNVEAYLDWEITIEQQLKRKSTSKSYDSHSYPKKDQGQGILGAAPSKPKDDKGKTIEKQPPNTSMQEKTSSIKCFKCLGRRH

SEQ ID NO: 140692 - protein, 135 aa, Glycine max
  Coding DNA Sequence Number=SeqID_49007
MGKAEEVQEKMKADMKAMKEQMATMMEAMMSMRKIMEANAVAVAATRAVSKVNPMPPSDLNQMNHPTSDMAGKDLGSTGGPHDVQIQNEHAFPTYGLPLNYTPPNVAYTPNKNVNYSTHIPIESQQTQTDHAHVS

SEQ ID NO: 140693 - protein, 118 aa, Glycine max
  Coding DNA Sequence Number=SeqID_49008
RLPYERCLSEEIIAPFIARGFNEANAKTLQRIRKAWNRVERKDKELKGSSNGIIGGYRKWLKSRTQGITWLLKLKGLSGEEVEIPEESEEVQALKAELERMRVVKEKLKVAVTRVRKE

SEQ ID NO: 140694 - protein, 102 aa, Glycine max
  Coding DNA Sequence Number=SeqID_49009
  Homolog annotation: Hit_ID=A5B1P9; Match level="QueryCoverage=90%, HitCoverage=6%, E-value=5e-15, Identity=46%"; Hit description =Putative uncharacterized protein
MVSIRSDHGGKFDAKADEAIFLGYSLESKVVYRAFNRRTLCVEESIHVVCDETNSLIQENALEDEDIGLQDKNIALEDETKVKDLEQNKEITTTPPKDLPKE

SEQ ID NO: 140695 - protein, 67 aa, Glycine max
  Coding DNA Sequence Number=SeqID_49010
MACCWMNSVDIVATRQVVTFSGIRAGRTFRPGVMVGRNDRVIADALQALAQAIGNPNRGEASGAVEY

SEQ ID NO: 140696 - protein, 200 aa, Glycine max
  Coding DNA Sequence Number=SeqID_49011
MGMRGCINYNPALVIRQLGYPMREAPTEESLSPFLAWENPLRKDKELRGIRNGIIGGYHEWMKVRTGGLDWLAKLKIINEENFEAPEEDEEVRALKTKLGKARLAKEKFKLVATDVRKECAGLREENAAIARALERETKKARKEEHGRDKFRGALWGNNNELKLVGLGSSSSMDSFASWKMNGSGMEKGRERGDATSRRR

SEQ ID NO: 140697 - protein, 127 aa, Glycine max
  Coding DNA Sequence Number=SeqID_49012
MALVVGSPMISCCHGFTVGNWLCDSDLVNPTGIERVLTEKDLLADSYSDLEASILDEKEFLLLKVISTLLELSCLICSMVGAGQGIDGVALSMTHFSGRVTSSHFMVLRRETLAFVISVTNKVVSPF

SEQ ID NO: 140698 - protein, 42 aa, Glycine max
  Coding DNA Sequence Number=SeqID_49013
MVAQEDREVKPHQEETKIMNLGVGEEKKEVANIVPVPKKDGK

SEQ ID NO: 140699 - protein, 351 aa, Glycine max
  Coding DNA Sequence Number=SeqID_49014
  Gene Ontology: Mol. function=transferase activity, transferring phosphorus-containing groups; Cellular component=integral to membrane; Biological process=two-component signal transduction system (phosphorelay)
  Homolog annotation: Hit_ID=A7MQZ7; Match level="QueryCoverage=86%, HitCoverage=33%, E-value=5e-75, Identity=47%"; Hit description =Sensor protein
  Pfam annotation: Domain name=HATPase_c; Domain location=1-109; Score =116.6; E_value=7.5e-32; Accession=PF02518.17; Description=Histidine kinase-, DNA gyrase B-, and HSP90-like ATPase
QILINLIGNAIKFTERGHIDLRVELRHLSITRAELEIQVHDTGIGISEQQQSQLFQAFRQADASISRRHGGTGLGLVITQKLVHEMGGEIAFHSRQNQGSTFWVQVHLDLNPNAPAIPRMLDDLHATPLAYIEPHPAVAKAVQEMLSITPLQVQHFASLDDLPDAHFPLLLMGLPVSDPHPATLSDALIARLRAHADSVLLALPSEMMLFADDLRARGIAGCIAKPVSLTRLLPMLLDLNMRHSDAAPRGVRQPLTVMAVDDNPANLKLIGALLEEQVQNIILCDNASQAIHQAQQQRLDVMFDGYSDAGHRRHLAPERSSAACHSTPARRLSRSQRMRCMSYARRLSLPA

SEQ ID NO: 140700 - protein, 112 aa, Glycine max
  Coding DNA Sequence Number=SeqID_49015
MTLLLSNIMPNDRNADLPLRKYQLGSRPQDTQWTWKSPTGPWGFQLWLRASISPTGCPYPPPPARSCHPDIGKDRAHKTPSGPGKVQQGLGFPALITALCQFYRVPVAPTSH

SEQ ID NO: 140701 - protein, 75 aa, Glycine max
  Coding DNA Sequence Number=SeqID_49016
MIPPPRIVPVAGEVIIVLLWLILLLRLRRSVAMCPSRASEGEAHGCAFQRRKDARSRHQRLFVENVGKTEGNRPK

SEQ ID NO: 140702 - protein, 78 aa, Glycine max
  Coding DNA Sequence Number=SeqID_49017
MDLFRSWRRSIIMPIGGADIEEEEPTDLRSNPHQGGGGDAILPRKGPVTRAMSKRLQEDWARVDKEGLRVLMNLRVDF

SEQ ID NO: 140703 - protein, 120 aa, Glycine max
  Coding DNA Sequence Number=SeqID_49018
  Gene Ontology: Mol. function=helicase activity; Cellular component =chromatin; Biological process=viral genome replication
  Homolog annotation: Hit_ID=Q2A9E0; Match level="QueryCoverage=75%, HitCoverage=6%, E-value=2e-25, Identity=60%"; Hit description =Putative uncharacterized protein
MMAHVVATFLFFVYANTNEQRHIFDSIINAVNGHAGGMFFLYGYEGTRKTFMWKTLASALHSKGDIVLTVASSGIASLLLPNGRTAHSKFVIPVRTLENSKCNIHQGKFFLSFLEEVDQT

SEQ ID NO: 140704 - protein, 116 aa, Glycine max
  Coding DNA Sequence Number=SeqID_49019
ITTHGSKLVGGGCMNENTIHGAPKGVEDGELHKAITTHGSKLVGGGRMNENAFHGAPKKGLEWRIALCNHYAWLKARGWRTHERKRNSLGSEKGLRMENRTKQSLRMAPNSWVEAA

SEQ ID NO: 140705 - protein, 209 aa, Glycine max
  Coding DNA Sequence Number=SeqID_49020
MSKSCGFGMTGPLDESISCFLIRVDPWVLVPIAFRGLHILAFRGLHVPHLERSTRPRLERTTRPHHQRAARPHLQRTARPRLERATRPRLGELHALAIRGLHVLTFVGLHALTFRGLHVLANRGLHALTLRGLHILALRGLHVLTIRGLHALTSRGLHVLALRGLPALALGTSYPHLQRTIRPHLQRATRPRHQRTACPHLRRATRPHL

SEQ ID NO: 140706 - protein, 74 aa, Glycine max
  Coding DNA Sequence Number=SeqID_49021
MARTRGLGRAIGRLVGRDRLDDQDAADVPERRRPTAVARRLRVHQMTAEGRDMVEDVADMPGDVPELAPEAPEM

SEQ ID NO: 140707 - protein, 114 aa, Glycine max
  Coding DNA Sequence Number=SeqID_49022
MGEVEEVQEQMKVNMEAMKEQMTTMMEATISMKKIMEANAIVVVATSVVAKVNPMPPSGLNQMNHPTSAMHAFPSYGLPPNYTPPNEIYIPNEDVNNSTPILIESRQPHHVHVS

SEQ ID NO: 140708 - protein, 91 aa, Glycine max
  Coding DNA Sequence Number=SeqID_49023
MGNLDHLEERLRDFEGGEDYAFANLEELFLVPKHGHSQEYAQRWRDLAAQVVPPMMEKETIIVMVDTLSVFYYEKMVGYAPSKLCGFGLRQ

SEQ ID NO: 140709 - protein, 241 aa, Glycine max
  Coding DNA Sequence Number=SeqID_49024
  Homolog annotation: Hit_ID=Q2HW90; Match level="QueryCoverage=63%, HitCoverage=28%, E-value=3e-14, Identity=33%"; Hit description =Putative uncharacterized protein
YQGSVWRKGQRPWKIKANGLSFIDILALLIFGVVLFPNMEGLVDLAVIDAFLAFHHGKESPVVAILDMYDTFDWGCEKSGARIVCCALALYVWLVSHLFLQEGRPIYPLQGHRSCVEKGKANWDQLLASKEGASVNWFPRWKEGGTRVLISCGGFPNVPLMGTRGCISYNPDRELRGSSNGIIGGNHKWLRVRTQGLDWLPNLKTVRDNEASEESDEVQALKAELERARVVEEKFKSIAIK

SEQ ID NO: 140710 - protein, 49 aa, Glycine max
  Coding DNA Sequence Number=SeqID_49025
MAIGRLEHPGRVRVVGTVHDQCTQLVALGKVYESVSIIHNVPYADDVVR

SEQ ID NO: 140711 - protein, 231 aa, Glycine max
  Coding DNA Sequence Number=SeqID_49026
EELRDYYEGRHRSHLRPHFHRREKERKPQEANIKLSNFHGKDNVEANLDWEIRVEQQLKKKSTSKSYGSHSYPKKDQGHITSQCPTTKTMIMRGQDIYSSQDEATTSPFSSESEEAKEEESSKETYPQEDGQPLVVKEKCKEISVSYKRLAKRETHFTIKTNIKETFPLRQPPHFLFCKKTLASIATPLGLEFIPQVKKLLDEGLVRKSLNPCALLVPKIGIIRHQVPKIG

SEQ ID NO: 140712 - protein, 112 aa, Glycine max
  Coding DNA Sequence Number=SeqID_49027
LITGLCQSFGVPVTPSKVIRPPITRAFIEKYCTPIQVQGGDLQAPDAPPPPHQADPAGSFDTERYLRHLICQQAANHRAHVQTHDCLYQLSLSLQSQGFAPFPCPTPDQFRA

SEQ ID NO: 140713 - protein, 102 aa, Glycine max
  Coding DNA Sequence Number=SeqID_49028
MAEEPRRVTLEDYSSSIVPQFFSSIARPEVKATVQATIRRFGWGENKVEDSRRSHGSYGKYGCKLQGVPSMVELTILAVVSPMKNQLVKSIIWGTSQDKISM

SEQ ID NO: 140714 - protein, 61 aa, Glycine max
  Coding DNA Sequence Number=SeqID_49029
MDIGPALGTRSMENSISLSGGSSSSMDSFASWKMKGSGMEKEEREETPLQGEDESRRSSPP

SEQ ID NO: 140715 - protein, 198 aa, Glycine max
  Coding DNA Sequence Number=SeqID_49030
MAKFDPEIVLEFYANAWPTEEGVRDMHSWVKGQWIPFDADALSQFLSELLFLEEGQQCEFSQRRNRAGGFDEEAIAQLLCTPEQDFAWTAAVRRVRIMRTSMTTFTQTWMTLLISNVLPSDHNSDLPLPKCQLVYAILTRMSVHVDQVIANAIYLYAGMMPTRDPLDPDKSNRALGFPALFTGLCQSFGVPVNPSKVI

SEQ ID NO: 140716 - protein, 153 aa, Glycine max
  Coding DNA Sequence Number=SeqID_49031
MDLIENMAASDIAILRDRAHIPTKKSLLELTYQDALLAQNKLLSKQLEALTETLRCTICGGAHESGCCIPIEEHPTREVNYMGNQPRKNFDAGGFSGFQHGQQYNQQQGQWRNNPGNQFNRDQGGPSTRPQQQGPSLYDRTTKLEETLAQFIQ

SEQ ID NO: 140717 - protein, 62 aa, Glycine max
  Coding DNA Sequence Number=SeqID_49032
MGQGITTKSVPNNLSESDNIVVWLCSLRKKPDVNIKGAVNSAMKTLANSLEGKVDQAVPMMD

SEQ ID NO: 140718 - protein, 204 aa, Glycine max
  Coding DNA Sequence Number=SeqID_49033
  Gene Ontology: Mol. function=phosphotransferase activity, alcohol group as acceptor; Cellular component=cytoplasm; Biological process =coenzyme A biosynthetic process
  Homolog annotation: Hit_ID=A8G9U0; Match level="QueryCoverage=100%, HitCoverage=100%, E-value=9e-86, Identity=79%"; Hit description =Dephospho-CoA kinase
  Pfam annotation: Domain name=CoaE; Domain location=3-180; Score =365.6; E_value=8.1e-107; Accession=PF01121.11; Description=Dephospho- CoA kinase
  Pfam annotation: Domain name=PRK; Domain location=4-183; Score=-74.7; E_value=0.087; Accession=PF00485.9; Description=Phosphoribulokinase Uridine kinase family
  Pfam module annotation: Pfam domain module=CoaE::PRK; Domain location= 3-180::4-183
MAYIVALTGGIGSGKTTVANAFARHGATLVDADVIARQVVEPGTPALAAIAERFGNEMLLPDGALNRAALRQRIFSHPDDKTWLNQLLHPLIHRETQRQLAQATSPYALWVVPLLVENGLQDRADRVLVIDVDAETQLDRTIARDGVSREQAQSILAAQATRRQRLAVADDIIDNSGAAQGIEPQVAALHRRYLELAATAPQQD

SEQ ID NO: 140719 - protein, 91 aa, Glycine max
  Coding DNA Sequence Number=SeqID_49034
MIIRGQDIYSRQDEATTSPSSSESEEAKWEESSEEIYPQEEGQPLVVKEKCKEVLIWDTLGLSYFFVGIINIKIQKKVSREGAQSMKNLGI

SEQ ID NO: 140720 - protein, 134 aa, Glycine max
  Coding DNA Sequence Number=SeqID_49035
MGHMNTNLSQDGVDQLALRQGKIRIMIAGRMLLRSSVIQICVRVVMLVRMIRTGLPVTLHAKSCPKTHSSWPMASSSNLEAWLLLSLNSQCYPSSRTNGCPKNLLMASSSKGTHWPRTQERLYPTPSSVGHALA

SEQ ID NO: 140721 - protein, 235 aa, Glycine max
  Coding DNA Sequence Number=SeqID_49036
  Gene Ontology: Mol. function=aspartic-type endopeptidase activity; Cellular component=small subunit processome; Biological process=DNA integration
  Homolog annotation: Hit_ID=A5ALN1; Match level="QueryCoverage=100%, HitCoverage=15%, E-value=3e-23, Identity=29%"; Hit description =Putative uncharacterized protein
ELWFLGQGYHDHLEKVEADVLEILRSFKTCCSFWKKAREIFANDIQSLFDATMKVTALKQTSHDMIAHIGKARAAVEELKRFLVADSLEEVNKKLDKFYMVLILRSLHSDFDHVRDQVLAGDQVPSMDSLITRLLRVPHVLKEENLADTMETSAMVATRGRGGGRNSRGGRSGREKSESKFSDEEYQEYLKLKSEKSSSQASSSSVPCYSTACISQSIDGPSPWILDSGASDHIS

SEQ ID NO: 140722 - protein, 83 aa, Glycine max
  Coding DNA Sequence Number=SeqID_49037
MRDKDINVIHFVEHCNCGFTRDSPQISASPHQLDLAPYASEPYNAQWNATGLLHDKHTLRSSRILGEMEVDEPWLGLWRPLNY

SEQ ID NO: 140723 - protein, 448 aa, Glycine max
  Coding DNA Sequence Number=SeqID_49038
  Gene Ontology: Cellular component=viral envelope
  Homolog annotation: Hit_ID=Q84VI1; Match level="QueryCoverage=100%, HitCoverage=69%, E-value=0.0, Identity=78%"; Hit description =Envelope-like protein
MDKKIRSIVSSILKDASVPDAGEDVPTSSTPNVSVPDVEKDVPTSSGPNAEVLSSPSKERSTEEDDQAIKETPAPRAPEPAPGDLIDLEEVESDEEPIANRLAPGIAERLQNRKGKTPLKRSGRIKTMAQKKSTPITPATSRRSKVAIPSKKRKEISSSDSDEDVEPDVSTSKRAKKSGRKVPGNVPDAPLDNISFHSIGNVEKWKYVYQRRLAVERELGRNALDCKETMDLIKAAGLLKTVTKLGDCYEGLVRDSLSTFPLTYQTEKVMIIKECLSEENIDVSEHQIAKEITAKRVQHWPKKGKLSAGKLSVKYAILHRIGAANWVPTNHTSTVATSLGKFLYVVGTKSKFNFGNYIFDQTVKHSESFAVKLPIAFPTVLCGIMLSQHPNILNNIDSVMKRESPLSLHYKLFEGTHVPDIVSTSGKAAALGAVSKDALIAELKDTCK

SEQ ID NO: 140724 - protein, 51 aa, Glycine max
  Coding DNA Sequence Number=SeqID_49039
MNSLPSAVQCPPLSSAEPLKKKRRGRDESRHHGKGRTDEISVLSLLSSYLR

SEQ ID NO: 140725 - protein, 79 aa, Glycine max
  Coding DNA Sequence Number=SeqID_49040
MAVEWRRKRERRCHFKEKISLEEAHHHRRPWIRAWRKKEMNEGRGREEHEILCSKRDLKSEPTNPRSITRFFTKCAYMS

SEQ ID NO: 140726 - protein, 52 aa, Glycine max
  Coding DNA Sequence Number=SeqID_49041
MASYGVSSPILFLPSSLCYHDLQEAKESIDEEDPRPKSSNGATSCGIKSRFI

SEQ ID NO: 140727 - protein, 172 aa, Glycine max
  Coding DNA Sequence Number=SeqID_49042
MWKQGHIKSKCPIYLRKQLVEKKGKKEEKYRKAYIAWEDNASASFDCSSEEDIANVCLMANSMDDSSTIEETEVNFEFEEVLEAFNEMHGEVQRHVVSNNKLRSDLKLHITKLASTQSEQDKLRQENEKLFSSYKVTGCVCASTSLNMDDYKSLQIEFEKFKKNHYVECMKV

SEQ ID NO: 140728 - protein, 160 aa, Glycine max
  Coding DNA Sequence Number=SeqID_49043
MGLGKDNGGITSLINAKGNRGKYGLGYKPTQADIKRSIAGRKTGGQSSRLRQESEGSPPCHISRSFISAGLGDEGQVVAIYEDDVPRSFFICSYVSTHSHPFACLLLYFRNGKSDDESPEGTNTWDPSINFEQEMNQTEDEGNEDVGLPPELERMVAVIP

SEQ ID NO: 140729 - protein, 181 aa, Glycine max
  Coding DNA Sequence Number=SeqID_49044
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=46%, HitCoverage=72%, E-value=5e-24, Identity=69%"; Hit description=LacZ protein
GQDRLGLPFGVKTKHERQKPVKVLKDERNRGWGHDRPIVTLLCAKQAGNVAARQPRLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 140730 - protein, 156 aa, Glycine max
  Coding DNA Sequence Number=SeqID_49045
  Homolog annotation: Hit_ID=A6FJQ2; Match level="QueryCoverage=24%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPLVTGSGDIGHVGGREEGVANGNGDTPSWYRYPLWRDRSRGTRPGAGEAAMLHVKFSFSGLQGYRARIRNHGHSCFLCEIVIRSQFHTTYEPEA

SEQ ID NO: 140731 - protein, 244 aa, Glycine max
  Coding DNA Sequence Number=SeqID_49046
MLGPDTQIMFWGETFYLRGSSEDRPPKQSRVRGHLVKINADSLNTFLETPVVLAEGETLPAYFRYYRLPTDFREIEAALCIPGRGFILNSEGHPRKILKKDLTTLAQVWSVLLYSNLAPTSHTSDLTVDRARLIFGLVSHLDMNIGALISGQMTSIAHSNTSRLGFPALITALCRAKGVVSDSLTFEHLSPVINLAYIRNNCWNPDDLTVSIRGARRARARPAELPSTFAAPTPASTSAAPSVL

SEQ ID NO: 140732 - protein, 102 aa, Glycine max
  Coding DNA Sequence Number=SeqID_49047
  Homolog annotation: Hit_ID=A6FJQ2; Match level="QueryCoverage=37%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARVFPVTTLSTLEDPPNSIGLDCLWMAKETLIVSKTTKADDHDCLCIPSNLIVS

SEQ ID NO: 140733 - protein, 96 aa, Glycine max
  Coding DNA Sequence Number=SeqID_49048
MAYVDISAMVKSKIFPYTLRKACIWKMARSVFALCPYFRDLHGRELKGLLVIIPKVVISLLMVFRGIIPFEEHIAAVGTTSNNMLSKRKTLDEGSL

SEQ ID NO: 140734 - protein, 188 aa, Glycine max
  Coding DNA Sequence Number=SeqID_49049
MVEASGNRLPACVIDYTEEWVTGCVIDYQRWKALKYPFYLHVVIVMAAQLIRDRIEMECLEGAWETLEGNTRCRFRGTIRFTATSLVHPNETARTLQRTVEWILPTPTPYRLVEPVQVIEVTSTEEDPEEDLEELPPEPAVDALDYLEGDEDPLLEVDSPEEVMSASEADSTEDSGPGEMAISGGSSS

SEQ ID NO: 140735 - protein, 90 aa, Glycine max
  Coding DNA Sequence Number=SeqID_49050
  Homolog annotation: Hit_ID=A7PBE8; Match level="QueryCoverage=41%, HitCoverage=4%, E-value=1e-09, Identity=78%"; Hit description =Chromosome chr16 scaffold_10, whole genome shotgun sequence
MCPNPHRSYRHFIHRSSSSAAKASHPSINIERAKEIKRKIGEAKKRENERRNGSWWPGQILGLDHLSTSHLTSPRSGTPVKLHRKEVSNK

SEQ ID NO: 140736 - protein, 195 aa, Glycine max
  Coding DNA Sequence Number=SeqID_49051
  Homolog annotation: Hit_ID=Q2AA09; Match level="QueryCoverage=81%, HitCoverage=50%, E-value=2e-07, Identity=28%"; Hit description =Retrotransposon gag protein
MERSMIDAASGGALGDMTPTEARNLIEKMASNSQQFSARNDAIVIRGVHEVATNSAASSETKKLEGKLDALVNLVTQLALNQKFVPVARVCGLSSSTDHLTDLCPSMQQPGAIEQPEAYAANIYNRPPQPQQQNQPQQNNYDLSSNRYNPGWRNHPNLRWSSPQQQQQQPAPSFQNAAGPSKPYIPPPIQQQQQP

SEQ ID NO: 140737 - protein, 93 aa, Glycine max
  Coding DNA Sequence Number=SeqID_49052
MMTKVMNKKLKRIKEHPSQENLEQVKEFKNQEEFKTQEESLQTRIKIQDQDSRLKRFKISRIKIKIQDSRFKNEEKTQSRLVLKSFFKTLNST

SEQ ID NO: 140738 - protein, 245 aa, Glycine max
  Coding DNA Sequence Number=SeqID_49053
  Homolog annotation: Hit_ID=O82360; Match level="QueryCoverage=84%, HitCoverage=75%, E-value=1e-13, Identity=29%"; Hit description =Expressed protein
MTNANCPQESLHSVSNGNLRLWKSIHYCFKSEGPSMKSLCESHNDIWTLMTALELPIIYVREPKGRKMKTISGHCVPVKDILVSKAAKILTKFVSADNGASLVINAYLHRASASFNELKQLHKELGSSHSHKKHKRHITENGNDSGIISLDLPKVKNPAKGKVLMQAMYGVKVETLEAVDASVKILYPTIQAGVDIVEIEWLVKTVEELRAGVEKLSQGNDLLAKGVDGLFEAAMTSRDTLLSFV

SEQ ID NO: 140739 - protein, 92 aa, Glycine max
  Coding DNA Sequence Number=SeqID_49054
MASTSGDATPPSPKTARLMAQMIKLGNQMRRMSYDNEERIERMRKKNEESLGRIHRSSEALSVRIENIKRRREEDGGMRGIGREVLDQVALE

SEQ ID NO: 140740 - protein, 50 aa, Glycine max
  Coding DNA Sequence Number=SeqID_49055
QFRAEVALHGDWPEAQAGGAPAGAPGDAEEARMDEEMTDLLGFLGGSGAT

SEQ ID NO: 140741 - protein, 211 aa, Glycine max
  Coding DNA Sequence Number=SeqID_49056
MTTLTQIWMTLLLSNILPSDHNSDLPLPKCQLVYAILTRMSIHVAQLIADAIYLFAGMAPTRHPMDPDKSNRALGFPALIIGLCQSFGVPVAPTKVIRPPITRAFIEKYCTQRQAQGDAPQAAGAPPPPHQAGPAGPFDMEQYLQHLVRQQAANHRAHHAEPGLRFFFMPYSRPVQGRGRMARGLARDPSMIGTPRGSRRWRGGPRGRGDG

SEQ ID NO: 140742 - protein, 256 aa, Glycine max
  Coding DNA Sequence Number=SeqID_49057
  Homolog annotation: Hit_ID=Q6WAY6; Match level="QueryCoverage=72%, HitCoverage=30%, E-value=3e-15, Identity=32%"; Hit description =Putative uncharacterized protein
KESLVVAILADLFDTFDRRCEKNSARIVYCLPALCVWLVSHLFQQDIRHPCALQSYRSCVEKRRVDWDQYLAGIGGSTINWFPRWKEGKEGVLFSCGDYPKVPLIGTRGCINYNPVLSIRQLGYPMRGAPTEESLSPFLVRDFGAQSLKVVQRVHKAWKSPLRKDKELRGIRNGIISGYHEWLRVRTRGLDWLSKLKVINEENFEALEEDEEVQALKLELGKARLAKEKFKSAATSIRKECTKLREENASNPCTKI

SEQ ID NO: 140743 - protein, 78 aa, Glycine max
  Coding DNA Sequence Number=SeqID_49058
MATIALSSRYGSKLAYDTGIWGESYRLFAAKFISWLVFFLTGFVVDLGMAFVDNWVVGKEEIHFDPFTGEDQIRKALR

SEQ ID NO: 140744 - protein, 454 aa, Glycine max
  Coding DNA Sequence Number=SeqID_49059
  Homolog annotation: Hit_ID=Q6WAY6; Match level="QueryCoverage=50%, HitCoverage=38%, E-value=7e-22, Identity=31%"; Hit description =Putative uncharacterized protein
MANQGDWVPFMDVLALLIFGVVLFPNVDGLIDLAAIDAFLAYHHSKESPVVAVLADLFDTFDRRCEKSSARIICCLPALCVWLVSHLFQQDTRHPCPLLSHRSCAEKGRMDWDQLLAEMGGRTISWFPRWKEGKEGVLFSCGRYPNIPLVGTRGCINYNPTLAIRQLGYPMRGAPTEESMSPFLVRDLGAQNSKTIQRIHKAWETPLRKDQELRGVRNGIIGGYHEWLKVRIREDEEVQALKSELGKAKLAKEKFKLAATHVRKECAGLREENAITARALEQETKRARKEEYGRNKFRGALWGSNNELKLRREERDQSRAHSMVLKEELIACSRSKRSLSQCLCETETNMLAIIAKYQEELGLATAHEHRIADEYAQVYAEKEARGRVIDSLHQEATMWMDRFALTLNGSQELPRLLAKAKAMADTYSGPEEIHGLLGYCQHMIDLMAHIIRNR

SEQ ID NO: 140745 - protein, 171 aa, Glycine max
  Coding DNA Sequence Number=SeqID_49060
  Homolog annotation: Hit_ID=UPI0000ECBAF8; Match level="QueryCoverage =23%, HitCoverage=48%, E-value=2e-16, Identity=100%"; Hit description= UPI0000ECBAF8 related cluster
  Subcellular localization annotation: CTP_CleavageSite=67; ConfidenceScore=5.15e-01
NAAFVRFVAFCWPFAHMFFPALSPDSVDNRITAFEKRKSAQYANRLSPRVGRFINAAGTTGFPTGKRAVSATQLIYDHDYEFELGTQHVDRWTAMLLVESPAGKVAGEFPRVAPSRPAGMQAWHWPSFYNVVTGKTLALPNLIALQHIPLSPAGVIAKRPAPIALPNSCAA

SEQ ID NO: 140746 - protein, 139 aa, Glycine max
  Coding DNA Sequence Number=SeqID_49061
MDNEEGVQEQMKVDMSALKDQMASITEAMLKIQKSIEDNATAAASNTAREAEPVLQPAINLGRDINAMGFNRSYSPQAYPYGLPPDFTPRTAPDDLSQAPTFEGQLPPHADYPLQEDDERDAHLGPLLPLKESAPHELP

SEQ ID NO: 140747 - protein, 43 aa, Glycine max
  Coding DNA Sequence Number=SeqID_49062
MHWMSTIILGTFRNNWEAYFNDPRPLEPERLKANPVGTILSPS

SEQ ID NO: 140748 - protein, 290 aa, Glycine max
  Coding DNA Sequence Number=SeqID_49063
  Gene Ontology: Mol. function=riboflavin synthase activity; Cellular component=riboflavin synthase complex; Biological process=riboflavin biosynthetic process
  Homolog annotation: Hit_ID=A8AK39; Match level="QueryCoverage=51%, HitCoverage=95%, E-value=1e-74, Identity=97%"; Hit description=6,7 -dimethyl-8-ribityllumazine synthase
  Pfam annotation: Domain name=DMRL_synthase; Domain location=10-154; Score=300.0; E_value=4.5e-87; Accession=PF00885.10; Description=6,7 -dimethyl-8-ribityllumazine synthase
  Pfam annotation: Domain name=NusB; Domain location=159-286; Score =163.1; E_value=7.5e-46; Accession=PF01029.9; Description=NusB family
  Pfam module annotation: Pfam domain module=DMRL_synthase::NusB; Domain location=10-154::159-286
MNIIEAAVATPDARVAITIARFNNFINDSLLEGAVDALKRIGQVKDDNITVVWVPGAYELPLAAGALAKTGKYDAVIALGTVIRGGTAHFEYVAGGASNGLAHVAQDAEIPVAFGVLTTESIEQAIERAGTKAGNKGAEAALTALEMINGNSVKPAARRRARECAVQALYSWQLSQNDIADVEYQFLSEQDVKDVDVAYFRELLSGAAVNAGMLDELMAPYLSRQLEELGQVERAVLRVALFELKMREDVPYKVAIKEAIELAKTFGAEDSHKFVNGVLDKVAPTLRKKK

SEQ ID NO: 140749 - protein, 329 aa, Glycine max
  Coding DNA Sequence Number=SeqID_49064
  Homolog annotation: Hit_ID=Q2HW90; Match level="QueryCoverage=89%, HitCoverage=61%, E-value=5e-62, Identity=42%"; Hit description =Putative uncharacterized protein
  Subcellular localization annotation: CTP_CleavageSite=41; ConfidenceScore=5.03e-01
MVLSLPLNPPTSQPPSILKPLSSKQTLPLKEASKNPVPTLLADTYHSIHDRTQAGRGTISCCAPLLYQWFTFHLPQSRAFKTNDDKLSWPRRIMTLDPSDIVWYQAASDVGEIIVSCGEYPNVPLLGMRGGISYNPLLARRQFGYPIKTKPNNLALTNEFYLNHGDHSNKRERFAQAWSAIRRLNRSQLGKKSDYVHESYTQWVIDRTKSFGLPYRLPRYLSSTIPPSSLPIPFDTKEEFHEQLTKERQEKETWKRRYQGLEQENEILKGKIAQQSRELFIQNQRMIEKDDLLRRKDALLHRDARRKRRFMDLFSRAHSDSEDPSTPGV

SEQ ID NO: 140750 - protein, 86 aa, Glycine max
  Coding DNA Sequence Number=SeqID_49065
MNCVFVHASSNHEFGVMRSDCLGQFSILNLFSEPMNCVFVHASSTHEFGAMGSDCLVQFSILNLFSEPHELRFRSCVLHLRVWSHA

SEQ ID NO: 140751 - protein, 46 aa, Glycine max
  Coding DNA Sequence Number=SeqID_49066
FRAEVAWPGDWPEARAGEAPAEAPNEADEAREDEEMTDFLGGSGAT

SEQ ID NO: 140752 - protein, 150 aa, Glycine max
  Coding DNA Sequence Number=SeqID_49067
MWLKEVKTLVVLSRNRDEHAKCASLSLTYTAKHHFASMASKKRKAPSTPTQAKFDRSSSIDIAIVKEFYTNLYDPEDKSPKQVRVRTPIVMGSCRNMPFCGRAKARLTDALSKGGKVRRVATNVYLWKTSEKPKEIGQNENSKFGSCIYV

SEQ ID NO: 140753 - protein, 287 aa, Glycine max
  Coding DNA Sequence Number=SeqID_49068
  Subcellular localization annotation: CTP_CleavageSite=48; ConfidenceScore=5.06e-01
MKDSGIRMSLKTVQWSRQLPQPTLRREGDARAHGCVFHRRKMRGVATNANKRKSSEKSERCGLRTLSVKGSGVVFTHGEERRTDEERRKTFTDLLTEALPKHLDLDFLHRNNFFHPKQLKWIAKGVRDIWNSLPSPIYRKGGEEVAAQLAQASWVASSISNPASKIFWKGLDSKIENCYLHPYIDKTLPIARQCSLSTFGMSRNFTDYLTMGVKYLEAVKQRLQAIKQWSPDEIRGNPVCQKAHRIVKYLKLKRMNLSIELRELVLDMVKFRNKALLKETLIIDDLE

SEQ ID NO: 140754 - protein, 105 aa, Glycine max
  Coding DNA Sequence Number=SeqID_49069
MVEEEEGMATTCHLSHFEWNKKGPPFSLDVTYAQPQEEGKNLTFETLKSCLSLRAVSLVPVPRVSLHPSGPVSESRQYVYQNTQNETLSVVQRLVLFNFKLHAKR

SEQ ID NO: 140755 - protein, 21 aa, Glycine max
  Coding DNA Sequence Number=SeqID_49070
MPVSAETNVVELRTKKPSSTY

SEQ ID NO: 140756 - protein, 78 aa, Glycine max
  Coding DNA Sequence Number=SeqID_49071
MGRRLGTKGGITIRYSVTCASNAKGPESVLDTNFGLRLSDDKRVRITIWYLRVSWVQNDQTWSLLVRAPHAIKRSVLR

SEQ ID NO: 140757 - protein, 194 aa, Glycine max
  Coding DNA Sequence Number=SeqID_49072
  Homolog annotation: Hit_ID=Q6WAY6; Match level="QueryCoverage=97%, HitCoverage=30%, E-value=3e-15, Identity=30%"; Hit description =Putative uncharacterized protein
KHLEEKVKALADQGEWASFIDVLALLVFEVVLFPNVDGLVDVAVIDAFLAYHHSKESPVVAVLTHAYGTFDRRCKKSGARIVYYTPALYVWLVSHLFLHESRSICPLQGHYMYVENGKANWEQLLAGMVGAFINWFLRWKEGGTGVLFSCEAFTNVPLMGTRGCINYNPVLAIRQLGYPMREAPSEKSITPFIA

SEQ ID NO: 140758 - protein, 306 aa, Glycine max
  Coding DNA Sequence Number=SeqID_49073
  Gene Ontology: Mol. function=endonuclease activity; Biological process=response to bacterium
  Homolog annotation: Hit_ID=A9R4N7; Match level="QueryCoverage=85%, HitCoverage=50%, E-value=5e-30, Identity=32%"; Hit description=S -type pyocin family protein
  Pfam annotation: Domain name=Pyocin_S; Domain location=134-291; Score= 78.3; E_value=2.5e-20; Accession=PF06958.3; Description=S-type Pyocin
MQGNNKNLILILQKWALFRAAPAVDAVTDSDAPQHAQTAKKKPQAPEDIPKPKKRSALYKWFNGNHEEMQYQAAVAAAASATRAQTATAGVNVLEQIGGRFATYGTWAVRGAEIATAGAGASVAGFLIGMMPGRLNDGEQDFIDRIRLAQMSEAPTRVRYTWENDSNGNPVPHGWHTPPGKDMVRVRKMQWDSTRQAYTFTTEEESPVTIIWTPDHSGVHTPSNTGNQTPPRLPGTILVNPLPDGIQSTSTTTTAPDEKNFADYILILPVSDIPPIYIYIRNNPGQVTGKGQKVTGTWLADAGHGN

SEQ ID NO: 140759 - protein, 203 aa, Glycine max
  Coding DNA Sequence Number=SeqID_49074
  Gene Ontology: Mol. function=RNA binding; Cellular component =cytoplasm; Biological process=thiamin biosynthetic process
  Homolog annotation: Hit_ID=P55913; Match level="QueryCoverage=98%, HitCoverage=41%, E-value=5e-99, Identity=90%"; Hit description =Thiamine biosynthesis protein thiI
  Pfam annotation: Domain name=THUMP; Domain location=75-165; Score =72.6; E_value=1.3e-18; Accession=PF02926.8; Description=THUMP domain
MKFIIKLFPEITIKSQSVRLRFIKILTGNIRNVLKNYDETLAVVRHWDHIEVRAKDENQRPVIRDALTRIPGIHHILEVEDVPFTSLHNIFEQTLPLWREQLEGKSFCKRVKRRGKHEFTSIEVERYVGGGLNQHIESARVKLTDPDVTVNLEIENDRLLLVKGRYEGIGGFPIGTQEDVLSLISGGFDSGVSSYMLMRLRLP

SEQ ID NO: 140760 - protein, 129 aa, Glycine max
  Coding DNA Sequence Number=SeqID_49075
  Gene Ontology: Mol. function=nucleoside-triphosphatase activity; Cellular component=plasma membrane; Biological process=lipoprotein transport
  Homolog annotation: Hit_ID=Q0TIV6; Match level="QueryCoverage=100%, HitCoverage=67%, E-value=1e-54, Identity=73%"; Hit description =Lipoprotein-releasing system ATP-binding protein lolD
  Pfam annotation: Domain name=ABC_tran; Domain location=2-117; Score =21.3; E_value=1.3e-08; Accession=PF00005.18; Description=ABC transporter
MSSAAKAELRNRELGFIYQFHHLLPDFTALENVAMPLLIGKKKPAEINARASDMLNAVGLGHRGNHRPSELSGGERQRVAIARALVNNPRLGTAFLVVTHDLQLAKRMGRQLEMRDGHLNAELTLMGAE

SEQ ID NO: 140761 - protein, 152 aa, Glycine max
  Coding DNA Sequence Number=SeqID_49076
  Gene Ontology: Mol. function=amino acid transmembrane transporter activity; Cellular component=integral to membrane; Biological process=amino acid transport
  Homolog annotation: Hit_ID=A8G9W9; Match level="QueryCoverage=98%, HitCoverage=32%, E-value=2e-54, Identity=70%"; Hit description=Amino acid permease-associated region precursor
MAQDGQAPRSFTKLTASGVPWMTVLVMSVALLLAVVLNYLIPEKVFMIIASIATFATVWVWLMILLSQIVMRRTLSPEETRQLSFPVPWWPVAPALATAFMAFVIGLLGYFEESRIALYVGLVWIALLTVAYWLWVRKKGGGSPVTAATQQM

SEQ ID NO: 140762 - protein, 64 aa, Glycine max
  Coding DNA Sequence Number=SeqID_49077
MVFLTRHEESIKARGYIYLGLTENKRGYISYGSVLVEGTSTRFKENKGGYIPCGSLLVKGFLQG

SEQ ID NO: 140763 - protein, 104 aa, Glycine max
  Coding DNA Sequence Number=SeqID_49078
MNPQLNVPSQLNADPTTDIHVAQSESNEMSHDYCSIGSTCYCEYKILSASVPSRATPLELVGLGSSSSMDSFASWKMNGSRMEKEEREEMPLQGEDESRRSSPP

SEQ ID NO: 140764 - protein, 188 aa, Glycine max
  Coding DNA Sequence Number=SeqID_49079
MTTLTQTWMTLLLSNILPSDHNSDLPLPKCMAPTRHPLDPDKSNRALGFPALITGLCQSFGVPVAPSKVIRPPITRAFIEKYCTQRQAQGDAPQAAGAPPPPHQADPAGSFDTERYLWHSMRQHAPNHRGLGQVHECLYHLSLNMQSQGFAPFPCPTPDQFRERRCQICSASWEGFRNRVEFHLGTSS

SEQ ID NO: 140765 - protein, 106 aa, Glycine max
  Coding DNA Sequence Number=SeqID_49080
MPISTCRCIGWNRTYKMPSGPEEVQQGLGICSSGIVPTRRLVDPKKSNRALGFPALVTGLCSPTGCPFPPARPHHHGIGIAPARYPVDPKKSNRVLELSSSNYGSL

SEQ ID NO: 140766 - protein, 227 aa, Glycine max
  Coding DNA Sequence Number=SeqID_49081
MERSMIDAARGGALGDMTLAEARNLIGKIASNSQQFSARSDAIVIRGVHEVATNSSSSAETKKLEGKLDALVNLVTQLAMNQKFALVARLCDLCSSADHHTDLCPSMQQSEAIEQPEAYVANIYNRPPQPQQQNQPQQNNYDLSSNRYNLGRRKYPNLRWSSRSQHQQQQQPYFQNAVGPSRPYVPPPIQQQQQQQQKQQPQKQQTVEAPPQPSLEELVRQMTMQNM

SEQ ID NO: 140767 - protein, 89 aa, Glycine max
  Coding DNA Sequence Number=SeqID_49082
  Subcellular localization annotation: CTP_CleavageSite=54; ConfidenceScore=5.13e-01
MFIRITTRVFPPRQRDSNVSMTDLVSAKDDVNLRVSTLVADKRRGADNRKVSSRATSSWVMVTKSGAVDKSEALAPTYPQMRNSDSNML

SEQ ID NO: 140768 - protein, 143 aa, Glycine max
  Coding DNA Sequence Number=SeqID_49083
MAQRLAEDQTEVAPVAAPDGLEDAHMDEEMTDLLNFLGGSGATYFVTIFVTYHFRAFFVHLVVRRKIDCNNINEIKEERMQTQFYTGSATSRAYIQYSSNPLEISTILVKSITKSEPHRDNPSLVFRNPLQQETHSLLTNLIE

SEQ ID NO: 140769 - protein, 127 aa, Glycine max
  Coding DNA Sequence Number=SeqID_49084
  Homolog annotation: Hit_ID=A5AW84; Match level="QueryCoverage=35%, HitCoverage=4%, E-value=3e-10, Identity=64%"; Hit description =Putative uncharacterized protein
MDSGYSRHMTGDKSRLTDFVLKEGGYATFGDNDKKRIMGEGNIGNQHKTHKKCFVMTKSSKINQRTTQVNQRSIKNNSRVQDKNQEEFKTQEESLETRIKIQGSKISRIKIKIQDSRFKNEEKTQSR

SEQ ID NO: 140770 - protein, 99 aa, Glycine max
  Coding DNA Sequence Number=SeqID_49085
MPHPIEGCVPTSFSTWFLKAIHLVICSLEHKVQDHLRIQTQTTHGESLSLSKIIGRPVRVTMFCENAPTIWDQHRLKGALKPDDPQGLHSEESVRASPS

SEQ ID NO: 140771 - protein, 191 aa, Glycine max
  Coding DNA Sequence Number=SeqID_49086
  Gene Ontology: Mol. function=chitin binding; Cellular component =extracellular region; Biological process=chitin metabolic process
  Homolog annotation: Hit_ID=UPI00006A17C9; Match level="QueryCoverage =70%, HitCoverage=100%, E-value=7e-14, Identity=32%"; Hit description= UPI00006A17C9 related cluster
  Subcellular localization annotation: CTP_CleavageSite=69; ConfidenceScore=5.22e-01
VMLVRMIHTRLFAAARVKSYLGMHSSSVIASLSGCARTVGPPPISGGGPRIVWMWSTLKMRTRSPLKVRACSPFKARMCSPLEVRACSPLMARTCNPLKVRACNPLMVRTCSPLNGEGNLVPKVRACSPLKARTCSPLEVRACNPLMVRTCSPLKARTCSPLTVRVKACSPLMVRTCSPLKARTYSPLETR

SEQ ID NO: 140772 - protein, 85 aa, Glycine max
  Coding DNA Sequence Number=SeqID_49087
  Subcellular localization annotation: CTP_CleavageSite=63; ConfidenceScore=5.06e-01
MTLSLEYLPCDIRIKFAQFQVKGKNLERASNAKRSFSALSATEESGRASISRPCAKREIRSLSAMVVFSQAQRMTDAKLKSTNSC

SEQ ID NO: 140773 - protein, 36 aa, Glycine max
  Coding DNA Sequence Number=SeqID_49088
GLWAFVGALSATPPRSARVDRALSAHVAGLARVLQA

SEQ ID NO: 140774 - protein, 113 aa, Glycine max
  Coding DNA Sequence Number=SeqID_49089
MSRWHDLAGGDGHPVGLTEARNQSWKPQGPVGLLRVHWDGMLLSSNVIHICVRVVMLVRMIRTRLFAAAQVKSCPDMHSSCVIDSLSGCARTVGRPPISGGGPGTDKRKLLAP

SEQ ID NO: 140775 - protein, 164 aa, Glycine max
  Coding DNA Sequence Number=SeqID_49090
  Homolog annotation: Hit_ID=UPI0000ECBAF8; Match level="QueryCoverage =25%, HitCoverage=48%, E-value=1e-16, Identity=100%"; Hit description= UPI0000ECBAF8 related cluster
SEQESARGSFQGETPGIFIVLSGFATSDLSVDFCDARQGAGAYGKTPATRPFYADTARRSRTTERSESVSEEAEERPIRKPPLPAPSGDKTIRIWAISDGSCLKTFEGHTSSMQAWHWPSFYNVVTGKTLALPNLIALQHIPLSPAGVIAKRPAPIALPNSCAA

SEQ ID NO: 140776 - protein, 64 aa, Glycine max
  Coding DNA Sequence Number=SeqID_49091
MATKMKRCPFEALGSIAPITSIPHIENDQGAAKTFKGSSRPWHVYWHVFQRIPHALPLAFTQPP

SEQ ID NO: 140777 - protein, 72 aa, Glycine max
  Coding DNA Sequence Number=SeqID_49092
  Subcellular localization annotation: CTP_CleavageSite=40; ConfidenceScore=5.13e-01
YPGLQRTTRPRQQRAARPHLKRVLCNVLTFRGLHALTFKRATRPRQSEDCVSSPSEGCTPSPSRGLTHVLMP

SEQ ID NO: 140778 - protein, 227 aa, Glycine max
  Coding DNA Sequence Number=SeqID_49093
MSYIDFTKMINSPRDPRKALCRGLKPLNCDSDILQLVEDVSGFDVVEVYVDEGVFEKSGKKKLNDFKGYEVVIIDGVEAEAVVEGEDEAEVQVDEQGLVEVQVQGEDEAGVVVWWMMMSGLRKMMTMAVIIVKFQIMTLKKVRIGQNGWTLRHLDTPVGSEDEGPSKVKFPHFKVPGNDEDVMFEGLVEVIKELGDNVEHRLCVKHLYARETTTSGWDKAMNQIGEL

SEQ ID NO: 140779 - protein, 73 aa, Glycine max
  Coding DNA Sequence Number=SeqID_49094
  Homolog annotation: Hit_ID=UPI0000ECBAF8; Match level="QueryCoverage =56%, HitCoverage=48%, E-value=1e-16, Identity=100%"; Hit description= UPI0000ECBAF8 related cluster
MDGMAKRELKETQLPPSRPAGMQAWHWPSFYNVVTGKTLALPNLIALQHIPLSPAGVIAKRPAPIALPNSCAA

SEQ ID NO: 140780 - protein, 301 aa, Glycine max
  Coding DNA Sequence Number=SeqID_49095
  Homolog annotation: Hit_ID=P03851; Match level="QueryCoverage=27%, HitCoverage=98%, E-value=5e-38, Identity=90%"; Hit description =Uncharacterized 9.4 kDa protein
MTVKTSDTCSSWRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRLRPLTSITKSTLKSEVAKPDRTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPQITRRTKGSQEDPLIFSTGSDAQWNENSR

SEQ ID NO: 140781 - protein, 210 aa, Glycine max
  Coding DNA Sequence Number=SeqID_49096
MAAMMEAMMSVKKRMEANAVAIAATSVVAKVNLMSPSGINQMNHPTSDMVGKDLGSTGGPHDVQIQNEHAFPPYGLPLNYTPPNVAYTPNKNTHEIPHHNLADFEPGLGYANEGQAVGGIPLENTSEGPQYHPQLHLLHSTTSENPHAMAEMGKLDHLVERLRVIEGGEDYAFANLEELFLVPNIINPPKFKVLDFDKYKGTTCPENHLK

SEQ ID NO: 140782 - protein, 350 aa, Glycine max
  Coding DNA Sequence Number=SeqID_49097
  Gene Ontology: Mol. function=aminopeptidase activity
  Homolog annotation: Hit_ID=A8GE73; Match level="QueryCoverage=99%, HitCoverage=98%, E-value=1e-167, Identity=83%"; Hit description =Putative uncharacterized protein
MAVNQSQLGQMFEQVLRLSKVDASQSVAILKSHYSDARTVQAATDAALRLGAKVYCVELPAFNHPTAMGNDMTAYCGDTALTGNIAAQRALEAADLIVDTMMLLHSPEQEQILKTGTRILLAVEPPEVLARMLPTEEDKSRVLAAAAVLEKARMMTVKSPVGSDFRAPLGQYPTVTEYGYADEPGRWDHWPSGFLFTWPNEDQAEGVLVLDVGDILLPFKSYARERITLEIEQGFVTHIHGGFEAEYLRDYMRYFNDPEVYGISHIGWGLQPRAQWTAMGLHDKNDGMCMDARAFYGNFLFSTGPNTEVGGKRKTPCHMDIALRRCDIKVDDLLVVAEGEVVAPEASRAR

SEQ ID NO: 140783 - protein, 154 aa, Glycine max
  Coding DNA Sequence Number=SeqID_49098
MGSSQKPSLKKRFYQVKIKSLEVTSLRKLGQLMGQLQRQAFAKPMGSTPHWPEFLKSPNLGAGIRPPKASRKWGGRNTEKIFGALYVGLVSHLFLQEGRPVYPLQGYRSCVEKGKANWDQLLASMGGRLLIGSLARRKEESRFYLHAKDVQMFP

SEQ ID NO: 140784 - protein, 103 aa, Glycine max
  Coding DNA Sequence Number=SeqID_49099
MYKDKWTQPWPMGSKIYPKVHENPRAFFNSSSPILLEPIAHGFGLKVLAFIFHKTQSPRLYLSWDSKSSLLSFRTQSPRFYLSQDTKSSPLSFMGLQVLTSIF

SEQ ID NO: 140785 - protein, 81 aa, Glycine max
  Coding DNA Sequence Number=SeqID_49100
MIRLPSAVRLSSTLKSYREPHELLVIHASSTIESGAPRIDCLALAVRLSSTLESYPEPHELLLIHASSNIESGAPRIDCLA

SEQ ID NO: 140786 - protein, 219 aa, Glycine max
  Coding DNA Sequence Number=SeqID_49101
MQQQQQQQRQQATEAHPQPSLEELVRQMTIQNMQFQQETRASIQSLINQMGQMTTQLNQAQSQNSDKLPSQTMQNPKNVSAITLRSGNQIQVPPPVVAPAPEPVKLHSTLEKEDEIVAQKRKLPNKNFHAGGPSSSNSDLQQPPIPLLFPPRAIPNKKNGKSRKGDLGDLQESRDELTSARCHQADSKICQVSKGTVHPQKEAQGNERISMGRNVSALI

SEQ ID NO: 140787 - protein, 114 aa, Glycine max
  Coding DNA Sequence Number=SeqID_49102
MEEKVQTQFLYWFGKVRCLRPIPKKPAWEFHYLKNPLHLLKRIRTSLPLCSDALQQETHSLLALFQKEKSVENSCPSHLFIVLRWPFKNQVKRYDCWQIFSKLATGNRLKSWGN

SEQ ID NO: 140788 - protein, 198 aa, Glycine max
  Coding DNA Sequence Number=SeqID_49103
MRTSFTTITQIWMTLLLSNILPNDHNSDLPLQKCQLVYAILTQVSVHVAQLISDPIYQFAGITPLRHPMDLEKSNRALGFPALITGLCQFYGVVVTPIKLIRPPISRAGAGSGIVAARGGPATASNRCTTVASRGGTLSKVHLRPPAEDRTLDAQLNETFYRYNMHQQSQDPSPFPWPTPEQFGATVAWLGDETDFEM

SEQ ID NO: 140789 - protein, 120 aa, Glycine max
  Coding DNA Sequence Number=SeqID_49104
MAKFDPDIVLEFYANAWPTEEGVRDMRSWVRGQWIPFDADALSQFRGYPLVLEEGQECEYSQRRNRSDGFDEEVIAQLLCVPGQDFARTAAGRRVRIMRTNMTTLTQVWMTLLLSNIQHQ

SEQ ID NO: 140790 - protein, 190 aa, Glycine max
  Coding DNA Sequence Number=SeqID_49105
MARFDPDEVLEFYANAWPTEEGVRDMRSWVRGHQFLGDLLVLEEGQECEYSQRRNQVDGFDEEAIAQLLCIPGQDFARTVAGRWVRIMRTSMPPTRHPLDPDKSNRAMGFPALITGLCHSFGLPATPSKVIRPPITRAFIEKYCTPRQAKGGAPQAANHRGHVQTHECLYQLSLSLQNQGFAPFLCPTPD

SEQ ID NO: 140791 - protein, 132 aa, Glycine max
  Coding DNA Sequence Number=SeqID_49106
MEDMVTSRRFILEALHEAGVIFLDGGKGDACLIHPGASHDVEACPVAEDLLHGWMDKGLFEVCGTRKWEQDVCMQSADKSPSKPKPLVIYFTRDVTMHKPRGFQPIPVKKPALFPYKNDKAVPLVWSRTRIK

SEQ ID NO: 140792 - protein, 204 aa, Glycine max
  Coding DNA Sequence Number=SeqID_49107
  Homolog annotation: Hit_ID=A5C169; Match level="QueryCoverage=75%, HitCoverage=13%, E-value=6e-07, Identity=26%"; Hit description =Putative uncharacterized protein
MTGRLLAGSLAFESRILHYLIVRILLPRSSNLAQVYEEDRVIMWAFHIGRQLDWAHLVRYRMHKALRLNAPLPYPHLVTLFLRHFQIPLDSEPYVPIKRSFLIGAAMIASFGYRKEHDGSWVKKGAQPADDEGNLPVEDNSSLLRRLLDKFDGLQTFVGDKFDAMELQVDMRFDAMDSRITKVEKDVSFIRTCFDPPPPPPSSS

SEQ ID NO: 140793 - protein, 225 aa, Glycine max
  Coding DNA Sequence Number=SeqID_49108
MDISEDTDIPVILGRPFMLTASWIVDMGKRKLELGFKDQKIDFDLFVEDKPAPKHNVCLQVMEGGQEVLKHKPHVKRISVHALSRESQALSTHPLHLRMIWSAKLAKMASKKRKSSDSRPLDQNDNRRFQSEEAWNRYIDNILDRRILPERNVKLYHSEFDEFKVELERRNLHKCLANLQERSIDVPVVKEFYANFYSPANQAPKCARIRGHLIRIDADNLNEFL

SEQ ID NO: 140794 - protein, 75 aa, Glycine max
  Coding DNA Sequence Number=SeqID_49109
MSVKNLVGRLGVHDKTNHTLARDQSGSQYFMRMLQPCGIDTGLKEHSNRVSPKAYTPKNPSGPLPPDSGPTQKTF

SEQ ID NO: 140795 - protein, 197 aa, Glycine max
  Coding DNA Sequence Number=SeqID_49110
  Homolog annotation: Hit_ID=UPI0000ECBAF8; Match level="QueryCoverage =20%, HitCoverage=48%, E-value=2e-16, Identity=100%"; Hit description= UPI0000ECBAF8 related cluster
ATLPEGRKPDRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTPAYTYAAGIATLNSQLRAHSMQAWHWPSFYNVVTGKTLALPNLIALQHIPLSPAGVIAKRPAPIALPNSCAA

SEQ ID NO: 140796 - protein, 101 aa, Glycine max
  Coding DNA Sequence Number=SeqID_49111
PLHAIKRSVLQIAKEWVRITIRYLRVSWVQNDQTWSLRAIGHDCVRMAKGMTKLGLCVPSDTTVSEWQRGADNHKNDQTLVSALSSGPPPLDDKRGADNHK

SEQ ID NO: 140797 - protein, 345 aa, Glycine max
  Coding DNA Sequence Number=SeqID_49112
  Homolog annotation: Hit_ID=Q84VH5; Match level="QueryCoverage=100%, HitCoverage=51%, E-value=1e-110, Identity=63%"; Hit description =Envelope-like protein
MATSPKETSASGSPSVPSSPHQEQPEFNIQPIQIIPGQASAPEKLAPRRQQGVKISENPSLATSPREVDPEMDKKIRSIVSSILKDAFVPDAEKDVPTSSTPSVSVPDAEKDVPTSSTPNAEVLPSPSEEESTDEEDQSTEETPAPRAPEPAPGDLIDLEEVESEEEPIANKLAPGIAERLQSRKGKTPLKRSGRIKTMAQKKSTPITPTTSRRSKVAIPSKKRKEISSSDSDDDVELDVSTSKRAKKSGKKVPENVPNAPLDNISFHSIGNAERWKFVYQRRLALERELGRAALDCKEIMDLIKAAGLLKTVTKLGDCYESLVREFIVNIPSDITNRKSDEYQK

SEQ ID NO: 140798 - protein, 280 aa, Glycine max
  Coding DNA Sequence Number=SeqID_49113
  Homolog annotation: Hit_ID=Q6WAY6; Match level="QueryCoverage=89%, HitCoverage=45%, E-value=3e-16, Identity=26%"; Hit description =Putative uncharacterized protein
GECGINSLASKEGASVNWFPRWKEGRTGVLISCRGFPNVPLMGTRGCISYNLVLAIRQLGYPMRGAPLEEEIVPVISRGFNKTNVETLWKVRKAWEVLQKKDKELRGSNNGPIGGYREWLKAHVQEEDEEAQALRTELKQAQTVKERFKSAALKIRKENAELRDVNMATTKALEQETKRARREEHGRNKFRGALWGSNSELKLRREERDQSRVDGLILKDELKACSRSKRSLSQRLCETETNMLAIITKYQEELSLATAHEHRVADEYAQVYAEKEARGR

SEQ ID NO: 140799 - protein, 167 aa, Glycine max
  Coding DNA Sequence Number=SeqID_49114
  Gene Ontology: Mol. function=chitin binding; Cellular component =extracellular region; Biological process=chitin metabolic process
  Homolog annotation: Hit_ID=UPI00006A17C9; Match level="QueryCoverage =59%, HitCoverage=98%, E-value=4e-09, Identity=32%"; Hit description =UPI00006A17C9 related cluster
MLLSSNVIYICVRVVMLVRMIRTRLFTAARMKSCPGGAQEPLKGNYWPLNRKCKSRPLKVRTHSPLKARACSPLKFKTCRLSKARECSPMMARTCNPLKVRTCSPLKVRACSPTKVKAHDPLTARTCSPLKLKARTYSPLEVRACSPLVVRTCSPLKARTCSPLTVR

SEQ ID NO: 140800 - protein, 176 aa, Glycine max
  Coding DNA Sequence Number=SeqID_49115
  Subcellular localization annotation: CTP_CleavageSite=34; ConfidenceScore=5.44e-01
RKGSSSTTTTVGHRRQGTSGDPPAPVPPSLSSPRSSTLFSLDDQRQRYYSQFCNRVILDPKYLDLEFFDEETFDCHQVFQNSALIDFMTLKLPYFPELVKVFYNNLKIQDGILYSEVHNIPIVIDQSLFYSLTKLPSQGAPFEGTLVDDWKFDYSTHDARRMVCNDQADMTGRLLA

SEQ ID NO: 140801 - protein, 73 aa, Glycine max
  Coding DNA Sequence Number=SeqID_49116
MASAVHVSSTYEFGATRSDCLVQFSNLAFFSETHECHCLALFMHPPPTSLEPREVIAYNCSQILHSQLLFGAP

SEQ ID NO: 140802 - protein, 57 aa, Glycine max
  Coding DNA Sequence Number=SeqID_49117
MASNRSSSWARGEGEGSRKRYAKEEGEGSRKSFNKLLGAPAILLGAPSISLIPLVTV

SEQ ID NO: 140803 - protein, 207 aa, Glycine max
  Coding DNA Sequence Number=SeqID_49118
  Subcellular localization annotation: CTP_CleavageSite=77; ConfidenceScore=5.24e-01
MTLHLQSCHTPLNAPQFSNLSVFCPLHIFTNQCVTSTFILHRPLLQQIFNVHSLNKKNTKTAQRMPSELSTDSTKTSTSSDSSTTTSKIEYPTHTNPLILQFTAVFHNDMDIIEVPTFYHQQWAPKYPEFVNFRYDGTIYQIRLRQHREKVYFAEGLKEFRKDLSIYESVIIKFLACSSKSMFDLYFVPSLECQTCGRPEVMSRQHI

SEQ ID NO: 140804 - protein, 67 aa, Glycine max
  Coding DNA Sequence Number=SeqID_49119
WLRNDELLKPKRRRKNPFVSLTILPFEGVFADFNRFGNGGTSQEKRGCAGISGKCDIYRAGRVVIDY

SEQ ID NO: 140805 - protein, 101 aa, Glycine max
  Coding DNA Sequence Number=SeqID_49120
KKEGVETRIVITERAGWTKSVSYLCFPLISDERPTWAFQILPPKGFCFWRKQPCSPGRAELAWASWVARGSAFLALLILSKFLRKIVSGKKIQAEALPLQR

SEQ ID NO: 140806 - protein, 108 aa, Glycine max
  Coding DNA Sequence Number=SeqID_49121
MVRASCVRVIPLWERMLVDLPGSYYGHLVGDEGRQEVFVRHWDRGEFWNRPQGKFLIVLEPTPKWALPTGRVVVGAGAWGASLWMGAGALGCTGAELEEFPARAEKLG

SEQ ID NO: 140807 - protein, 96 aa, Glycine max
  Coding DNA Sequence Number=SeqID_49122
MGEVEEVQEQMKADTEALKEKMATMMEAMMSIKEIVEVSAAYRTRARARVMGEVEEVQERMNADMEVKKEQMATMMEAMISMKKIMEANVVAVAAS

SEQ ID NO: 140808 - protein, 315 aa, Glycine max
  Coding DNA Sequence Number=SeqID_49123
  Gene Ontology: Mol. function=motor activity; Cellular component=cell projection
  Homolog annotation: Hit_ID=UPI00016621D1; Match level="QueryCoverage =72%, HitCoverage=40%, E-value=3e-16, Identity=31%"; Hit description =UPI00016621D1 related cluster
GLHVLTIRGLHALAFRGLHILTIRGLHALTFRGLHALTFRGLHALAFRGLHVIPIRGLHALTFKGLHVLTFRGLHVLAIRGGLQVLAFRGLYILAIIGLHALAFRGLHVLTFRGLHVLAIRELHALALGTSTLTFRGLHVLTFRGLYVLTIRGLHVLTFRGMHTLAFRELHALAFRGLHVLHIRGLQALTFRGLHALAFRGQHVLNFRGLHALAFRGLQVLAFRGLHALAFGGTKSAPSKTSKSSALNALPRLALPGEGPVISLYQSLGHPLILEGYQLCQHNQRGRLSRNYYAYQGKISSVPLQRDECRSCTPT

SEQ ID NO: 140809 - protein, 139 aa, Glycine max
  Coding DNA Sequence Number=SeqID_49124
MLQSIHQGQIILLQSLQVVAPPGSIPSIEQFLEREDGGPTTQVPKHVEDASSEATVPEPFIVEEEASETQVTSDPPTPVVDLSSPQHAADPSTPILEIPVDPTTPVLTMSTSPPATPVLHLTDEKGVQTQDTQDQSHEF

SEQ ID NO: 140810 - protein, 123 aa, Glycine max
  Coding DNA Sequence Number=SeqID_49125
  Subcellular localization annotation: CTP_CleavageSite=53; ConfidenceScore=5.28e-01
MAFMFLSAVPSCSVLRNWCVTQKHQPEHTSGARFPFGKPCQVRNCINESANARAMRRPLAYYAAGAKGVYTGLLCWVTVRVSSEVRSCGRKKLTASRICDTTHYSANSSLTDSYRSVVHAAAL

SEQ ID NO: 140811 - protein, 98 aa, Glycine max
  Coding DNA Sequence Number=SeqID_49126
MFLIFNTSALKGLDDAPQPKSKAAARWIVVKVHDLMYRQKGITKCGYYMMHWMSTIILGSFRNNWETYFNEVRPLEAERFKAFRIQWTQYYLKVRNQT

SEQ ID NO: 140812 - protein, 95 aa, Glycine max
  Coding DNA Sequence Number=SeqID_49127
MTPTHDALLYYNGRWNMPPQNKFVGYVFTGCTIDELKDLIKQVTPKWIPPHGIHESQTVRRLFFRQPGRFEYSDKVIKYEINELKTNDEVLKVLV

SEQ ID NO: 140813 - protein, 134 aa, Glycine max
  Coding DNA Sequence Number=SeqID_49128
  Homolog annotation: Hit_ID=Q5XM22; Match level="QueryCoverage=52%, HitCoverage=38%, E-value=6e-16, Identity=65%"; Hit description =Resistance-like protein HAAS-2
ETSSLHLLVGEVTITLDDVASLLHLPIIGAFHTFKPLHVNEAVLMLVELLEVSGEEARAETTQCAYLLHLLGCTLFANTSATHVHVVFLDTLRDLSQSGSYAWGDAALVHMYDHLNDAPKIGDQQFAGYITLLQ

SEQ ID NO: 140814 - protein, 205 aa, Glycine max
  Coding DNA Sequence Number=SeqID_49129
  Homolog annotation: Hit_ID=Q6UUU1; Match level="QueryCoverage=29%, HitCoverage=40%, E-value=1e-16, Identity=73%"; Hit description =Putative uncharacterized protein
GGHTNENAIHGAPKKGREWRVALSNHYAWLQTRRWRTHERKRNSWGSEKGLRMENCTKQSLRMAHQAYRYRRPRGGARYQLLFPLVRVNFELGVIMVIAVSFGKPVVPSALMNRPTRGERRFAYWALAECILAYYVGTDEGVSEVLHVGGKKRLHRCVSRICDTGDIPLPRSLNRYARSFDWGERKWLTNGAEISWKMPGRHLTG

SEQ ID NO: 140815 - protein, 60 aa, Glycine max
  Coding DNA Sequence Number=SeqID_49130
MVKARQKGVEDRRTTKTERRTMKNGEKREVVDAQLAQVSWVASTRRHHLLLEPPGRPKWA

SEQ ID NO: 140816 - protein, 116 aa, Glycine max
  Coding DNA Sequence Number=SeqID_49131
MAPKKFFAKRSRRDAAVEGTSAAPEFDSHCFRSTEHQQRFEAIKGWSFHRERRVQLRDDEYTDFQEEIARRRWTSLVTPMAKFDPDLVLEFYANAWPTEKGVRGHAVMGEGSMDSL

SEQ ID NO: 140817 - protein, 112 aa, Glycine max
  Coding DNA Sequence Number=SeqID_49132
MTRGDTLRLSAPFCHPEAAGPMTRRDKFGHSAPLCHLEAAGPMTRGDTLRLSAPFCHPKAAGPMTRRDKIWSFCTLVSSRGGGPDDARRYLTVIRTLLSSRAGGPDDMQRLT

SEQ ID NO: 140818 - protein, 205 aa, Glycine max
  Coding DNA Sequence Number=SeqID_49133
  Gene Ontology: Mol. function=aspartic-type endopeptidase activity; Cellular component=intracellular; Biological process=RNA-dependent DNA replication
  Homolog annotation: Hit_ID=Q0KIL1; Match level="QueryCoverage=100%, HitCoverage=23%, E-value=5e-09, Identity=25%"; Hit description =Gag/pol polyprotein, 3'-partial, putative
  Pfam annotation: Domain name=G-patch; Domain location=43-82; Score =24.3; E_value=0.00022; Accession=PF01585.14; Description=G-patch domain
MPYVEAAEESLETAFQSFEVVSISSVDSLFGQPCLSEAAVMMARVMLGNGYEPGMGLGKDNGGITSLIKTQGNRGKYGLGYKPTQADMKRSIAGRKNSGQSSRWKQESEGNPPCHISRSFISAGLGDEGQVVAICEDDVPSTLDLVRPCPPDFQLGNWRVEERPGIYATSIISDDESPEGTESWDPSIDFEQEMNQTVDEGDEYE

SEQ ID NO: 140819 - protein, 35 aa, Glycine max
  Coding DNA Sequence Number=SeqID_49134
LYEGSIYRAGGEGRRASSKSLSEEVGAMHDGREKT

SEQ ID NO: 140820 - protein, 55 aa, Glycine max
  Coding DNA Sequence Number=SeqID_49135
SFGSQVLQGKVANEPQLFVVSGAVAVVAAGLWRAIRPSKVGMIPPLGLYLLLERS

SEQ ID NO: 140821 - protein, 17 aa, Glycine max
  Coding DNA Sequence Number=SeqID_49136
MDDMEPRLVTCNHKTRG

SEQ ID NO: 140822 - protein, 368 aa, Glycine max
  Coding DNA Sequence Number=SeqID_49137
MKVKGDGHEKVVAVVAKISNKPRTPVVSVREERASIQEDIWFSMYQRRQVNQVVTAKRTWFVPRVLLLNHSAAFLLKNSASSGSMKLVFELVLDIGCKMVEMLYVGIADIENAHSWFYPLGEESPGSVLVAVCGETREWKPEAKQEIAEDFLNQFNLRDSGFVMPFMMRLVILDGKPKSHEVFMRNPQQLGHKLFRSHDIAHTCFEMTVQKLIGLKSMMDVGESDLGMRTTTVSAIWVGTLPDVKVSPIMCQISSPVCIFDFPFRDRSSKRGGYMIINLGDMLYGQQAWISAPGISNEQACDFISSPLNNGLGMEELDIAKDIFDEGDRFISKLLELMQGIATGIGPSLHHNIFIFWVSEAKEDTFKE

SEQ ID NO: 140823 - protein, 478 aa, Glycine max
  Coding DNA Sequence Number=SeqID_49138
  Gene Ontology: Mol. function=protein binding; Cellular component=SCF ubiquitin ligase complex
  Homolog annotation: Hit_ID=A2ZD70; Match level="QueryCoverage=99%, HitCoverage=96%, E-value=4e-83, Identity=38%"; Hit description =Putative uncharacterized protein
  Pfam annotation: Domain name=DUF525; Domain location=321-474; Score =24.0; E_value=1.7e-08; Accession=PF04379.5; Description=Protein of unknown function (DUF525)
  Pfam annotation: Domain name=F-box; Domain location=1-48; Score=28.4; E_value=2.7e-05; Accession=PF00646.24; Description=F-box domain
  Pfam module annotation: Pfam domain module=DUF525::F-box; Domain location=321-474::1-48
MGLESVGDLAIHVILSKLGAQDTARVACVSKRFCSSASDDTLWINHCFHELALTQPLDHLGNPLSSFKQKTLDDRHIVYAKVQMMFLECYQAWRGAFVMYPWSLVKRVKRCWDKIKTWLTNNFPEAEATLCKGATEADIQELENVLKVKLPLPSRILYRFHNGQEIAKADPETTTYGSSLGLIGGYSFYSHLVNVYLLPIRQIILETKQTRRHLSFLRRSKYVLVAASSTYSRKLFFLNCTNGQLYVGTRDLLTEGDIIPCVPHDLINLHQELNISEQQDAMLLWLEEHGRRLEHGFIKLHDKGNGKSINLFPEEPPLCSMAVTNGVKVRASALVIPELIDLQDDLEKYLFAYSIRLSLEPQGCTINGMSFSSCQLHWRHWIIRANDIVISDVNGEAVIGQVLKNLSIRVACIYQHHQVPLKVLLHLYPADTWWNLWDEMKIQWEKISDRWFRLADPKGDPFLATVARFPLQLPDYIF

SEQ ID NO: 140824 - protein, 598 aa, Glycine max
  Coding DNA Sequence Number=SeqID_49139
  Homolog annotation: Hit_ID=A5AIH8; Match level="QueryCoverage=71%, HitCoverage=57%, E-value=1e-132, Identity=60%"; Hit description =Putative uncharacterized protein
  Pfam annotation: Domain name=DUF936; Domain location=1-598; Score =168.7; E_value=1.5e-47; Accession=PF06075.3; Description=Plant protein of unknown function (DUF936)
MANLVPGVLLKLMQHMNTDVKVAGEHRSSLLQVVSIVPALAGGELFPNQGFYLKVSDSLHATYVSLPDEHDDLILSDKIQLGQFVFVDRLEAASPVPILHGVRPVPGRHPCVGTPEDIVATTHSLGFLSNGKASKKSACSGPLDLERSKSPRKVLSNHHVGEKEKKEKVRLNNEDQLDKKAMLFAKSKSQTTKAAAANVVDVKKEPLARLKSLNSRTIPSSPTSCYSLPTSFEKFANGVKQQANIKGVDRLTAKVGVVEIGKGVRGASPTGKRISVGNPIRNLVQGIELGAKALRKSWEGNMEIKKKDTSKLRAAKCDPKPEVRSSTPRRSTSSEKFPSKEESKMQPQTKSFKEDHENQSSIKRVIANGTMEEQEKPSKQRVSVGKRSSEASNNGFPENLVKVSPSSRKVTDASVQWASLPSSIAKLGRLRASLGITVRLLPYDLKLKVMGLTLGNNLLLCTDKAVYIYPPPPPRPIRWEPYTLGCLYVFEFGYIMRNCSEHNFLYLFSFCLLACPQLSIKVMMEREVMKQRDAAQMAATEAIQEAAAAESLLQCLRYECIHMNNFTMDFSMSDQYFPSLVFLNMVEILDCSCQEVGI

SEQ ID NO: 140825 - protein, 218 aa, Glycine max
  Coding DNA Sequence Number=SeqID_49140
  Gene Ontology: Cellular component=chloroplast; Biological process =response to stress
  Homolog annotation: Hit_ID=Q03943; Match level="QueryCoverage=99%, HitCoverage=56%, E-value=2e-76, Identity=73%"; Hit description =Membrane-associated 30 kDa protein, chloroplast precursor
  Pfam annotation: Domain name=PspA_IM30; Domain location=65-217; Score= 12.8; E_value=4.9e-06; Accession=PF04012.3; Description=PspAIM30 family
  Subcellular localization annotation: CTP_CleavageSite=46; ConfidenceScore=5.75e-01
MAAKLQIFTGLPPAPFQSSSSTLCVLKKPLTTSFFGTARVEVLKLRVMRIAKPARGGGALGARMNLFDRFARVVKSYANAVLSSFEDPEKILEQAVLEMNDDLTKMRQATAQVLASQKRLENKYKAAQQASEEWYRKAQLALQKGEEDLAREALKRRKSYALKLLESLDDDTTDFTVADSLKCFHMYISTHDNASSLKAQLDQQKTVVENLVSNTRQK

SEQ ID NO: 140826 - protein, 88 aa, Glycine max
  Coding DNA Sequence Number=SeqID_49141
  Subcellular localization annotation: CTP_CleavageSite=22; ConfidenceScore=5.24e-01
MTSISQAIISQSSNSDKFGAVPAKDEGRKSQILRSQCQIPVKMTILGVFSSPTSTETTIRHLISLYQFQLLIQVKKHQLQIPTKFQPS

SEQ ID NO: 140827 - protein, 244 aa, Glycine max
  Coding DNA Sequence Number=SeqID_49142
  Homolog annotation: Hit_ID=A7P9A7; Match level="QueryCoverage=86%, HitCoverage=95%, E-value=3e-73, Identity=63%"; Hit description =Chromosome chr3 scaffold_8, whole genome shotgun sequence
MDEVFAMSKMRKADLVKRVVIIAVMAIADAADTNDVYSPCLDAKVQRGDGFTFGIAFSDKEFFSQGNGPQLSPCDKRLDLANKGAQLSVFRPTVDEISLLTINRSIVNAGKDAYMVAFAGQKYAARSLPIMFADNSHTITSFTLVLEFQEGTLQNLYWKSFGCNACPSGSICLNNQDCAVPNTECQKNGGSACNLGIQLAFSGTDKNLDALNSWYEAQNLRQYSLYGLFSNLRDSIIGPYENLF

SEQ ID NO: 140828 - protein, 327 aa, Glycine max
  Coding DNA Sequence Number=SeqID_49143
  Gene Ontology: Mol. function=DNA binding; Biological process =regulation of transcription, DNA-dependent
  Homolog annotation: Hit_ID=A7NTN5; Match level="QueryCoverage=91%, HitCoverage=94%, E-value=9e-25, Identity=26%"; Hit description =Chromosome chr18 scaffold_1, whole genome shotgun sequence
  Pfam annotation: Domain name=B3; Domain location=21-111; Score=42.1; E_value=2e-09; Accession=PF02362.12; Description=B3 DNA binding domain
  Pfam annotation: Domain name=B3; Domain location=228-326; Score=47.6; E_value=4.3e-11; Accession=PF02362.12; Description=B3 DNA binding domain
  Pfam module annotation: Pfam domain module=B3::B3; Domain location=21- 111::228-326
MGDFSLHENNMDYHQDNPAVFFTIINNTKLLKVPEEFLKHLNEDLSSNAVLIGPSGDKWQVTILKKGNNVYMNNGWSQFLKDNSVVLDEFLLFTYHGGNCFYVQIFCGNGLERLCLKETRQEQAVTPQFLDLTFSNKALISDGCEIKKTSQEQASTPSLVRITNKSKQRKTSAGSFLHHESKSSCQEDLPFSNKALLSKDFPKPLSSIKFETSEACKLAESFTSRNPHWKHLMTKCNVEDHCTLHIATQFACKYIPEVVKQIILWNSEGKFWEVEVTCLRYQNKRYTRFTTGWGKFVRDNKLMKGDTCIFELEDENHMSVHIFRTSV

SEQ ID NO: 140829 - protein, 1133 aa, Glycine max
  Coding DNA Sequence Number=SeqID_49144
  Gene Ontology: Mol. function=nucleotide binding; Cellular component =nucleolus; Biological process=ribosome biogenesis and assembly
  Homolog annotation: Hit_ID=O94653; Match level="QueryCoverage=90%, HitCoverage=91%, E-value=0.0, Identity=38%"; Hit description =Ribosome biogenesis protein BMS1 homolog
  Pfam annotation: Domain name=AARP2CN; Domain location=239-325; Score =166.2; E_value=9e-47; Accession=PF08142.3; Description=AARP2CN (NUC121) domain
  Pfam annotation: Domain name=DUF663; Domain location=667-964; Score =293.2; E_value=5e-85; Accession=PF04950.3; Description=Protein of unknown function (DUF663)
  Pfam annotation: Domain name=GTP_EFTU; Domain location=88-275; Score=- 71.8; E_value=0.0083; Accession=PF00009.18; Description=Elongation factor Tu GTP binding domain
  Pfam annotation: Domain name=MMR_HSR1; Domain location=91-195; Score=- 9.6; E_value=0.008; Accession=PF01926.14; Description=GTPase of unknown function
  Pfam annotation: Domain name=Miro; Domain location=92-195; Score= -10.7; E_value=0.099; Accession=PF08477.4; Description=Miro-like protein
  Pfam module annotation: Pfam domain module=AARP2CN::DUF663::GTP _EFTU::MMR_HSR1::Miro; Domain location=239-325::667-964::88-275::91 -195::92-195
  Subcellular localization annotation: CTP_CleavageSite=16; ConfidenceScore=5.06e-01
MAVNDADQSNKSHRTRQSGAKTNKKKKTKKKQKQNPDDAGGLEDPKNRNPKAFAFTSSNKAKRLQSRAVEKEQRRLHVPVIDRSYDEPAPYVVVVQGPPQVGKSLLIKSLVKHYTKHNLPDVRGPITIVSGKQRRVQFVECPNDINGMIDAAKFADLALLLIDGSYGFEMETFEFLNILQVHGFPKVMGVLTHLDKFKDAKKLRKTKQRLKHRFWTEIYDGAKLFYLSGLIHGKYVKREVHNLARFISVMKFHPLSWRTSHPYVMVDRFEDITPPEKVHANNKCDRKVTLYGYLRGCNLKMGNKVHIAGVGDYSLAVVTALPDPCPLPSAAKKKGLRDKEKLFYAPMSGLGDLLYDKDAVYININDHLVQFSKVDENSAMTSKGKGGDIGEDLVKSLQNIKYSINEKLENSFINIFGQKTNVSSEALGDAHGTNKEVEPNGKTEALDKYQPGAVITGEDNNKMDLDGSESSDQDEDDATDREPSGSDDDDKDAPNSNASNGVHLQEHIEFHDGRQRRRAIFGNDVDQNDLMDSEGDDDGDTSDDDVESSEEEEEDDNDNDDTNGAQNVRDGLNDDGMVNTEDCSKCTQFVDQRWDENDNEEIRNRFVTGNLAKAALRNALPAANTEEENDDVYGDFEDLETGEKHENHQTDDALAATTHKGDDLEAEERRLKKLALRAKKILVMKMKTSSVVVKLMKLKEEIELQKQMNIAELNDLDEATRLEIEGFRTGTYLRLEIHDVPCEMVEYFDPYHPILVGGIGIGEENVGYMQARLKRHRWHKKVLKTRDPIIVSVGWRRYQTTPIYAIEDSNGRDRMLKYTPEHMHCLAMFWGPLAPPNTGVVAFQNLSNNQATFRITATAVVLEFNHAARIVKKIKLVGYPCKIFKKTALIKDMFTSDLEVARFEGAAIRTVSGIRGQVKKAAKEEIGNQAKRKGGQTKEGIARCTFEDKILMSDIVFLRAWTQVEVPQFYNPLTTALQPRDMTWKGMKTVAELRREHNLAIPVNKDSLYKKIERKPRKFNPVVIPKSLQASLPFASKPKDISKRKKPLLEERRARGVVMEPRERKVHTLVQHLQLIDREKMKKRKLKEENKRKALEAESAKEELLLRKRRREERRDKYRKEDKQNKKIRRAEV

SEQ ID NO: 140830 - protein, 105 aa, Glycine max
  Coding DNA Sequence Number=SeqID_49145
  Homolog annotation: Hit_ID=A7P977; Match level="QueryCoverage=53%, HitCoverage=19%, E-value=1e-18, Identity=73%"; Hit description =Chromosome chr3 scaffold_8, whole genome shotgun sequence
MGSERVGYLDDPNVLPCVGNDAYGPFPQGDLALPLEAYDSPSNALTIIQQRSPVVKSIAFVYFPVEHHASCPSNQKLPKAVHISVVVGLLLPSKMEGKNSRMCFI

SEQ ID NO: 140831 - protein, 692 aa, Glycine max
  Coding DNA Sequence Number=SeqID_49146
  Gene Ontology: Mol. function=binding; Cellular component=nucleus; Biological process=metabolic process
  Homolog annotation: Hit_ID=A7P944; Match level="QueryCoverage=94%, HitCoverage=80%, E-value=0.0, Identity=48%"; Hit description =Chromosome chr3 scaffold_8, whole genome shotgun sequence
  Pfam annotation: Domain name=PPR; Domain location=165-199; Score=8.8; E_value=0.71; Accession=PF01535.11; Description=PPR repeat
  Pfam annotation: Domain name=PPR; Domain location=229-263; Score =45.2; E_value=2.4e-10; Accession=PF01535.11; Description=PPR repeat
  Pfam annotation: Domain name=PPR; Domain location=30-64; Score=19.8; E_value=0.01; Accession=PF01535.11; Description=PPR repeat
  Pfam annotation: Domain name=PPR; Domain location=330-364; Score =16.4; E_value=0.088; Accession=PF01535.11; Description=PPR repeat
  Pfam annotation: Domain name=PPR; Domain location=465-499; Score =42.6; E_value=1.4e-09; Accession=PF01535.11; Description=PPR repeat
  Pfam annotation: Domain name=PPR; Domain location=500-534; Score =18.1; E_value=0.032; Accession=PF01535.11; Description=PPR repeat
  Pfam annotation: Domain name=PPR; Domain location=535-568; Score=4.7; E_value=2.1; Accession=PF01535.11; Description=PPR repeat
  Pfam module annotation: Pfam domain module=PPR::PPR::PPR::PPR::PPR::PP R::PPR; Domain location=165-199::229-263::30-64::330-364::465 -499::500-534::535-568
MAIRSLRVRDAMVYLDHVQAIKSGLVSSIFTCNQLIHLYSNHGLLQEAHKLFDEMPHPNVFSWNAIIMAYIKAHNLTQARALFDSASHRDLVSYNSLLSAYVGSDGYETEALDLFTRMQSARDTIGIDEITLTNMLNLAAKLRVLCYGKQMHSYMVKTANDLSKFALSSLIDMYSKCGCFQEACNLFGSCDEMVDLVSKNAMVAACCREGKMDMALNVFWKNPELKDTVSWNTLIAGYSQNGYMEKSLTFFVEMIENGIDFNEHTLASVLNACSALKCSKLGKSVHAWVLKKGYSSNQFISSGVVDFYSKCGNIRYAELVYAKIGIKSPFAVASLIAAYSSQGNMTEAQRLFDSLLERNSVVWTALCSGYVKSQQCEAVFKLFREFRTKEALVPDAMIIVSILGACAIQADLSLGKQIHAYILRMRFKVDKKLLSSLVDMYSKCGNVAYAEKLFRLVTDSDRDAILYNVIIAGYAHHGFENKAIELFQEMLNKSVKPDAVTFVALLSACRHRGLVELGEQFFMSMEHYNVLPEIYHYACMVDMYGRANQLEKAVEFMRKIPIKIDATIWGAFLNACQMSSDAALVKQAEEELLKVEADNGSRYVQLANAYAAKGKWDEMGRIRKKMRGHEAKKLAGCSWIYVENGIHVFTSGDRSHSKAEAVYSTLTCLNGKLYLSFKEQKQLYEIQSDVDC

SEQ ID NO: 140832 - protein, 424 aa, Glycine max
  Coding DNA Sequence Number=SeqID_49147
  Gene Ontology: Mol. function=metal ion binding; Cellular component =integral to membrane; Biological process=ubiquitin cycle
  Homolog annotation: Hit_ID=Q67YI6; Match level="QueryCoverage=91%, HitCoverage=95%, E-value=2e-67, Identity=43%"; Hit description=RING -H2 finger protein ATL3G
  Pfam annotation: Domain name=PHD; Domain location=136-181; Score= -5.9; E_value=0.064; Accession=PF00628.20; Description=PHD-finger
  Pfam annotation: Domain name=zf-C3HC4; Domain location=137-178; Score= 36.5; E_value=9.3e-08; Accession=PF00097.16; Description=Zinc finger, C3HC4 type (RING finger)
  Pfam module annotation: Pfam domain module=PHD::zf-C3HC4; Domain location=136-181::137-178
  Subcellular localization annotation: CTP_CleavageSite=61; ConfidenceScore=5.85e-01
MAPSQPPHWAPSPSLTPTPILHKSFFPPPSNSPAVDFSPPLIAMVVVVAAAFLVVTYSRLIARHLRPPIHRLLRRFRRRRFLPSSVGDLESLPYESPFDGPHVFSPYGLDETVIKTIPFSLYTAKYDARFDESRNDCAVCLLEFEDDDYVRTLPICSHTFHVDCIDAWLRSHANCPLCRAGVLCTDSPFTPMMAARIRPSFDDDTILHRISIDPLIDPPLLPAAAISSVPEITPCVDENSPRRNQNHANVNSEDCFRDFLLKRSYSFGFERSLASERMVMEPATASPWRYRRGSSSFWSKRPSPFGSLGKPRVFSFRYYRGMKSPFFRRRGFFPLSESSVRYGGGGGGGGSSSRRSKSIASPMFLRSSGVTSAAAFSSSRLRCGDPEALLSPERFNGRGLIGDGWRDEEEHLIGERTKTFHAEK

SEQ ID NO: 140833 - protein, 230 aa, Glycine max
  Coding DNA Sequence Number=SeqID_49148
  Gene Ontology: Mol. function=methyltransferase activity; Cellular component=cytoplasmic vesicle membrane; Biological process=metabolic process
  Homolog annotation: Hit_ID=A7P958; Match level="QueryCoverage=71%, HitCoverage=63%, E-value=1e-69, Identity=73%"; Hit description =Chromosome chr3 scaffold_8, whole genome shotgun sequence
  Pfam annotation: Domain name=Methyltransf_11; Domain location=53-165; Score=60.3; E_value=6.6e-15; Accession=PF08241.3; Description =Methyltransferase domain
  Pfam annotation: Domain name=Methyltransf_12; Domain location=53-163; Score=30.3; E_value=7.1e-06; Accession=PF08242.3; Description =Methyltransferase domain
  Pfam annotation: Domain name=Ubie_methyltran; Domain location=21-203; Score=-148.1; E_value=0.09; Accession=PF01209.9; Description=ubiECOQ5 methyltransferase family
  Pfam module annotation: Pfam domain module=Methyltransf _11::Methyltransf_12::Ubie_methyltran; Domain location=53-165::53 -163::21-203
MEDTPTPSTALTYLNPSYWDERFSKEEQYEWFKDYSHFRHLIQPHLTPHSAVLELGCGNSQMCEQLHKDGTTNITCIDLSPVAVQNMQKRLLSRGFKDIKVLQADMLELPFEDECFDLVIEKGTMDVLFVDSGDPWNPKPETIFKVMATLKGVHRVLKAGGTFISVTFGQVSKIVRCVVSLLMSIAVIDSNLSKIHASHISGALYLMHQISTGLLSGLLLVKPFTILSMF

SEQ ID NO: 140834 - protein, 95 aa, Glycine max
  Coding DNA Sequence Number=SeqID_49149
MALPEVVRSDILFVFIITRQAVSVCVLIHTDHMQVGLRLLLSPVTSNLLLRTACCSIGLALPVYSTFKAIENNDPYEQQRFYLRHYDLTSCPLLM

SEQ ID NO: 140835 - protein, 271 aa, Glycine max
  Coding DNA Sequence Number=SeqID_49150
  Gene Ontology: Mol. function=oxidoreductase activity; Cellular component=flagellum; Biological process=negative regulation of transcription
  Homolog annotation: Hit_ID=A7P948; Match level="QueryCoverage=92%, HitCoverage=96%, E-value=6e-87, Identity=67%"; Hit description =Chromosome chr3 scaffold_8, whole genome shotgun sequence
  Pfam annotation: Domain name=FMN_red; Domain location=55-239; Score= -30.9; E_value=0.0075; Accession=PF03358.6; Description=NADPH -dependent FMN reductase
  Pfam annotation: Domain name=Flavodoxin_1; Domain location=59-191; Score=60.2; E_value=7.2e-15; Accession=PF00258.16; Description =Flavodoxin
  Pfam module annotation: Pfam domain module=FMN_red::Flavodoxin_1; Domain location=55-239::59-191
MGKGGGCFPSKTKAPISGAEKDPIIVESLIPTNDRSSTSQEVEAPAPAPAAVKKLKIFIVFYSTYGHVESLARSLKKGVDSIEGVEGVLYRVLETLPKEVLELMKAPEKDETVPLISEDKLVEADGLLFGFPTRYGSMAAQMKVFFDSTGQLWREQKLAGVPAGFFVSTGTQGGGQETTAWTAITQLVHHGMLYVPIGYTFGAGMFEMDSVRGGSPYGAGVFAGDGSRQASETELALAEYQGKYMATIVKKNCWLRLIGFKQHSSVQLAHD

SEQ ID NO: 140836 - protein, 147 aa, Glycine max
  Coding DNA Sequence Number=SeqID_49151
  Homolog annotation: Hit_ID=Q45NM4; Match level="QueryCoverage=56%, HitCoverage=73%, E-value=5e-17, Identity=39%"; Hit description=BURP domain-containing protein
  Pfam annotation: Domain name=BURP; Domain location=1-98; Score=-59.6; E_value=7.6e-05; Accession=PF03181.6; Description=BURP domain
MRRTLEQCEAKPTKGETKTCATSLESMLQFVAAIIGSEAKYNILTSAENGDNKIETLGVCHLDTSDWNPNHIIFTRLGIKPGKAPVNLSSDDYVPFVELSFYVCLACALFYPQTELIEQYREETVMNLLKAQSTVSVAGGGQGSNNS

SEQ ID NO: 140837 - protein, 235 aa, Glycine max
  Coding DNA Sequence Number=SeqID_49152
MKLQMLFLFMMRLNIRSEIGFKASCRLRMLSLFMMRLNIRSEIGLITSCKCSQNTCNDIEYLQNFILKESKKLKRGRKRYIMNSIITVLYFNGRVFEDNDGVIFEGRKYVALQICDDEDVETMIESFQQQQQMSVLELYVEKDVAGGSMFHAANSVTSCGRNVSHYESELPKNISNLHVDEDDDDDDDDYLASNSYVEESFDEDDSDDGISHTDDEVTDIVEPVSIVHPSEGKCL

SEQ ID NO: 140838 - protein, 100 aa, Glycine max
  Coding DNA Sequence Number=SeqID_49153
  Subcellular localization annotation: CTP_CleavageSite=28; ConfidenceScore=5.04e-01
MSEITDTLKLLDFTWPGRAAVVVPPHARALLAWRACDSGSSTSCVSSRLALICSFPWMIARFNDNSITQNNVVLKICKDHPRRLGNSKLRRGRSENENGG

SEQ ID NO: 140839 - protein, 40 aa, Glycine max
  Coding DNA Sequence Number=SeqID_49154
MAGGDIVVLYTKNEGILSKKWQQKGRERRNSEVGPAQQWR

SEQ ID NO: 140840 - protein, 132 aa, Glycine max
  Coding DNA Sequence Number=SeqID_49155
  Gene Ontology: Mol. function=protein serine/threonine kinase activity; Biological process=protein amino acid phosphorylation
  Homolog annotation: Hit_ID=Q9LX30; Match level="QueryCoverage=84%, HitCoverage=8%, E-value=6e-27, Identity=58%"; Hit description =Probable serine/threonine-protein kinase GCN2
  Pfam annotation: Domain name=RWD; Domain location=32-132; Score=-5.2; E_value=0.085; Accession=PF05773.13; Description=RWD domain
SKKKKRGGGGSGRRSKGRTQSKDHASQFGADDYDQLSEDITALCAIFEEDCKVLPGSPPRVVIKLSLTKDMGYEDLDVSAVLAIRQLNHCLFLFLVRCLPGYPFKCPKLQITPEKGLSEADAKKLLSLFQDL

SEQ ID NO: 140841 - protein, 277 aa, Glycine max
  Coding DNA Sequence Number=SeqID_49156
MAPRKLSSKRSRKDAAASGTSAAPEFDSHRFRSAEHQQRFEAIKGWSFHRERRVQLRDDKYTDFQEEIARRRWTSLVTPMAKFDPDIVLEFYANAWPTEEGVRDLRSSVRGQWIPFDADALSQFLGYPLVLVGGFQGVRIRSEKEPGRMDLMRRPLAQLLCIPGQDFARTATGRWVRIMRTNMTALTQTWMTLLLSNILPSDHNSDLPLPMCQLVYAILTRMSVHVAQLIPDAIYLFVGMPPTRNPLDPDKSNRALGFPALITGLCQSFGVPVTLSK

SEQ ID NO: 140842 - protein, 400 aa, Glycine max
  Coding DNA Sequence Number=SeqID_49157
  Homolog annotation: Hit_ID=Q6WAY6; Match level="QueryCoverage=89%, HitCoverage=62%, E-value=5e-26, Identity=26%"; Hit description =Putative uncharacterized protein
MDMVNQEEWVPFMDVLALLIFGVVLFPNVDGLVDLAAIDAFLAYHNHKESPIVAMLADLYDTFDRRCEKSNTRIVCCTLALYVRLVSHLFRQEVRHACPLEGHRSCTEKGGANWDQLLANKEGASINWFPRWKEGRTGVLVSCGGFLNVPLIGTRGCIDYNPILAIRQLGYLMRGAPLEEELALVISRGFNETNVETLRKVRKAWEVVQKKDKELRGSNNGPIGGYCEWLKAHVQGLDWLPSLRTAKREEVEAPEEDEDVQALRTELKQAQVVKERFKSAALKIRKENAELRDINIATTKALEQETKRARREEHGRNKFRGALWGSNSELKLRREERDQSRVDSLILKDELKVCSRSKRNLSQRLCETETHMFSHRQQVPRRIKSSHSPTSTKWADEYAR

SEQ ID NO: 140843 - protein, 194 aa, Glycine max
  Coding DNA Sequence Number=SeqID_49158
MEGGAVNAVESDRPRRSKPLRDVASPRRFIFEALQKGVKEERSSTYACSSWMVYLVIYFTKGTASQKPGHPLAAKPVPFPYQNSHAVPWRYTPPRGKEEEATDVSSLSAKVTNITGLSGVTRSGRVFAPPDLPVQPANVKGKAKVVEEQDDEIPLASNKDIPAKGLPEKKDGKKEVSLEEASEFLRIIQQSEFK

SEQ ID NO: 140844 - protein, 142 aa, Glycine max
  Coding DNA Sequence Number=SeqID_49159
MARAGDNGGVYHQLDESQRLFLDAWTTQMQRLLNRNKEEPYRRIAKSSSFTLKPLSLREVCDDQIRMREKREQEKEIVRHHKGIWKRRVIHLRKRVIHIRERVIHMRENLIILQRRVKNLKMSFLKEIPHGLPPFKRHRTSS

SEQ ID NO: 140845 - protein, 185 aa, Glycine max
  Coding DNA Sequence Number=SeqID_49160
MKDKRDAEEKLENQKKKKDSMALSSKAKGKEKEEKDSSKKIVKKENHCDKMEISLSTAIPLKLEVIPQVKELLDEGLVRKSLNPCALLVPKISIMGHQIPMIGGMMNMLSGATLFCKITHAPKIFMICVHGDSLGRNNQHENKEKGMFYSITFLNFLNSDQGLPMDPKRIKVLRKESMSFKNPRI

SEQ ID NO: 140846 - protein, 141 aa, Glycine max
  Coding DNA Sequence Number=SeqID_49161
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=9e-25, Identity=55%"; Hit description =Putative uncharacterized protein
  Subcellular localization annotation: CTP_CleavageSite=14; ConfidenceScore=5.35e-01
MTMITPSSKLTLTKGNKSWNRCRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVQEELLP

SEQ ID NO: 140847 - protein, 91 aa, Glycine max
  Coding DNA Sequence Number=SeqID_49162
AEEGRRCGFQNHMFRNVSSLSEHQDKEDWYLDRAEKPSHSGVKGIQCHECEPMDTSKLNVRPFGDLKKITGMGKLVHDGLRYMIKGLQIWG

SEQ ID NO: 140848 - protein, 131 aa, Glycine max
  Coding DNA Sequence Number=SeqID_49163
  Subcellular localization annotation: CTP_CleavageSite=77; ConfidenceScore=5.13e-01
KWPRGSWPQRDLGRIKRLKEPVPLSNMTATALGALNTSSASRPSRDGHFSGSDASSSGTTRRARYEVWVRGQWIPFDADAIGQLLGYPLVLEEGFCPDCCRETGADHAHQHDHPDSDLDDFAAQQHPAQRP

SEQ ID NO: 140849 - protein, 82 aa, Glycine max
  Coding DNA Sequence Number=SeqID_49164
DQGVPTNTKRIKVIPEWPTLPSIRKIWGFNDLTNFYKRCGEGTMQSYPPRALDRRPQEDWARDAREGPRVLMSLRVDFGPMG

SEQ ID NO: 140850 - protein, 147 aa, Glycine max
  Coding DNA Sequence Number=SeqID_49165
MTGRLLAGSFSFESRILHYLIVRILLPRSSNLAQVSEEDLIVMWAFHKGASVIASFGYVKEHDGSWIKKGAKNVGEEGHEGEDSSLLSKILERFDGLQTFVGERFDTLELQVDMRFNEMESRMTKVEEDVSYIRSSFDLPPPPPPSS

SEQ ID NO: 140851 - protein, 109 aa, Glycine max
  Coding DNA Sequence Number=SeqID_49166
MGRIKEFLDCVVLNSLTREKGDTKEFRRLVPCSFGKERRKTQKEFRRLVLGEFFLPKGEENEKMNSTSFQGLENQKTSESFWYKEEEEVQRDSRLVKDCMRLLERLEND

SEQ ID NO: 140852 - protein, 221 aa, Glycine max
  Coding DNA Sequence Number=SeqID_49167
  Homolog annotation: Hit_ID=Q2HW90; Match level="QueryCoverage=33%, HitCoverage=14%, E-value=8e-09, Identity=42%"; Hit description =Putative uncharacterized protein
MGSSRKPSLKKRFYQVKIKSLEVTSLRKLVPLIPPPSTASLLQKPMELDRQRQVENGVVGIPRKCLEAKARILAGRNEWAPFIDVLALLIFGGVLFSNVDGLVDLAAIDAFLAYHNHKESPVVAMLADLYDMFDRGCEKSSARIVCCALALYVWLVSHLFLQEGRPVYPLQGHRSCVEKGKANWDQLLASMEGRLLIGSLARRKEESGLYLHAKDVQMFPG

SEQ ID NO: 140853 - protein, 78 aa, Glycine max
  Coding DNA Sequence Number=SeqID_49168
  Subcellular localization annotation: CTP_CleavageSite=15; ConfidenceScore=5.04e-01
MKNGGKPSRNRPQKRLGSVTEAPRLGFSSRKQFFSLILREKREVVAAQLAQASWVAAFWWNILEGPSGPDCYLHTHVY

SEQ ID NO: 140854 - protein, 76 aa, Glycine max
  Coding DNA Sequence Number=SeqID_49169
  Subcellular localization annotation: CTP_CleavageSite=46; ConfidenceScore=5.16e-01
HNEGKPNKGVSHGKTLHKIKWPNSLKTVESPTVATYPSAGGRRVTRGMRVPQKEYARSRHQRLFEENVGKTGKDAI

SEQ ID NO: 140855 - protein, 224 aa, Glycine max
  Coding DNA Sequence Number=SeqID_49170
  Gene Ontology: Mol. function=motor activity; Cellular component=cell projection
  Homolog annotation: Hit_ID=UPI00016621D1; Match level="QueryCoverage =98%, HitCoverage=40%, E-value=9e-21, Identity=35%"; Hit description =UPI00016621D1 related cluster
GLHVLAFNGLQVLAFRGLHVLAFGGLHVLPSRGLHALAFRGLHVFAFIGLHVLTFRGLHVLAFRGLHVLPPRGLHALTFRGLHVLAFRGLHVLTFRGLHVLTFREMYVFTFRGLRALAFRGLHALAITRLHALTFRGLHSLTFRGLQALAFRGLHVLTLRGLHVLAFRGLHDLTFRGLHVLAFRGLHVLPFKGLHVLALRERHVLAFRGLHALTFRGLHVLTIS

SEQ ID NO: 140856 - protein, 95 aa, Glycine max
  Coding DNA Sequence Number=SeqID_49171
MLSFDFWHVTKLHVLRNNGCQVPQSGQAKVACHHMVPGRKLGYDTCRNLPFGERARRDSRMRVPRKEYARSRHQRLFEENVGKTGKTRSTNFLVK

SEQ ID NO: 140857 - protein, 238 aa, Glycine max
  Coding DNA Sequence Number=SeqID_49172
MAKFDPDIVLEFYANAWPTEEGVRDMRSWEGQKCEYSQRRNRADGFDEKAIAQLLCIPGQDFARAAAGRRVRIMRTSMTTLTQTWMTLLLSNILPSDHNSDLPLLKCQLVYAILTRMSVHVAQLIADAIYLFAGMPPTRHPLDPDKSNKALGFPALITGLWQSFGAAVTPSKVIQPPITRAFIERYCTSRQAQGGAPQAPDASPPPHQLIQLGHLTQSGIYDIWFASSGQPQGAGADP

SEQ ID NO: 140858 - protein, 197 aa, Glycine max
  Coding DNA Sequence Number=SeqID_49173
MVCTNQADMTGRLLTGSLAFECRIMHYLIVCILLPRSSNLAQAHLVRYRMHKTLRSNAPLPHPHLITLFLQHFNVPLDSKPFVKVKRSFSIGVNVVSSFGYRKERDGSWVKKDAPVQAAEDRSPSPHSQRDDSSSLMHNILDKLDGLHTFIGERFDSLDSRIDAMDARFAAMDTRITKLEEDVTYVRQCFDLPPPSS

SEQ ID NO: 140859 - protein, 16 aa, Glycine max
  Coding DNA Sequence Number=SeqID_49174
MEANAVAVAATRAVAK

SEQ ID NO: 140860 - protein, 111 aa, Glycine max
  Coding DNA Sequence Number=SeqID_49175
MADLVSAKNDVNLRVPTGLSAAIDEGCRRRCLAAAIDEGHRRRRQSLRAIRLFVLQTAKKNVYTDNHSGISARQHDSNVSMTDLVSAEDDVNLRVSMALSAAIDEGRRRRR

SEQ ID NO: 140861 - protein, 98 aa, Glycine max
  Coding DNA Sequence Number=SeqID_49176
  Homolog annotation: Hit_ID=A5ZQM3; Match level="QueryCoverage=43%, HitCoverage=39%, E-value=2e-16, Identity=90%"; Hit description =Putative uncharacterized protein
  Subcellular localization annotation: CTP_CleavageSite=57; ConfidenceScore=5.16e-01
VWHLDVGSSPPGAVVCSKGWAVRPLKRYVSWVQNVVRQFGPYPDREGRTSGVPVIVPTVNAGASGSTAETAMGSLPQRGWSERSFENSREGHGETSRF

SEQ ID NO: 140862 - protein, 208 aa, Glycine max
  Coding DNA Sequence Number=SeqID_49177
  Gene Ontology: Mol. function=kinase activity
  Homolog annotation: Hit_ID=A8AMN4; Match level="QueryCoverage=97%, HitCoverage=46%, E-value=4e-50, Identity=45%"; Hit description =Putative uncharacterized protein
  Pfam annotation: Domain name=YjeF_N; Domain location=12-141; Score =88.0; E_value=3e-23; Accession=PF03853.6; Description=YjeF-related protein N-terminus
MPQLDCDASDGLGLTLYELMQLPGRPAAGLSVTLLACDSERPLPEEAQQARDGWLAAGGVIHAADAAWPEHIDVIVDALLGTGLNRAPAAPYQSLIEQINAHAAPVFAVDIPSGLVAATGTTPGAAVVADCTLSMIALKPGQLTGKARDHVGVLHCATLGLDAFLAGEPAPIHRYAAADLPRWLKPRKATSHKGDHGRLLVVGGDSGT

SEQ ID NO: 140863 - protein, 63 aa, Glycine max
  Coding DNA Sequence Number=SeqID_49178
MRRYAVNWFCKVVRLHRFLTIQTISPNEKFIFMGNEVKAPVEIVETYCLKRNTGHRLDLLETP

SEQ ID NO: 140864 - protein, 198 aa, Glycine max
  Coding DNA Sequence Number=SeqID_49179
MLNRDSRSRRIPTGPWGFQLWLRASVNPTGCPFPPARSHHHDIGIAPAGHPVDPKKSNRVLGFPALNTSLCQFYGVPVTPSKAGARRDTTTAWGWLATTTDAPPPPHQADPAGSFGMERYFQHLVRQQAANHRGQVQIHECLYQLSLSQQSQGFAPFACPIPNQFRAEVAWPGDWSEDQTEEAPAGAPDGAEDARMDE

SEQ ID NO: 140865 - protein, 177 aa, Glycine max
  Coding DNA Sequence Number=SeqID_49180
  Subcellular localization annotation: CTP_CleavageSite=41; ConfidenceScore=5.37e-01
MAESSKKRKGSSSTTAAAGHRRHGPSEAPTTPIHPPLSSPRSSTFFSSDDQRLRYLSQFSSRIILDPKYLDIDFFNDETFDCYQVFQNFGLVDFMSLKLPYYPELVKVFSCNLKIQDGIISSEVHVKVHLFEGTIVDDWKFDYSSHDACRMIDWAHLVRYRMPKALRANAPLPYPHL

SEQ ID NO: 140866 - protein, 133 aa, Glycine max
  Coding DNA Sequence Number=SeqID_49181
  Homolog annotation: Hit_ID=Q5XM22; Match level="QueryCoverage=66%, HitCoverage=49%, E-value=4e-23, Identity=61%"; Hit description =Resistance-like protein HAAS-2
MLVDLLMVSPESARAETAQCRGPYLRLQWVRDIYECQCQAGHWTAAARAYLLHLLGCTLFANKSATNVHVVYLEALRDLSMTERYAWGVAALVHMWIATKKTVKSIRTPAYRERLDRLRIPDVCWTPYGEHRE

SEQ ID NO: 140867 - protein, 70 aa, Glycine max
  Coding DNA Sequence Number=SeqID_49182
MAKDETDLFPKVLMSLSKSKFDWEMEAVELNQKAKALHGGDRVKHWPNEWREATHFTLKEVYEEILRQQK

SEQ ID NO: 140868 - protein, 124 aa, Glycine max
  Coding DNA Sequence Number=SeqID_49183
MVIRIFRQLEASEPIDPQRPIWSSAPFFEDSMSIDRDYFSLYFAIWRQSSPIACGGRNGHSLSVFWDYQSPLYHPVTSESDDIRDDHGRPFQIVLEIFAAPFVILRQSSPMMHKDSLLLSRDDQ

SEQ ID NO: 140869 - protein, 130 aa, Glycine max
  Coding DNA Sequence Number=SeqID_49184
MTEGCGEGFCLANLPGDAFSLWGNFFEAKKQMMADAKFAGLLGSAVLGYGPVLSFGLVGPLLPPRDQFCWPGFCQLWLAPRWLSLCLGGGSSCHNMARHKGRDESKRQGLNLSGSWQQGHSATYNTPSRI

SEQ ID NO: 140870 - protein, 50 aa, Glycine max
  Coding DNA Sequence Number=SeqID_49185
MKKQQWKRSLLVGLYGGWIFELQWGPLMVIFHHGDAAEDKGKEVRGGAIH

SEQ ID NO: 140871 - protein, 50 aa, Glycine max
  Coding DNA Sequence Number=SeqID_49186
MVRHLQSSFFLLHYADIHLQEAKDSIDEEDPRLTSFTWSYIMWYRASSSR

SEQ ID NO: 140872 - protein, 122 aa, Glycine max
  Coding DNA Sequence Number=SeqID_49187
MEKRLCRGPLTSLLRFLLTQHISSPVRNIFRSPHRTQPEHIRPLAPAGVIAKPARSALRATVAIQPECSEWHDSVPVESGACKRNGRVNGGYASRAPALHLPALMSGVYALCRIERTHPFSS

SEQ ID NO: 140873 - protein, 64 aa, Glycine max
  Coding DNA Sequence Number=SeqID_49188
MEVGTRGSKRTSLDEDALIPHDANSIGASRPRIFFINGFLCSLEDEWQRNGEGRERGDATSRRR

SEQ ID NO: 140874 - protein, 97 aa, Glycine max
  Coding DNA Sequence Number=SeqID_49189
TLPEQVRAVMQVGSATFIIRVIKHSGIGSGDSKILQVASRFQDVKTSLVTSAFCSLCLHALLSATSLFQDVKASLVTSAFCSPCLHALAAASSISYS

SEQ ID NO: 140875 - protein, 101 aa, Glycine max
  Coding DNA Sequence Number=SeqID_49190
MSNHKSTESTLKNLEVQVGQLAKQIADKSSNSFVANTKQNPKEECNAVMTRSKRFMEVEDEDSVVYKKKTADKKSTDGKKNEETGNNHALRRSFAADATLL

SEQ ID NO: 140876 - protein, 146 aa, Glycine max
  Coding DNA Sequence Number=SeqID_49191
SAKRNTPGLSARKNPEEDELYRFTKRTASVHLLSEKGALSQKSLTWAKRTSTNKPTYLSLKSDFVKGVWTAIQSFACGGDILTTCIFSIIHLVLLFVVKKASWYRKLNPLLDLPWSFNSGNWFDSKVIDSEGLSCRAFKRNRGAIS

SEQ ID NO: 140877 - protein, 326 aa, Glycine max
  Coding DNA Sequence Number=SeqID_49192
  Gene Ontology: Mol. function=prolyl aminopeptidase activity; Cellular component=cytoplasm; Biological process=proteolysis
  Homolog annotation: Hit_ID=A1FRP0; Match level="QueryCoverage=96%, HitCoverage=100%, E-value=1e-179, Identity=95%"; Hit description =Proline iminopeptidase
  Pfam annotation: Domain name=Abhydrolase_1; Domain location=72-318; Score=79.3; E_value=1.3e-20; Accession=PF00561.11; Description =alphabeta hydrolase fold
  Pfam annotation: Domain name=Peptidase_S15; Domain location=28-306; Score=-105.9; E_value=0.023; Accession=PF02129.9; Description=X-Pro dipeptidyl-peptidase (S15 family)
  Pfam module annotation: Pfam domain module=Abhydrolase_1::Peptidase _S15; Domain location=72-318::28-306
MLAAPACETSAVRTLYPAIEPYREFTLKVSDLHTLHIEECGTPEGIPVVYLHGGPGAGISPTHRRFFDPARYRIVLIDQRGSGRSTPFGELRDNTTQDLVADIEKVREHLGIERWLVYGGSWGSTLSLAYAQAHPERATGLIVRGVFLGREMENRWFAEANGGARWIFPERWERYEAYIPEAERGDMIAAYWTRMDGPDEATRIEAAQAWLGWEDNAATLQHDVDAQSTDDPLDTLAKARIEAHYFRNSIFLEPDQLLRDIDRIRHLPCVIVQGRYDIICPPRSAWDLAKAWPEARLEMVTSGHSANEPTTVDALVRATDAFADRF

SEQ ID NO: 140878 - protein, 120 aa, Glycine max
  Coding DNA Sequence Number=SeqID_49193
MKRGLQHLGWKMLEHLCQHQGQKHSGWKMLEHAFSIRDRRICSECYSQYCGSSYPSPLSTSLGLVAQARVFRESYTFSLLSWGQQLSQDTGADRNHFFVCMELDMELQVVPGFITVLLVD

SEQ ID NO: 140879 - protein, 40 aa, Glycine max
  Coding DNA Sequence Number=SeqID_49194
  Homolog annotation: Hit_ID=A5BCY8; Match level="QueryCoverage=100%, HitCoverage=5%, E-value=1e-09, Identity=60%"; Hit description =Putative uncharacterized protein
MNEEYKLMQDNKVWELVPLPEGNVERYKARLVAKDYTQNE

SEQ ID NO: 140880 - protein, 138 aa, Glycine max; identical to SEQ ID NO: 105458
  Coding DNA Sequence Number=SeqID_49195

SEQ ID NO: 140881 - protein, 64 aa, Glycine max
  Coding DNA Sequence Number=SeqID_49196
  Subcellular localization annotation: CTP_CleavageSite=30; ConfidenceScore=5.25e-01
MVLKRGRGKVSAPKTLPPHSKKQKLTGFTNFAALKSPFLTFLIPFCSIIHLQQGMALGLWCILK

SEQ ID NO: 140882 - protein, 93 aa, Glycine max
  Coding DNA Sequence Number=SeqID_49197
  Subcellular localization annotation: CTP_CleavageSite=57; ConfidenceScore=5.26e-01
MVKVGTSYVPINVSFSPKVGPGLPGSYSAQYRAPRGDAATSLLDSSWRICCLSAVPSCSATDGELVIRVQFGTQAYQPEASALASVKPGCLRR

SEQ ID NO: 140883 - protein, 145 aa, Glycine max
  Coding DNA Sequence Number=SeqID_49198
  Gene Ontology: Biological process=transposition, DNA-mediated
  Homolog annotation: Hit_ID=Q1J7G7; Match level="QueryCoverage=28%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIFEENIGKTGKDAIYELLSE

SEQ ID NO: 140884 - protein, 325 aa, Glycine max
  Coding DNA Sequence Number=SeqID_49199
  Homolog annotation: Hit_ID=Q2HW90; Match level="QueryCoverage=94%, HitCoverage=65%, E-value=6e-26, Identity=29%"; Hit description =Putative uncharacterized protein
MENQDEWVPFMDVLALLIFGVVLFPNVDGLVDLAVIDTFLAYHHSKEIPVVAVLADLFDTFDQRCEKSSARIICCLPALCVWLVSHLFQQDIRHPCPLRSHRSCAEKRRVDWDQHLAGIGGGTVNWFPRWKEGKEGVLFSCGSYPNIPLIGTRGCINYNPALAIRQLGYPMRGAPTEESLSPFLVRDFGVQNFKVIQRVHKAWENPLRKDKELRGIRNGIIGGYHEWLKVRTRGLDWLAKLKIINEENFEAPEEDEEVRALKTELGKARLAKEEFKLVATDARKECVGLREENAATAKALEQETKRARKEEHSHDKFCGALWGSN

SEQ ID NO: 140885 - protein, 264 aa, Glycine max
  Coding DNA Sequence Number=SeqID_49200
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLEKVKGKIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFTGVIP

SEQ ID NO: 140886 - protein, 56 aa, Glycine max
  Coding DNA Sequence Number=SeqID_49201
MSISPCGSISWSVSIQHRGRARKTPCGPGEVQEGLGVASSDYGPLSVLRGACCLQQ

SEQ ID NO: 140887 - protein, 121 aa, Glycine max
  Coding DNA Sequence Number=SeqID_49202
  Homolog annotation: Hit_ID=A5BSR3; Match level="QueryCoverage=67%, HitCoverage=29%, E-value=8e-07, Identity=36%"; Hit description =Putative uncharacterized protein
MAEKTKKSLEEAAQSGSTEGVIDPPSPIRRHVKWKMTRTKKTGQMTSEAAKEMAEKIGSFVPHGRQDVLNAAIGRPEHPGRVCAVGVDGLALPPEPEVGPLGACVSTKESCVAPSGNDPGT

SEQ ID NO: 140888 - protein, 144 aa, Glycine max
  Coding DNA Sequence Number=SeqID_49203
  Homolog annotation: Hit_ID=Q6UUU1; Match level="QueryCoverage=55%, HitCoverage=54%, E-value=2e-32, Identity=85%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSRKAVRSKLDCMHKPPDQPTAAPYPVTIDLSPTPERHAKAPLAAATGN

SEQ ID NO: 140889 - protein, 108 aa, Glycine max
  Coding DNA Sequence Number=SeqID_49204
HALRCPYRTRARARVMGEVEEVQEQMKADTKASKEKMAIMMEAMMSIKEIIKVSVVAIATTSTIVEHAFPPYGLPPNYTPPYVAYTPSEDVNNLAPILIESQQPQSGT

SEQ ID NO: 140890 - protein, 355 aa, Glycine max
  Coding DNA Sequence Number=SeqID_49205
MGADQSCDRCGVAAAGGQEDVFAAYRMLAHDRALLIGMPARCQEHIVGNADLADVVEARGQADLRTGIVVEIAASRICSDIERASIRQACACSRSGAGTASGNMVIRPHRVGTGAGCSGGRSTRGEGGQKGTGRIEAVFRQRQRVLDAQLVGPFHGVEVRLFLDQLDHRHWIDVRLGLEHDAATVLAQVQLADAQRVGLELQLGDGEQVLGRIRQQAEAVDHLHLQLAQRIGVARAGNTLVQGQARVHVRQVVFRDQRRHMQLDLGTAHFFTGIQVGQLALLDAAYRAFQQLGIEAEADLGHLPALVLAKQFTGAADFQIVRGQGDAGAQLVHRGDRFQALLGVGCDRATVGGDQ

SEQ ID NO: 140891 - protein, 141 aa, Glycine max
  Coding DNA Sequence Number=SeqID_49206
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
MKHFTDTLISANILLSRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 140892 - protein, 131 aa, Glycine max
  Coding DNA Sequence Number=SeqID_49207
MSVIKLYIEKDVAGGFTFHSANSDKSCENNLSNNESKSSTNVNNLNDDADYLVSNSYVEEFLDEDDNIDDISDTDDEVIHMVEPVIIVQPREAISIGVILVRRIFAVWRCHRVLRLGKNYMLVCILTVKML

SEQ ID NO: 140893 - protein, 65 aa, Glycine max
  Coding DNA Sequence Number=SeqID_49208
  Subcellular localization annotation: CTP_CleavageSite=34; ConfidenceScore=5.30e-01
MSSCAQRAINSFSEKIVSSALSTRMALIQISFTRAKRKNGAKRAFTDKKPFLSLNCRELSSTRDI

SEQ ID NO: 140894 - protein, 157 aa, Glycine max
  Coding DNA Sequence Number=SeqID_49209
  Homolog annotation: Hit_ID=Q6UUU1; Match level="QueryCoverage=54%, HitCoverage=55%, E-value=7e-19, Identity=61%"; Hit description =Putative uncharacterized protein
VALTARFPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSCSCLSVYRCHSAVMAAFVSFHADTQFR

SEQ ID NO: 140895 - protein, 194 aa, Glycine max
  Coding DNA Sequence Number=SeqID_49210
  Gene Ontology: Mol. function=motor activity; Cellular component=cell projection
  Homolog annotation: Hit_ID=UPI00016621D1; Match level="QueryCoverage =96%, HitCoverage=40%, E-value=5e-21, Identity=36%"; Hit description =UPI00016621D1 related cluster
LHALAFRGLHVLTFRRPNILIFRGLHVLAFRGLHVLTFRGLHALTFRGLHVLAFRGLHVLDFKGLHVLAFKGLHVLNFRGLHVLHFRGLHVLAFKGLHVLNFRGLHVLHFRGLHVLTFRGLHALAFRGLHVLAFRGLHVIHFRGLHVLTFRGLHALAFKGLHVITFRGLHAPAFVWLHALTFRGLHFLTFRGLN

SEQ ID NO: 140896 - protein, 49 aa, Glycine max
  Coding DNA Sequence Number=SeqID_49211
MAAAAHNEADIKQHHLRHVVDDFAAIADRLDRLLNLRILIEGTEAYTVV

SEQ ID NO: 140897 - protein, 78 aa, Glycine max
  Coding DNA Sequence Number=SeqID_49212
MHIVVVRQGQDHLELPSGVRKKCGRQKPIKVLRDGCKWGWGHDRPIVAPSLRETSRERRCKAAPYPLYLQFSFTICLF

SEQ ID NO: 140898 - protein, 61 aa, Glycine max
  Coding DNA Sequence Number=SeqID_49213
MEEDLKKTLKFLDATNATNLVTSKQIVPQMRNGLRKVIRKEKEINLLTKDYESDENISQED

SEQ ID NO: 140899 - protein, 107 aa, Glycine max
  Coding DNA Sequence Number=SeqID_49214
MVGYTPSSFADLVFTDERIKVSLKKGKFSHPAWTNEKTRANEEGEDEVEAHAVTAIPIQPSFPPTQQCHYSANNKPSPYPPPSYPQRPSLKSTTKSVYRTSNDEHHL

SEQ ID NO: 140900 - protein, 76 aa, Glycine max
  Coding DNA Sequence Number=SeqID_49215
MGPKSTLRLILGVFYPMLLGGRIASVMNVPQKEKKKIKSSIKDWRKAKEKEKFSIKDRKRAKEKYTERSLDQTMSE

SEQ ID NO: 140901 - protein, 74 aa, Glycine max
  Coding DNA Sequence Number=SeqID_49216
MEDAPLAHSRGPFAPPPKGRLRHDENAHRLKWPNSLKTIPSGVANCHNLPFDRRATRGSQVLAPHASVTRNDSL

SEQ ID NO: 140902 - protein, 86 aa, Glycine max
  Coding DNA Sequence Number=SeqID_49217
  Homolog annotation: Hit_ID=Q6WAY6; Match level="QueryCoverage=81%, HitCoverage=12%, E-value=9e-09, Identity=41%"; Hit description =Putative uncharacterized protein
MSSHVCEKGKANWEEILADMVGAPVNWFPRWKEGGAGVLCLCEGFPNVPLMGTRDCINYNLVLAIRQLGYHMREAPLEESIAPFIA

SEQ ID NO: 140903 - protein, 65 aa, Glycine max
  Coding DNA Sequence Number=SeqID_49218
MFCENAPTIWDQHRLKGALKPDDPQGLHFEESVEDLSLLIQYPRPHTRVSNTFNALRYNLTLVPK

SEQ ID NO: 140904 - protein, 163 aa, Glycine max
  Coding DNA Sequence Number=SeqID_49219
MDSVGVGSIQSTCPEIGTSCRLRGSPNLPLGTPSIFDHGLAALPSRSTRKKKERGRLFHVATHCLHFLSPVIDYQRSPQHTVSISKPGNRLHILGNRLPEAVATYPSAGGRRVTRGMRVPRKEYARSRHQRLFEENVGKTGKDAIYELLSERFGSCIYARGRY

SEQ ID NO: 140905 - protein, 66 aa, Glycine max
  Coding DNA Sequence Number=SeqID_49220
MSVKRQITTIQMRRVREEKGKVGIAFCVRSKKWNVPKPVWSRRQRQRHAEREENVGSRNKRRYQKR

SEQ ID NO: 140906 - protein, 163 aa, Glycine max
  Coding DNA Sequence Number=SeqID_49221
MQAGNFDVYGFIEPQSIQRSGQSQFESKSYMKNWMQNSKWNVYLGAYMNGLDNYVKGIINMSVLFFNAFALSLLSNINILMFLVFNNALKGLNDTPQPKSKAGARWILVKCNRQKGSTECDYYVMHWMSTIILGTFRNNWETTIGSTEIEGASHPMGTVLSQS

SEQ ID NO: 140907 - protein, 98 aa, Glycine max
  Coding DNA Sequence Number=SeqID_49222
MWAFLTGRQIDWAHLVRYRMHKALRANAPLPYPQLVTLFLRHFQIPLDDEPFVQVKRSFAIGAGAVTSFGYCKDHDGQWLKKDALPQQDERTPSPPPR

SEQ ID NO: 140908 - protein, 314 aa, Glycine max
  Coding DNA Sequence Number=SeqID_49223
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCREFDGSGAPCIGSPYGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPAFPPGGSLVRSPVPAFRFT

SEQ ID NO: 140909 - protein, 282 aa, Glycine max
  Coding DNA Sequence Number=SeqID_49224
MAKFDPDIVLEFYANAWPTEEGVRDMRSWVRGQWIPFDADVIGQLLGYPLVLEEGQECEYGQRRNQSDGFDEEAIAQLLCISGQDFARTAAGRRVQIMHTNMTTLTQIWMTLLLSNILPTDHNFDLPLPKCMAPTRHPLDPNKSNRALGFPALIIGLCQSFSVPVTPSKVIRPPITRAFIEKYCTQRQVQGDAPQAVDAPPPHQAGPAGSFDTEQYLRHLVRQQAANHRAHSQGFTSFLCPTPDQFRAEVAWPGDWPEAQAGEAPVGAPAEAPDEADEARED

SEQ ID NO: 140910 - protein, 211 aa, Glycine max
  Coding DNA Sequence Number=SeqID_49225
MNILTTHDQGWEQELSPYNQYEEERTPNLEGVFEEFMAYHASSKANQNSMENHEIHFGKSYSIEKFQGGPELQPYYQNEAERGSNLDKLLMQFKKTTKSTQRALQSVEIQVGELAEEVTQFMSRREKYFVEVEAQEESPVKEHESREKDEEQAQQQWEKYSTIENNQESILQINNLPHQRIDKKKRQGEYEETLSAILSLIINTFPEIIWN

SEQ ID NO: 140911 - protein, 317 aa, Glycine max
  Coding DNA Sequence Number=SeqID_49226
  Gene Ontology: Mol. function=uroporphyrinogen decarboxylase activity; Cellular component=cytoplasm; Biological process=porphyrin biosynthetic process
  Homolog annotation: Hit_ID=Q1GXV8; Match level="QueryCoverage=96%, HitCoverage=86%, E-value=1e-135, Identity=78%"; Hit description =Uroporphyrinogen decarboxylase
  Pfam annotation: Domain name=URO-D; Domain location=4-313; Score =432.9; E_value=4.4e-127; Accession=PF01208.8; Description =Uroporphyrinogen decarboxylase (URO-D)
MTQLQNDTFLRALMRQPTEYTPVWMMRQAGRYLPEYRESRKTAGSFMQLCQSPSFATEVTLQPLDRYPQLDAAILFSDILTVPDAMGLGLYFEEGEGPKFERTLQAEEDILKLEVPDMTKLQYVFDAVSSIRKALNGRVPLIGFSGSPWTLATYMVEGKGGTDFLNTKKMGYARPELLHRILEITSQTVIQYLNAQIAAGAQAVMIFDSWGGALSHDAYLEFSLHYMQKIVAGLTKTAEGKTVPSIVFTKGGGLWLEQQAAIGADALGLDWTVDLAQARQRVGDQVALQGNMDPAILLSSPAAIEKERCPHSRQLWP

SEQ ID NO: 140912 - protein, 106 aa, Glycine max
  Coding DNA Sequence Number=SeqID_49227
EDVLVSCTSSMPYVEAAEESLEMAFQSFEVVSIASVDSLSGQPCLSDTAMMVARVMLGYGYERRMGLGKNNYGRTRLDTKAKWSRYARMTLRVGRIRYDHSLLVSD

SEQ ID NO: 140913 - protein, 81 aa, Glycine max
  Coding DNA Sequence Number=SeqID_49228
  Subcellular localization annotation: CTP_CleavageSite=63; ConfidenceScore=5.63e-01
MTLLIAALGFWKATVFVLNAKPHSVFDFSNFNKFVLHSSSTFMDYVSASCFILRFLFNPWKARFSGVVSFCEDKPIVRFRL

SEQ ID NO: 140914 - protein, 55 aa, Glycine max
  Coding DNA Sequence Number=SeqID_49229
MKAMPSKPPRKGRLKAQVEKDKAPKWRRMKAQVEKDEGPEAETLSRLLIVVGGPN

SEQ ID NO: 140915 - protein, 33 aa, Glycine max
  Coding DNA Sequence Number=SeqID_49230
MVFGASVASAMLSWLHRSSPFFVRFSSFFSLQP

SEQ ID NO: 140916 - protein, 199 aa, Glycine max
  Coding DNA Sequence Number=SeqID_49231
  Homolog annotation: Hit_ID=Q6UUU1; Match level="QueryCoverage=30%, HitCoverage=40%, E-value=2e-18, Identity=78%"; Hit description =Putative uncharacterized protein
LVEDFAQVYAEKEARGRVIDALHQEATMWMDRFALTLNGSQDLPRLLAKAKAMAKVCTAPEEIHGLINYWRAGTDEGDLSALIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140917 - protein, 344 aa, Glycine max
  Coding DNA Sequence Number=SeqID_49232
MTTCHTVFGNHHQPSELDIHGLRQSGPYTAFLGCVSDTTQRCCMCTRNAHDEAQTSVRMNDEAGTQHSLQVPFATNVATFTVEKDKGSFGIPLQDLHIFDVRMKHLAETMENMDKHNKTRLDAMEKTNYTMLKAICNFVKQDHNKSTKDGIEDVGMSATQNTSLNDETLHCQNPKKPLSTPTVRCTKNEAYGKSKPNLKNIETIFIPGDGDDDFPRPLPMRIKGKFLGQENNTTYSSPKTINLSGPNDVNTTNESSPQEPFMSNYVIGLRAKKPEIEQHSQTWNAPKMQYIKGSSSGNMNNKKASQIFHRPRTNSTRGYTHTIPKDMPCSFKPTIDMNLTFEET

SEQ ID NO: 140918 - protein, 45 aa, Glycine max
  Coding DNA Sequence Number=SeqID_49233
MDKVDIFVPHPLTNACLLIQLSPECGWITLPLCSRIPYNKRPTIS

SEQ ID NO: 140919 - protein, 148 aa, Glycine max
  Coding DNA Sequence Number=SeqID_49234
MTLLRTFCPATVMPISPCRSISWSVSSQHRDHAHKTPSGPGGAQQGPGVSNSSYGPLITPARHPVDPEKPNRVLGFPALITGLCQFYGVSVTLSKVIRPPTNRAFIKKCCAPKQAQGETPQQPGDSQQRATDAPPPPLEFTSAHPQKG

SEQ ID NO: 140920 - protein, 101 aa, Glycine max
  Coding DNA Sequence Number=SeqID_49235
MGVQIETRPTWAFQKIPPEGGCFWRKQPSSPGRAGERSERKFGSTLLVIRESLEISEKNWFREENPSRGASITFPWVISRRFSTALRRSSFVLRRSSVFNR

SEQ ID NO: 140921 - protein, 154 aa, Glycine max
  Coding DNA Sequence Number=SeqID_49236
  Subcellular localization annotation: CTP_CleavageSite=42; ConfidenceScore=5.36e-01
MATGSRLFLIPAARPGLCKNGFFISSYSTRTLELCESSSSSSSSALAGKSPKREGFGLGGTSKTATCPPISTLPKLPPKSWRHYSPGPTRKHSPTPAFASPTLTGSPGGSTSSRAAATAVGAPNSPYSESYYNFTGPSVLQRRGLGKTPGGSPT

SEQ ID NO: 140922 - protein, 98 aa, Glycine max
  Coding DNA Sequence Number=SeqID_49237
EPARTLQQPVEWILPTPTPYRLAEPVQVIEVSSSGEDLEEDLEELPPEPAMDALDLPKDDEDPFPNVDSPEDVMSVSEADSTEESGPGGTTISDDSSS

SEQ ID NO: 140923 - protein, 72 aa, Glycine max
  Coding DNA Sequence Number=SeqID_49238
MEDCLEGPLLGNHGITAPNSKVERTHEQPQAITFTWLRKRTRMEDCLEGPLKAIMEHSSKLKSGGHMNSPKQ

SEQ ID NO: 140924 - protein, 43 aa, Glycine max
  Coding DNA Sequence Number=SeqID_49239
MLRCTNSSPGCEPVSTSADIVQSNLDYARGAGVPNCDFSLIRV

SEQ ID NO: 140925 - protein, 127 aa, Glycine max
  Coding DNA Sequence Number=SeqID_49240
MTRGNPSNLQPFDPKIDRTFHRLVRHHFIPFDHPERSITDESVHSVIGDFEHPDLEHYNFEHSDSEHSDFAHSKNMAQPPPRERTLREMAAPDFTYESLCIQYPDEDVPYVLKTGLIHLLPKFHGLA

SEQ ID NO: 140926 - protein, 110 aa, Glycine max
  Coding DNA Sequence Number=SeqID_49241
HLTETCMRAGNSDIYGFLEPQSIQRSGQSQFESESYIKSWMQSSQRDVYLGAYLNGFHCSGHWQMVPKSKAPARWIVVKYFNDPRPLEPERLKALRIQWAQFYLRVRDQA

SEQ ID NO: 140927 - protein, 114 aa, Glycine max
  Coding DNA Sequence Number=SeqID_49242
  Subcellular localization annotation: CTP_CleavageSite=36; ConfidenceScore=5.03e-01
MVKVGTSYVPINVSFSPKVGPGLPGINRDTRSLICLAAEVWCSQSKASVAGEKSCTGASVRICRYRTHYSGHSSLDSYARSLMRRRESGPYNGAEFDSFWFVRLLALRKNLTGK

SEQ ID NO: 140928 - protein, 110 aa, Glycine max
  Coding DNA Sequence Number=SeqID_49243
  Gene Ontology: Biological process=transposition, DNA-mediated
  Homolog annotation: Hit_ID=Q1J7G7; Match level="QueryCoverage=29%, HitCoverage=45%, E-value=3e-11, Identity=100%"; Hit description =Transposase
  Subcellular localization annotation: CTP_CleavageSite=79; ConfidenceScore=5.14e-01
VLQWLLFLSAVPPVQLLTGWCVTAKAPPDISAGKCSGKLRVTTTPAALKAPLQGASHSPFRLRNCWEGRSVRAFSLLLQLAKGGCAARRLSWVTPGFSQSRRCKTTASEL

SEQ ID NO: 140929 - protein, 243 aa, Glycine max
  Coding DNA Sequence Number=SeqID_49244
  Homolog annotation: Hit_ID=Q6WAY6; Match level="QueryCoverage=72%, HitCoverage=30%, E-value=1e-18, Identity=32%"; Hit description =Putative uncharacterized protein
VLSSQGQEPRDHQSKRVRAVDGSAPTASFSQFYGKIWDLAMVEVPTEAIASLAQYYDQPLRCFTFGDFQLSPMVEEFEEILGCPLGGRRPYLFSGFYPSLARISKIVQISAQELDHRKQVENGVVGIPRKYLEAKARILAGRGEWAPFIDVRALLIFGGVLFPNVDGLVDLAAIDAFLAYHDHKESPVVAMLADLYDTFDRRYEKSEKGGENWDPLLANKEGASVNWFPQWKEGRTRVLISCG

SEQ ID NO: 140930 - protein, 163 aa, Glycine max
  Coding DNA Sequence Number=SeqID_49245
  Subcellular localization annotation: CTP_CleavageSite=49; ConfidenceScore=5.06e-01
MRRWRQCRPTVGTHQGRRRDAATKVGTYRGRKQKKPLRGSGFLSFRRRRSASGSEVDPAGLHELVAPVTTEQGVHADVLARARRVQEAAITDIDADVVDAALAAEEHQVTGGERSAVVDQLGVVIVGHLARDARQLDAQRRAEHVADQAAAVEAAVRVAATPT

SEQ ID NO: 140931 - protein, 179 aa, Glycine max
  Coding DNA Sequence Number=SeqID_49246
MPPTRHPLDPDKSNRALGFPALITGLCQSFGVPVTPSKVIRPPITRAFIKKYCTPRQAQGDAHQAANAPPPPHQADLAGSLGMERYLQHLVCQLAANHHGQVQIHECLYRFSRSQQGQSSTPFVCPTPEQFAAEVTWPGDWPDAQAGEEPAGSPGRMDEPRMDEDMTDLFDFLEGSGAA

SEQ ID NO: 140932 - protein, 186 aa, Glycine max
  Coding DNA Sequence Number=SeqID_49247
MVKEECKEVSVSSKKLAKKESHFTIKTNIKKTSPLRQPPHFLLCKKTLVSIATPLGLEFIPQVKELLDEDLVCKSLNPCALLVQKIGIIRHQIPMIGGMMNVLSGATLFCKITHAPNIFMICVHSDSLGSDQGLPMDPKRIKVLPEWPTPPSVEERINEFREPLDLRSNPFQGGGNDAILPPKGIG

SEQ ID NO: 140933 - protein, 111 aa, Glycine max
  Coding DNA Sequence Number=SeqID_49248
MKDIELVEEEQAQIGANPSSETSNKSENYKEEARNATQKHKPKKVESVNTDAEAFAEPLEHTKKRDTGHQSVSLENKAGDSTVLKIGNSGKVVIKQDMKGRRHTYGFNNNK

SEQ ID NO: 140934 - protein, 24 aa, Glycine max
  Coding DNA Sequence Number=SeqID_49249
MGPHQKNRAGRLRIGSGRGSKIGQ

SEQ ID NO: 140935 - protein, 133 aa, Glycine max
  Coding DNA Sequence Number=SeqID_49250
MCEHNQKEAITQLLCIPGKIHPCRCKETSADHAHQHDHSYTDIDDMLLATFCPATAMPISPCKSISWSVSSRHGDRTHKTPSGPGKVQQGPGVSSSGYGPLSVLQGARTPRQGHVIIGIAPARHPVDPKKSNR

SEQ ID NO: 140936 - protein, 71 aa, Glycine max
  Coding DNA Sequence Number=SeqID_49251
MSLEVTSSLTSFVLNGIAMTEVVSSPWRFTVGNWLCDSDLVSPTGIERVLTEKDLLADSYSDLEASILDEK

SEQ ID NO: 140937 - protein, 434 aa, Glycine max
  Coding DNA Sequence Number=SeqID_49252
  Homolog annotation: Hit_ID=Q2HW90; Match level="QueryCoverage=49%, HitCoverage=40%, E-value=2e-23, Identity=34%"; Hit description =Putative uncharacterized protein
MASQEKWGPFADVLALLIFGVVLFPNVDGLVDLAAIDAFLAYHHSKESPMVAILADLFDTFDRRCEKNSARIVCCLPALCVWLISHLFRQDTRHPCPLQSYRSCAEKGRIVWDQHLAGMGGSMINWFPRWKEGKEGVLFSCGDYPNVPLIGTRGCINYNPAFAIRQLGYPMSGAPTEESLSPFLVRDLGTQGLKVIQRIHKAWRSSLRKDKELRDIRNGIIGGYHGWLRIHTRGLGWLSKLKVVDEEKFEAPEEDEEVRALKLELGKARLAKEKFKSAATHIRKECTELQEENAATARALEQETKRARKEEHGREKFRGALWGSNNDLKLRREERDRSRVHGMILKEELVACARSKRSLAQHLEATEQSMLAIIGQYKEELNQSMAHEQKLVEDFAQVYAEKEARGRVIDALHQEATMWMDRFALTLNGSQDLP

SEQ ID NO: 140938 - protein, 260 aa, Glycine max
  Coding DNA Sequence Number=SeqID_49253
MAMKNSPRRGLEETPQQKGLVPPPSLIVIISRVPSTSSEEIAHRRWTSLVTPMAKFDPEIVLEFYANAWPTEEGVRDMRSWVRGQWIPFDVDALSQFLGHCPAVMHTGAGFRPDRYREAGADHAYQHDHFDLDVDDTAAPQFGVYHPDTDDRPRVPGSRHPYKVIRPLITRAFIEKYCTPRQAQGDAHQAADALSPPQQADPAGSLGIERYLQHLVRQQAANHHGQAREEPAGSPSEAEEARMDDDMTDLLGFLGGSGAM

SEQ ID NO: 140939 - protein, 69 aa, Glycine max
  Coding DNA Sequence Number=SeqID_49254
MAELCLVPDISIPSKFKEDGGILLRREALNAFLPKELGWGGSHLVYQLRSYPDQLLEGLDGYLHQAVSI

SEQ ID NO: 140940 - protein, 109 aa, Glycine max
  Coding DNA Sequence Number=SeqID_49255
MVAQARAVDMLVETSSSRLWMAARALGVPRHCALLASACGLPIRPVLKHGPRSLGVTCVRVNGRNWRCGMNRKLGYGAQLRANLDPTKGVGRLRQQDGGHGSRNPLRSV

SEQ ID NO: 140941 - protein, 63 aa, Glycine max
  Coding DNA Sequence Number=SeqID_49256
MVAGNTTIEKPREDWSEEERRLVQYNLKAKNIITSALGMDEYFRVSNCKSAKDMWDTLQDEYK

SEQ ID NO: 140942 - protein, 17 aa, Glycine max
  Coding DNA Sequence Number=SeqID_49257
AKSATLFSLEDQAQFSL

SEQ ID NO: 140943 - protein, 60 aa, Glycine max
  Coding DNA Sequence Number=SeqID_49258
MVKEECKEVIPQVKELFDKGLVCKSLNPCALLVPKIGIIRHQIPKIDGMMNVLSGATLFC

SEQ ID NO: 140944 - protein, 101 aa, Glycine max
  Coding DNA Sequence Number=SeqID_49259
MGAMYLEVVKRGWHPKMDGPRTKLGLGGKAQNDHNLSLRATGHDRLWMAKRICLCAFITRLAAPERQRAQKTLLVSMRLSLIERADDRNWSPHVIGPAASG

SEQ ID NO: 140945 - protein, 63 aa, Glycine max
  Coding DNA Sequence Number=SeqID_49260
  Subcellular localization annotation: CTP_CleavageSite=40; ConfidenceScore=5.49e-01
MNNSKKSNRSNKVASKDKHCFKINTRLLQQRKPCFKINSRSSLASKQSVSKTSKALVIDYQAV

SEQ ID NO: 140946 - protein, 156 aa, Glycine max
  Coding DNA Sequence Number=SeqID_49261
  Homolog annotation: Hit_ID=UPI00006A2D9E; Match level="QueryCoverage =82%, HitCoverage=75%, E-value=4e-10, Identity=17%"; Hit description =UPI00006A2D9E related cluster
MSLPSEGYPPSPWVLVTLTFRGLHALAIRGLHVLTFRGLHALAIKGLHVLTFVGLHALTFRGLHVLAFVGLHALTFRGLHVLAFVGLHTLTFRGLHVLANRGLHALTLRGLHVLANRGLHVLTLRGLHALTIRGLRVLIFNVLHICTLREFKVLCP

SEQ ID NO: 140947 - protein, 41 aa, Glycine max
  Coding DNA Sequence Number=SeqID_49262
MSRNFTDCLTMGVKYLEALSEGCMPPNNGPRTKLGTKIGIT

SEQ ID NO: 140948 - protein, 90 aa, Glycine max
  Coding DNA Sequence Number=SeqID_49263
MSEEVDMNVENEEDVGVKVEHVDCSDVFNTFQLFATHDEILHWAQSVAHEIGFVVVIMRLDTNTSVRGRTSFLLIACKRSGEYRPKKNDL

SEQ ID NO: 140949 - protein, 114 aa, Glycine max
  Coding DNA Sequence Number=SeqID_49264
MPTPQWHIRGEAQSRLDYGLRVLHVSPPWVESDAILPRKGPVTRAMSKRLQEDWARVDKEGLRVLMNLRLSSSFSRKLLKELLKEVFSKKLLKEVFLRKLLKEVFLRRLLKEAT

SEQ ID NO: 140950 - protein, 95 aa, Glycine max
  Coding DNA Sequence Number=SeqID_49265
MHSISFLLCQYLLAKVCDIYPRIELANSQTKYAKYSDSKSIQMPKLHRISVSCRSDDESHEQNDGDSNEVYFVEAFGKRRHRKAPFGGGDSDCGA

SEQ ID NO: 140951 - protein, 139 aa, Glycine max
  Coding DNA Sequence Number=SeqID_49266
TTSSSPNRGLHALTFRGLHVLANRGLHALTFRGLHILAFRGPFHDYMSSPSVGLHALTSGGLRRPRLEGLPALALGTITLPSEDYTCLAFRGLHALTFPAPYWRAPTVRAPEATAMHIGARILPVPRLERLVRIKLTKA

SEQ ID NO: 140952 - protein, 81 aa, Glycine max
  Coding DNA Sequence Number=SeqID_49267
  Subcellular localization annotation: CTP_CleavageSite=9; ConfidenceScore=5.05e-01
MRPPPTSLECMRSDCLVQFSILNPSFRSPMNCVFVHASSTHEFGAMRSDCLVQFSIVYPFLEPHELRFRSCVLHPRVWSHA

SEQ ID NO: 140953 - protein, 70 aa, Glycine max
  Coding DNA Sequence Number=SeqID_49268
MARNVFASCPYLRDLYGRELKRLLVIAPKVVISLLMVSRGIIPFEEHIAAVGTTSNNKFSKRKALDEGSL

SEQ ID NO: 140954 - protein, 193 aa, Glycine max
  Coding DNA Sequence Number=SeqID_49269
MSSPSEGCTPSPRGLHVLTFRGLHALAIRGLHVLTFVGLHALTFRGLHVLANIGLHALTFRGLHGLHALTFPEGYVSSLFSVLHPSPSENLRCTLTFPEDYMPRLEREHTPSPWRTYMSSLIRGLHALTSRGLHVLTLRGLHVLTIRGLHALTSRGLHVLALRGLLALALRGLLALALGTSYPHLQRTTSSPS

SEQ ID NO: 140955 - protein, 130 aa, Glycine max
  Coding DNA Sequence Number=SeqID_49270
DIRVKRFCRLNLVEASVLNFEHLDILRDSIGHPTKKLLSLEFAQCLSFQFRAPRYITGLRHPSKKLLSFEFDSGASVFNLESLEILRDEIGHPSKNLLSFEFCSELQHSISSVSISYGTQSDIREKRYCC

SEQ ID NO: 140956 - protein, 268 aa, Glycine max
  Coding DNA Sequence Number=SeqID_49271
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=97%, HitCoverage=52%, E-value=4e-81, Identity=81%"; Hit description =Photosystem I P700 chlorophyll a apoprotein A1
  Pfam annotation: Domain name=PsaA_PsaB; Domain location=1-268; Score =31.5; E_value=6.9e-07; Accession=PF00223.10; Description=Photosystem I psaApsaB protein
STLEDPTIWNLHADAHDFDSHTNDLEEISRKVFSAHFGQLSIIFLWLSGMYFHGARFSNYEAWLSDPTHIRPSAQIWRASGITSELQLYCTAIGALVFAALMVFAGLDPVTGGLWLTDIIHHHLAIAILFLIAGHMYRTNWGIGHSIKDILEAHKGPFTGQGHKGLYEILTTSWHAQLSINLAMLGSLTIVVAHHMYSMPPYPYLATDYGTQLSLFTHHMWIGGFLIVGAAAHAAIFMVRDYDPTIRYNDLLDRVLRHRDAIISHLNW

SEQ ID NO: 140957 - protein, 52 aa, Glycine max
  Coding DNA Sequence Number=SeqID_49272
HLSNSIPNEEQIAHEVNYMGNQPIGNFNTSGFPGFHPGNQFNRDQGGSSTRP

SEQ ID NO: 140958 - protein, 126 aa, Glycine max
  Coding DNA Sequence Number=SeqID_49273
MERSMIDAASAGALGDMTPAEARNLIEKMASNSQQFSARSDAIVIRGVHEVAKNSSGETKKLEGKLDVLVNLVTQLAMNQKSTPVARLCGLCSFADHHIDICPSVQQSEAIEQPKAYVANIYNRPP

SEQ ID NO: 140959 - protein, 107 aa, Glycine max
  Coding DNA Sequence Number=SeqID_49274
MSISPCGRIAPTKTPNELGEVQQGPGVSSSGDGPLLVLQGARSPQQGVPAAPNKVIMPPTNQAFIKKYCALRQAQGETPQQSGDGRQRATDAPPPPLEFTSAHPQKG

SEQ ID NO: 140960 - protein, 129 aa, Glycine max
  Coding DNA Sequence Number=SeqID_49275
  Homolog annotation: Hit_ID=A7PXJ9; Match level="QueryCoverage=61%, HitCoverage=16%, E-value=7e-20, Identity=55%"; Hit description =Chromosome chr12 scaffold_36, whole genome shotgun sequence
  Pfam annotation: Domain name=DUF604; Domain location=16-129; Score= -119.7; E_value=2e-05; Accession=PF04646.3; Description=Protein of unknown function, DUF604
PLVPSKKFPKKAPPSGGSNLARLGELGGKLLPHFPINRERREEQKCSTFLVDLKGNTFGILAAHPLTPLLSLHHPDYSDPIFPNRTTKQAPKHLSEAANVDSQRMRQQAICYDRWFSWTVSVSWGYAVQ

SEQ ID NO: 140961 - protein, 59 aa, Glycine max
  Coding DNA Sequence Number=SeqID_49276
MDSGRFQVSVPGVYHKLLALQWHIRGKARSQLDCGGAFHVSPPRFERHVHDQFGVVGSQ

SEQ ID NO: 140962 - protein, 27 aa, Glycine max
  Coding DNA Sequence Number=SeqID_49277
MDNSPRNYRSFGYFIFNIKYFMKANIV

SEQ ID NO: 140963 - protein, 146 aa, Glycine max
  Coding DNA Sequence Number=SeqID_49278
  Homolog annotation: Hit_ID=A5B6M9; Match level="QueryCoverage=80%, HitCoverage=28%, E-value=5e-10, Identity=36%"; Hit description =Putative uncharacterized protein
MALVRANIEEDSEDTMARFLNGLNLKSEMLLNYRSMWCWMTCYIGRFGLNSKLKEKVQQGGTHPILTTKTGPTDPRRREVIRSDLQPHPRMESQQHPVGHIASECPTRRTMIMKADGEITSESEISEEEVEEEEYEEEAMQGDMLM

SEQ ID NO: 140964 - protein, 316 aa, Glycine max
  Coding DNA Sequence Number=SeqID_49279
  Homolog annotation: Hit_ID=Q6WAY6; Match level="QueryCoverage=83%, HitCoverage=64%, E-value=4e-21, Identity=26%"; Hit description =Putative uncharacterized protein
MGSSQKPSLKKRFYQVKIKSLEVTSLRELGQLMGQLQRQAFRKANGKIWDLARVEVSMEPIASLSQYYDQPLRCFTFEDFQLVPTMKEFKEILGCPLGGKKPYLFSGKGQRPWKIKANGLSFIDILALLIFGVVLFPNMEGLVDLAVIDAGRAFHHGKESPVVAILAMYDTFDRGCPSIRYKEGRIRILSSCEGCPNVPLMGTRGCINPVLAIRQLGYPMRGVPSDESITPFIARGFSDHNARDRELRGSSNGIIGGYHKWLRVRTQGLDWLPNLKTVRDNEVKASEDSDEVQALKAKLERARVVKEKFKSIAIKV

SEQ ID NO: 140965 - protein, 276 aa, Glycine max
  Coding DNA Sequence Number=SeqID_49280
  Gene Ontology: Mol. function=protein transporter activity; Cellular component=membrane; Biological process=protein secretion
  Homolog annotation: Hit_ID=A4W7T4; Match level="QueryCoverage=80%, HitCoverage=76%, E-value=1e-84, Identity=62%"; Hit description =Efflux transporter, RND family, MFP subunit precursor
MPHQPAGAMIVIRCGGDIPGAFCRHRWQTAHPPALLGGALKPSTPSCAPASRHHDAEPRAAVRLAQAEVNSAEATLRQAQQQLSRFESLGSSKAISRHDVDNARMQRDVARAALEQAKARLDARNVTLNYTRITSPIDGRVGHSNFHAGSLVNPASGVLVEVVQLDPIRIAFALEEGAFATKAGQHADISAMKQAWQVFIDSNGQRIRGELTSVDNRIDPRTATEQPVLTLPAAAVQQNGDGFFAWVIASGVKPGERAITDGAQRVQPGAAVQILN

SEQ ID NO: 140966 - protein, 183 aa, Glycine max
  Coding DNA Sequence Number=SeqID_49281
MQTTSSIGAFAVAVTRGEDTIATSRFHGVASPIGDFAMQGGVASQTGEFQAQGTGFSAFLGFLVGRLFQLAGAGVRAKGKVYEENDGVIFEGSKKAIQIKRGISFNALKKKIGDKDVAGGSMFHFANSLSSCGNNLSNNEAQPPRNVSNLHGDDDDDYYYYLVSNSYVEESLDEDDSTAGGSL

SEQ ID NO: 140967 - protein, 87 aa, Glycine max
  Coding DNA Sequence Number=SeqID_49282
  Gene Ontology: Mol. function=catalytic activity; Biological process =metabolic process
  Homolog annotation: Hit_ID=A2Q5Z6; Match level="QueryCoverage=73%, HitCoverage=19%, E-value=8e-10, Identity=50%"; Hit description =Phosphoglycerate/bisphosphoglycerate mutase
MNVKIREDMVVCSQREGEVEGESGHDNALRASEHLHCVMRSDDYSPDWRVQFYVFPYARTQSMLHEFRQCFLKKKIIDVRKESRIRE

SEQ ID NO: 140968 - protein, 91 aa, Glycine max
  Coding DNA Sequence Number=SeqID_49283
  Homolog annotation: Hit_ID=Q84VH5; Match level="QueryCoverage=48%, HitCoverage=6%, E-value=3e-15, Identity=97%"; Hit description =Envelope-like protein
AVSKDALIAELKDTCKVLEATIKATTEKKMELERLIKRLSESGIDDEEAAEQEDEAAEEEVEAAEEEEEATEEEEDAAEDTESDDDSEATP

SEQ ID NO: 140969 - protein, 62 aa, Glycine max
  Coding DNA Sequence Number=SeqID_49284
MTVAEYAVKFEELVRYFPHYQGRDGESSKCVKFLNSLRLEVKQMGHIQRDCPYAKKEQNGGV

SEQ ID NO: 140970 - protein, 126 aa, Glycine max
  Coding DNA Sequence Number=SeqID_49285
MVTSILQLNSMNLFVKARAWFYPITQRKALLIANSSSTFHRDERLGNTHAVHGKYGFMIPTWLAHATYPSAGGRRVTRGMRVPRKEYARSRHQRLFEENVGKTGKDAIYELLSERFGSCIYARGRY

SEQ ID NO: 140971 - protein, 152 aa, Glycine max
  Coding DNA Sequence Number=SeqID_49286
  Gene Ontology: Mol. function=transporter activity; Cellular component= integral to membrane; Biological process=transport
  Homolog annotation: Hit_ID=Q47HB0; Match level="QueryCoverage=90%, HitCoverage=30%, E-value=5e-39, Identity=54%"; Hit description=Major facilitator superfamily MFS_1
  Subcellular localization annotation: CTP_CleavageSite=56; ConfidenceScore=5.19e-01
MAFSATDAGLLLLPSGIALVLTIPLAGRMADRFSPRRITLAGLAIFGASFLVFVFVAMRVQYWEIVAATVVGRIGLGLILPALNLATLHEMEPQHLGQSSVVVWGSVAPGVFQAYAQGFLLLSVVFVLAILVAMGMKDARRQGNQLPSGLED

SEQ ID NO: 140972 - protein, 88 aa, Glycine max
  Coding DNA Sequence Number=SeqID_49287
MQYLGSDPRSSPDEQWLQEFILNQFCGSNAFKGYFDDAKEFKNQEKDSREVSSSSFQESRIMNNQEQDSRIKRILNQDKYEKVFSKAE

SEQ ID NO: 140973 - protein, 181 aa, Glycine max
  Coding DNA Sequence Number=SeqID_49288
  Gene Ontology: Mol. function=transcription elongation regulator activity; Cellular component=integral to membrane; Biological process=regulation of transcription, DNA-dependent
  Homolog annotation: Hit_ID=P0AFG1; Match level="QueryCoverage=99%, HitCoverage=99%, E-value=1e-96, Identity=97%"; Hit description =Transcription antitermination protein nusG
  Pfam annotation: Domain name=KOW; Domain location=130-165; Score =44.8; E_value=3e-10; Accession=PF00467.20; Description=KOW motif
  Pfam annotation: Domain name=NusG; Domain location=7-106; Score =198.8; E_value=1.3e-56; Accession=PF02357.10; Description =Transcription termination factor nusG
  Pfam module annotation: Pfam domain module=KOW::NusG; Domain location= 130-165::7-106
MSEAPKKRWYVVQAFSGFEARVAKSLQEHIKLHNMEELFGEVMVPTEEVVEIRGGQRRKSERKFFPGYVLVQMVMNDASWHLVRSVPRVMGFIGGTSDRPAPISDKEVDAIMNRLQQVGDKPRPKTLFEPGEMVRVNDGPFADFNGVVEEVDYEKSRLKVSVSIFGRATPVELDFAQVEKG

SEQ ID NO: 140974 - protein, 201 aa, Glycine max
  Coding DNA Sequence Number=SeqID_49289
  Homolog annotation: Hit_ID=A5BSR3; Match level="QueryCoverage=51%, HitCoverage=33%, E-value=1e-08, Identity=38%"; Hit description =Putative uncharacterized protein
MARKKKTREMTTEAAKEIAEKIPFEEQATQGSFVPHGRQDVLTAAIGRSEHPGRVRAAGAGVTIKQYFGSAPRTSRNSSSLPPKELQQLTQQIRDQLEESITEKVMRHLMASFSQMQSQIQSQMQSQGLALPPDPLVGPFGPRVSTKGSCVDPSGNDPETGDSDWCGLYIEADLAHLVAMGRVYEGSTVVHNTPLLPGQVK

SEQ ID NO: 140975 - protein, 75 aa, Glycine max
  Coding DNA Sequence Number=SeqID_49290
MSVSSLGSHSPLDRIPEYFFKVLATGVVADGMPLMFNRDKEPCFLFYWQSDPTRFKSYDKDLLTLVERADKTILE

SEQ ID NO: 140976 - protein, 71 aa, Glycine max
  Coding DNA Sequence Number=SeqID_49291
MSQICCGHFIALVCRHNNVGGYLAWASSSEAQQFQWSLPRRVRKTLTKRKEETFLSIKCMEVTNSLKGFKY

SEQ ID NO: 140977 - protein, 273 aa, Glycine max
  Coding DNA Sequence Number=SeqID_49292
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDRELGSPDLCHVVKANSKSVPKELLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140978 - protein, 118 aa, Glycine max
  Coding DNA Sequence Number=SeqID_49293
MEGLVDLAAIDAFLAFHHGKESPVVAILAMYDTFDRGCEKSSARIVCCALALYVWLVSHLFSPRRGCINYNPVLAIRPLGYPMRGVPSGESITPFIARGFSDHNARVLQGVRKAWDAA

SEQ ID NO: 140979 - protein, 85 aa, Glycine max
  Coding DNA Sequence Number=SeqID_49294
  Subcellular localization annotation: CTP_CleavageSite=48; ConfidenceScore=5.29e-01
SWRNHGFYQLFPPVQLLTGWAPLSPSGNLRNCLMRQPGRSSAAFAITPAGAKGGCVHTGDYYVGTVTPGVNSGYNGAEFAVEINA

SEQ ID NO: 140980 - protein, 91 aa, Glycine max
  Coding DNA Sequence Number=SeqID_49295
MKAMKEQMATMMEAMMSMKKIMEANAVAVIATSAVAKVNPMPPSGLNHLNHPTSARVGQMNPIYAQFKQACLPTIWLASQLYTTHRGIHSR

SEQ ID NO: 140981 - protein, 40 aa, Glycine max
  Coding DNA Sequence Number=SeqID_49296
MGDSVSARPISQKSFTKLPELSESTSLSPVYCTRWMNVRP

SEQ ID NO: 140982 - protein, 62 aa, Glycine max
  Coding DNA Sequence Number=SeqID_49297
MTKLGLCVPSDTTVSEWQRGADNRKVSPRIMGADNRKVSPRIIVCRMTKLGLCLPSDTTVSK

SEQ ID NO: 140983 - protein, 113 aa, Glycine max
  Coding DNA Sequence Number=SeqID_49298
MEVPFVCKPTEEQTVRLKIHHGGMFIYNPFIVYVNGQIVEEEWGWDVDIVSYIDVTKVINSLGLNLWSPLQTPVMLRPVMRRAPGRPKKARSKRNDESTNRFKLPRQSKISCL

SEQ ID NO: 140984 - protein, 242 aa, Glycine max
  Coding DNA Sequence Number=SeqID_49299
  Homolog annotation: Hit_ID=Q8Z462; Match level="QueryCoverage=55%, HitCoverage=26%, E-value=8e-61, Identity=82%"; Hit description =Putative uncharacterized protein STY3070
MSLKCGNSANRRNQGRVREFGVFLKSPGELSDIVAGKEPDYPVFGIYSPACGNIEAMVIPADAGNVVTSNTGAASTTASYYGMGVQIISACVCNALALLGQFFWRHWMDLITEKWLPVIFSSGEKTRISLLDLLDNRIQDLAYPRADFQGAAWQMLIGILQCTVAPEDKEDWGDIWQDGIDSENWISALQTLSFALQFGEQKPSFLQSYDPLDSDYGSISGLLVDAPGGNTLKLNKDHFVKR

SEQ ID NO: 140985 - protein, 92 aa, Glycine max
  Coding DNA Sequence Number=SeqID_49300
MAPQRLTHKKVPSEVANCRNMPFCGRVRGEAHGCVFQGGKCAESPPTFICGKRLKNRRKPVIKNIPSSGVVFTFEEGISTSHVCLKGQQPIF

SEQ ID NO: 140986 - protein, 192 aa, Glycine max
  Coding DNA Sequence Number=SeqID_49301
MVEAMMSMEKIMEAKAVVVVATSAVAKVNPMPPSGLNQMNHPTSDIVGKDLGSMGGPHYAQIQIKHAFTPYGLPPNYTPPNMAYTPNKDVNNSAPILIESQQPQSDHATERQAVGGIPLQNTLEGPQFCPQPQPLHFAVGRAPPAMAEKGKLDHIEERLKDIEGGEDYAFANLEELFLVPKHGHSQVQGVGL

SEQ ID NO: 140987 - protein, 101 aa, Glycine max
  Coding DNA Sequence Number=SeqID_49302
IGNDIHGARKKSGEWRIGEQRYAITLRAPDSYVEDTRIALGNDIHGAPKKSAEWRIGEQRYAITSRGSRLVGGAHRIALGSDILGLRKKVENGELANSATK

SEQ ID NO: 140988 - protein, 108 aa, Glycine max
  Coding DNA Sequence Number=SeqID_49303
  Homolog annotation: Hit_ID=A7R311; Match level="QueryCoverage=33%, HitCoverage=10%, E-value=1e-07, Identity=72%"; Hit description =Chromosome undetermined scaffold_470, whole genome shotgun sequence
MFLHVGLSQQVVIAKHKGYVSGSLSDEGKVELGGDSGKSESSLEKGLVDRSDASDVDAKVDNMARCFRTNQRILVLSAAKVAKKMKLKFTKEWIAYLRLPLPIDVYKE

SEQ ID NO: 140989 - protein, 136 aa, Glycine max
  Coding DNA Sequence Number=SeqID_49304
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
MTPEGHHRFVWESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 140990 - protein, 122 aa, Glycine max
  Coding DNA Sequence Number=SeqID_49305
MKDDIGHILDLTPKGEKMKESLKRLTLTSHTSMGRTMTYYLSMPHHETMIMKGQDIYSSQDEATTSHSSSESEEAKGKESSEEIYPQEEGQPLKVKEERKEVCVSSKRLAKKGKSFYNKDKH

SEQ ID NO: 140991 - protein, 213 aa, Glycine max
  Coding DNA Sequence Number=SeqID_49306
  Homolog annotation: Hit_ID=Q6L477; Match level="QueryCoverage=80%, HitCoverage=31%, E-value=1e-07, Identity=24%"; Hit description =Putative uncharacterized protein OSJNBa0009L15.8
VHVDPATRKADGPHRKKLRTYLGIVARDKVDITYENWKEVRTAQKDLIWEDIQAEFDIPEASDNLTRKWALAADQDSAEDTVCDKYDISKEKWAQFCQTRRDPSWEAIQKQNTAPHVLSHGGYDYLEQKLLAEKTKKKVQEAAQSGNVDGVIDPPSLVRRHVKWKMARTKKTGEMTTEAAKKIAEKIPYRDRSSPMDVRMFWPLLLDVQSTLD

SEQ ID NO: 140992 - protein, 216 aa, Glycine max
  Coding DNA Sequence Number=SeqID_49307
  Homolog annotation: Hit_ID=A7R5Q5; Match level="QueryCoverage=49%, HitCoverage=22%, E-value=4e-09, Identity=34%"; Hit description =Chromosome undetermined scaffold_1022, whole genome shotgun sequence
CITRGNPCDLQPFDPEIDRTIHRLVRHSVHPGHSMHFEHSEYSVAGDSEYSDFEHLTTNFHTENIAQPPPHERTLREMTAPDFTYESLCIQYPDEGVPYVLKTGLIHLLPKFHGLIGEDPHKHLKEFHIVCSTMKPPDVQEDHIFLKAFPHSLEWQKIDYTTLLPGPFSARMTLRLAILPCSHESEIYTYCKSLWSMFLCRSPYRSMSFFAAIWGQ

SEQ ID NO: 140993 - protein, 128 aa, Glycine max
  Coding DNA Sequence Number=SeqID_49308
MNLIIVINGKGHALRRPYRTRARARVMGEVEEIQEKMKADMEAIKEKMATMMEAMMSVKKIMEANAVIVAATSAVAKVNPMLPSGLKQMNHPTSNMVGKDLGSTDDPMMCKFKTSTPSHHMACLLGIL

SEQ ID NO: 140994 - protein, 181 aa, Glycine max
  Coding DNA Sequence Number=SeqID_49309
  Gene Ontology: Mol. function=RNA-directed DNA polymerase activity; Biological process=regulation of transcription, DNA-dependent
  Homolog annotation: Hit_ID=Q8H6Q8; Match level="QueryCoverage=71%, HitCoverage=43%, E-value=5e-35, Identity=55%"; Hit description=CTV.20
QHFIGDPSLWKDRSAELLSNLKCRTLADFRWYRDTFLTRVYTREDSQRPFWKEKFLAGLPRSLGDKVRDKIRSQSANGDIPYESLSYGQLISYVQKVALKICQDDKIQRQLAKEKAQTKRDLGSFCEQFGLPACPKQKKKQSSKKEIHENKPINTKRFPRRRYSHKPSTSRGMENPKQKTK

SEQ ID NO: 140995 - protein, 71 aa, Glycine max
  Coding DNA Sequence Number=SeqID_49310
MNYLFLKICVLIVPELVASLSVERPSFDGLETLLVLCAPETMAVKLRSGAGSFGRGVPPRSLYGELPQWYF

SEQ ID NO: 140996 - protein, 177 aa, Glycine max
  Coding DNA Sequence Number=SeqID_49311
LTSHDALLAQNKLLSKNLEILMETLGCTMCGEANETGQCIPTEENTQEIHFMRNQQRLGYTQGGFSSFQQGPYNQQGQTTKLEETLTQFMQVMMSDHNSIESTLKNLEVQVGQLAKQIVDKSFNSFGANTGNNPKEECKAMMTRSKKFVEAEDEESVVYKEQMGEKIGAEVKENDVK

SEQ ID NO: 140997 - protein, 297 aa, Glycine max
  Coding DNA Sequence Number=SeqID_49312
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPGELELHRGGGRSRTSGSPGLQEFDHKYKHMVIDTKHTSTHSNYIQIDGHNNMQTTKLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 140998 - protein, 95 aa, Glycine max
  Coding DNA Sequence Number=SeqID_49313
MRGYLMVTHTFRQPGENEPVEARRRTSFSAPFVILTRQVRVIRTFRQPKAYEPVDARRLTSSSAPFVVLTHEVRGHTGLPYCYPHSSSTMGKRAK

SEQ ID NO: 140999 - protein, 90 aa, Glycine max
  Coding DNA Sequence Number=SeqID_49314
GSPPLDRFIGIRGGFELDPKQRLTSPYQRKPLVKERGEACLLVRVRGKGFSKAQSLACCFRAGARWVVKWSVKIEAAVGEKTPVRPASTG

SEQ ID NO: 141000 - protein, 289 aa, Glycine max
  Coding DNA Sequence Number=SeqID_49315
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIGYINAAVNYGGDQGHVSAKIYTAEAMSSGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141001 - protein, 183 aa, Glycine max
  Coding DNA Sequence Number=SeqID_49316
MRASGNRLPRECNRLPCLELEAAGCRGLWDGSLVIDYQIVMATQLIHDRVEMECLEGAWETLEGNTRCRFRGTIRFTATSLVHPDEPMRTLQRTVEWILPTPTPYCLVEPVQVIEVTSSEEDPEEDPEELPPEPAVDALDFLEGDEDPLPEVDSPEEVMSASEADSTEDSGPREMATSGGSSS

SEQ ID NO: 141002 - protein, 105 aa, Glycine max
  Coding DNA Sequence Number=SeqID_49317
MAIEDESSYVQQGLVEALDGEDKLEKMMADGGKESTTAEGHTVQIILSLGDKVVEAKTLLFGRDSVSLDEVQAALNSKESNERKEKKSSTRGEGLTARGKPSRKI

SEQ ID NO: 141003 - protein, 167 aa, Glycine max
  Coding DNA Sequence Number=SeqID_49318
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=51%, HitCoverage=73%, E-value=2e-24, Identity=68%"; Hit description=LacZ protein
MKHFTDTLISANIGNIGSQDSVRIGKVVHGTIAAPIHVYCWLLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141004 - protein, 222 aa, Glycine max
  Coding DNA Sequence Number=SeqID_49319
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=23%, HitCoverage=50%, E-value=1e-23, Identity=100%"; Hit description=LacZ protein
MKHFTDTLISANIGTKAGTGPPLEVDGIDKLDASQIRYPILRAIQKWLSGFLHCRKNSDGVVTNRDAYLTRGHRCNVGYMYLQATPRPHHHWCFHCQVGTLPGPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141005 - protein, 237 aa, Glycine max
  Coding DNA Sequence Number=SeqID_49320
MFVDPANAKTATLGEVAEALQYMVSPQGRNTCTFDDLVPYVEKITILSEEQERVTEPVSHGPASERQFPAQQFHMLQSSIETQGIDRRRDIVEAEEYSQQMAERGHGMYYTPQTFAEYPTQMYQYPFQGHHTDTSASQQSFGGVAETQAHFSWPTMTPSQQYHGPIPTPNAPLGTQWNVPGPIPNTGDLFGVDLRHAFSAELTKKKRGGIGAEEILIAKHEDGIDMWHILTTSRTPK

SEQ ID NO: 141006 - protein, 93 aa, Glycine max
  Coding DNA Sequence Number=SeqID_49321
MESPKAVRTLPVRREGERDSKTDEERMFHQERRRTVRHQRLEISTENVRKNVSEKTPRLDFLTETIFPRNSKEREVIYANGANIFSIPPSAHL

SEQ ID NO: 141007 - protein, 192 aa, Glycine max
  Coding DNA Sequence Number=SeqID_49322
METCLAVEDLLQQMIDQGRLEVGDEGREEQHICMQSTDERSFGRPKPLVVYFTKDVTPQIPRYPSVVKPVLFPYRNSHTVPWRYAPPSERKEEATDISSLSAKVTNITVLSGVTRSGRVFAPPDLPTQPANVKGKTKMVEEQDDKTTLTPNEDIPVKGLSEKRDGCGKKEVSLEEASEFLRIIQQSEFKVIK

SEQ ID NO: 141008 - protein, 136 aa, Glycine max
  Coding DNA Sequence Number=SeqID_49323
  Homolog annotation: Hit_ID=UPI00006A2D9E; Match level="QueryCoverage =85%, HitCoverage=65%, E-value=5e-10, Identity=17%"; Hit description =UPI00006A2D9E related cluster
MRGPLKESTSCFLVRLKSFGTCTYWLAFRGLHVLTFKGLHALAIKGLHVLTFRGLHALAIRGLHVLTFVGLHVLTFVGLHALTFGGLHVLANRGLHALTFRGLHVLAFRGLHVLAFKGLHALAIRGLHVLTFRGLH

SEQ ID NO: 141009 - protein, 154 aa, Glycine max
  Coding DNA Sequence Number=SeqID_49324
  Homolog annotation: Hit_ID=A5BSR3; Match level="QueryCoverage=51%, HitCoverage=25%, E-value=6e-10, Identity=45%"; Hit description =Putative uncharacterized protein
DVRKKAQAIQKQNTAPHILSHGGYDYLEQKLLAEKTKKKLEEAAQLGSFYGVIDPPSPVRRHVKWKMARTKKTGEMTTEAAKEIAAKIDSFEDQATQGSFVPHGRQDVLATVVGRREHPGRVRAAEAGVTIKQYFGSAPRTSHNSSSLPPEELQ

SEQ ID NO: 141010 - protein, 200 aa, Glycine max
  Coding DNA Sequence Number=SeqID_49325
HDLEIPNSENAQNWVVNLVFQFHDDPTVNKSEIVIFLRQGCLTDYPSERQFDECLKKFKMAYSPWPMFVDYCVDYAGKNPSSCGCMVRTTLGLPCSCELSKYVGGCIPLDSIHMFWRRLSFSDQGLCEPEVSIKAEIETISKRFEELDVSTKGAPKKPMSRNPRSTKRDPSYLEYVDAFESMQNSNSSVRRSASSSEQPN

SEQ ID NO: 141011 - protein, 218 aa, Glycine max
  Coding DNA Sequence Number=SeqID_49326
  Gene Ontology: Mol. function=aspartic-type endopeptidase activity; Cellular component=small subunit processome; Biological process=DNA integration
  Homolog annotation: Hit_ID=A5AFV0; Match level="QueryCoverage=99%, HitCoverage=17%, E-value=1e-21, Identity=30%"; Hit description =Putative uncharacterized protein
  Pfam annotation: Domain name=zf-CCHC; Domain location=126-143; Score =13.4; E_value=0.014; Accession=PF00098.14; Description=Zinc knuckle
MKVTALKQTSHDMIAHIGKARAAVEELKRFLVADSLEEVNKKLDKFYMVLILRSLHSDFDHMRDQVLAGDQVPSMDSLITRLLRVPHVLKEENPADTMETSAMVATRGRGGGRNSRGGRSSRGGRPQCSYCKRMGHTQENCYSLHGFPDKVAKVAQTEKSESKFSNEEYQEYLKLKYEKSSSQASSSSVPCYSTACISQSIDGPSPWILDSGASDHIS

SEQ ID NO: 141012 - protein, 252 aa, Glycine max
  Coding DNA Sequence Number=SeqID_49327
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFNRKSIRAINIMNIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141013 - protein, 143 aa, Glycine max
  Coding DNA Sequence Number=SeqID_49328
  Homolog annotation: Hit_ID=A5C6C9; Match level="QueryCoverage=78%, HitCoverage=9%, E-value=3e-11, Identity=34%"; Hit description =Serine/threonine protein phosphatase
MGGRIKFFDRVFNRHWRSGTYILVCREVAPGDKYFPSSSGGDALRDLTQTRRYAWGAAGLIHMYDHLNDASINTSRQVTGYITLLQCWIYEHFPSIAECNADLEYDEVSPRACRWIATKKTVKKISTSMYRQRLNCLKIPNVC

SEQ ID NO: 141014 - protein, 89 aa, Glycine max
  Coding DNA Sequence Number=SeqID_49329
MVGYTPSSFADLVFAEGENEGETHAVTVIPIQPSFPPTQQCHYSANNKPFPYPPPSYPQRSSLKQPQSLSTALPMTNTTFSTNQNTTKK

SEQ ID NO: 141015 - protein, 83 aa, Glycine max
  Coding DNA Sequence Number=SeqID_49330
  Homolog annotation: Hit_ID=Q2HW90; Match level="QueryCoverage=74%, HitCoverage=13%, E-value=6e-13, Identity=56%"; Hit description =Putative uncharacterized protein
MDVVRPGVVPQSDNIRKWSMTLGTWELASLVSDPVDFQAHHGKLLRILRVDVEERCLETLVQFYDPLYHCFTFPDYQLVPTLE

SEQ ID NO: 141016 - protein, 209 aa, Glycine max
  Coding DNA Sequence Number=SeqID_49331
  Subcellular localization annotation: CTP_CleavageSite=76; ConfidenceScore=5.62e-01
MLPPAENSAISTPVGSKVARSWTVTFWPLNSISPPAERSEARTLRVPTGKSRSARIDNMVSPTAPVAPTTATWKLRCALLMGETLTKTGIGKKHARQLGSGNLLKRGARRFPIVSRVDRARHARRAAVQAEPGNQIIDGQLYHRRARGQRGAADMRSEHHVAQRQQLRAHLRLALVHIQARCSQAAVGQCIGQRDFIDQAAAGDVHQRR

SEQ ID NO: 141017 - protein, 84 aa, Glycine max
  Coding DNA Sequence Number=SeqID_49332
MSSPSEGCTPSPSEDYTSSPSRGLHALAFRGLHILALRGLHALAMRGLQVLTFRGLHALAFRGLHVLTFRGLHALALRGLHASP

SEQ ID NO: 141018 - protein, 136 aa, Glycine max
  Coding DNA Sequence Number=SeqID_49333
MIYEAPTPTRTPDTNGYGHVDTCNVQNIERNTCVVSVSDTDTDACRTPDTTRHWSGKVAYNIPPPYLRIAKSLWAMGYEKMLANFTLELAIPTRLAPQTLKIPQPLTKKFIAKDEENTEDHGGHEPNPWEGNQENL

SEQ ID NO: 141019 - protein, 407 aa, Glycine max
  Coding DNA Sequence Number=SeqID_49334
  Gene Ontology: Mol. function=glycerate kinase activity; Cellular component=chloroplast; Biological process=oxidative photosynthetic carbon pathway
  Homolog annotation: Hit_ID=A7P7I0; Match level="QueryCoverage=79%, HitCoverage=93%, E-value=1e-134, Identity=67%"; Hit description =Chromosome chr9 scaffold_7, whole genome shotgun sequence
  Subcellular localization annotation: CTP_CleavageSite=96; ConfidenceScore=5.59e-01
MATLNLFSQPWQPTISPFCCSNTNNNNNVVYAYHNHNNSKLHFFSNSRQFSVLSQLSTNSSKSVSGSSGLQNSSFVSGIEYRKRPLYSVFPTKPAQVSSVEDLYEFICSGPLLDKIGITQEQVAESIDNWLLYGRYLCRLFQLNELFLTEPQKARIYHYYVPVFLWCEQQITEHQSKFKDGEDIPPLVIGFSAPQGCGKTTLVFALDYLFEVIGRKSATVSIDDFYLMAEGQNKLREANPGNALLEFLKANCLLMQSAFNGRGDRADPSTWSEVEGPLTVVLFEGWMLGFKPLPVDAVKVVDPQLETVNKNLEAYYDAWDKYIKSWIVIKIKNPNCVFQWRLQAEIAMREAGKPGMTDDEVRDFVSRYLPAYYAYLPTLYSEGPNGSDPQHLLTIEIDEGRNPILAT

SEQ ID NO: 141020 - protein, 306 aa, Glycine max
  Coding DNA Sequence Number=SeqID_49335
  Gene Ontology: Mol. function=nucleoside-triphosphatase activity; Cellular component=integral to membrane; Biological process=transport
  Homolog annotation: Hit_ID=A7P7L7; Match level="QueryCoverage=98%, HitCoverage=63%, E-value=1e-98, Identity=44%"; Hit description =Chromosome chr9 scaffold_7, whole genome shotgun sequence
  Pfam annotation: Domain name=ABC2_membrane; Domain location=36-248; Score=208.4; E_value=1.7e-59; Accession=PF01061.15; Description=ABC -2 type transporter
MSYVRRNKALAAELSKHAPGSKELHFPTQYAQPFFVQCKACQWKQHWRNPPYTVVKFLFTTFVALMFGTMFWDLGFRTRRKQDLFNAIGSMYNAIIFLGIQNAFFVQPVVAIERTVFYRERAAGMYSAIPYALAQVVIELPYIFVQAVTYGIIVYAMIGFELTASKFFWYLFFMYFTFLYFTFYGMMTVAVTPNQHIASIVATAFYGVSNLFSGFVVSRPFYIPVWWRWYYWACPVAWSLYGLVASQFGDVTSAVELNETVKEFFRRYFGYRDDFVGVAAGVVVGFALLFATIFAFSVKVFNFERR

SEQ ID NO: 141021 - protein, 227 aa, Glycine max
  Coding DNA Sequence Number=SeqID_49336
  Gene Ontology: Mol. function=binding
  Homolog annotation: Hit_ID=Q593S0; Match level="QueryCoverage=50%, HitCoverage=54%, E-value=2e-21, Identity=42%"; Hit description =Expressed protein
MASDVAVKVISFIPNSLLQFHMLDLVYCLSSLLSSHQVEVATPCAIALNLVISNLSATSEKAVMEALKETETSMRIVGNRKDFAEGAKKIEYFEETTLLLSTILWRWPPSRFPVARKLIEDGEVFPQMFVLAQCLLVNFYFTFTVLMLSNYTNSNFSFVYSLSFVDTLEKWCRICQKDIADPFQGEPVSRAVLVMIHSPRNSISSHARFLLLDVLNAKGLSGLKSLI

SEQ ID NO: 141022 - protein, 383 aa, Glycine max
  Coding DNA Sequence Number=SeqID_49337
  Gene Ontology: Cellular component=mitochondrion
  Homolog annotation: Hit_ID=Q9CA94; Match level="QueryCoverage=70%, HitCoverage=69%, E-value=2e-54, Identity=41%"; Hit description =Putative uncharacterized protein F19K16.13
  Pfam annotation: Domain name=DUF292; Domain location=2-125; Score =89.7; E_value=9.3e-24; Accession=PF03398.5; Description=Eukaryotic protein of unknown function, DUF292
MRLETICKKRSAVQKFLKKDIADLLRSALDYNAYGRSLHLKQAEGVLVEQNLTFCYEIIGKFTTCILGHVGDLYKQRDCPAECKEAIQSLIYAAARFSDLPELRELRSLFTGKFGNSLELYISKEFVEKLRQYPPSKEMKIQLLHDVAQEFSIEWNSKALEQRLHSPPQLHLEKAKPDLLNDHEDHKNNDVSLFEGKKDTSDAYWRSPRSSTEDDNSSLDGHNKACSSSLGSVSEDETEIKRPFSYNLVPPPYVKQKLKKGESNMNKPTKSEEALKLPHEDNNTFSDSKTCGTAKLEDSSGKESEKAKKQPQQTKPAEEEEKERTVDGLLMHYTRKQSPHPCFQHDKGPEMVRRTARHVHPSLPDYDDLLARLAALKKTTQPA

SEQ ID NO: 141023 - protein, 230 aa, Glycine max
  Coding DNA Sequence Number=SeqID_49338
  Gene Ontology: Mol. function=acetyl-CoA carboxylase activity; Cellular component=acetyl-CoA carboxylase complex; Biological process=regulation of transcription, DNA-dependent
  Homolog annotation: Hit_ID=Q2HVX5; Match level="QueryCoverage=100%, HitCoverage=96%, E-value=1e-62, Identity=53%"; Hit description =Biotin/lipoyl attachment
  Pfam annotation: Domain name=Biotin_lipoyl; Domain location=142-219; Score=18.3; E_value=8.9e-05; Accession=PF00364.13; Description =Biotin-requiring enzyme
  Subcellular localization annotation: CTP_CleavageSite=75; ConfidenceScore=5.52e-01
MTGSIGTPNIKVLNLHFGGKKVGLSRQFGTRSWISRLQYTSLVMSRQTVRFLASSNGPSTEIQFAARSEGSEEIRSSGLTSGVPAHKIMRHKFNWGVRFKKTPKTNGSVPTTSLAVSKPVDPVPSSGSIQRFLDKAADEGLVIIQSPKVGFFRRSRTIKGKRAPPSCKEKQNVEEGQVICYIEQLGGELPIESDVSGEVIKILRQDGDPVGYGDALVAILPSFPGIKKLQ

SEQ ID NO: 141024 - protein, 328 aa, Glycine max
  Coding DNA Sequence Number=SeqID_49339
  Gene Ontology: Mol. function=racemase and epimerase activity, acting on amino acids and derivatives; Biological process=amino acid metabolic process
  Homolog annotation: Hit_ID=Q2HVX3; Match level="QueryCoverage=92%, HitCoverage=91%, E-value=1e-106, Identity=68%"; Hit description =Asp/Glu racemase
  Pfam annotation: Domain name=Asp_Glu_race; Domain location=76-322; Score=3.5; E_value=0.00039; Accession=PF01177.13; Description =AspGluHydantoin racemase
  Subcellular localization annotation: CTP_CleavageSite=73; ConfidenceScore=5.15e-01
MSAQGLFYRMVLVHRFSNSGTQMGIYLSKTRRCLVQATPPSSVILNADGSGKFSEKLHVPNLDSGRGAPFVIQGSAVGIIGGVSVDATLKFLRKLVEFSSQDGVNSTPFVLCSDPLLSKELLSYERSYFVSSTSKAENLKLDSSPIVQTLRNKRVFLENSGTSCIVMPCNVSHSWYEQVSEGCSVPVFHMAECVAKELKEAKLKPLEAGSPLRIGVLATNATLAAGFYKEKLQNEGFDVVLPDRATMEHTVIPAIEALNRKDMEGACNLLRIALQVLLVRAANFIILASDDMRDLLPPDDPLIKKCIDPMDALARSTIKWVKSSGQNT

SEQ ID NO: 141025 - protein, 1025 aa, Glycine max
  Coding DNA Sequence Number=SeqID_49340
  Gene Ontology: Mol. function=nucleotide binding; Cellular component =nucleus; Biological process=metabolic process
  Homolog annotation: Hit_ID=A7PKZ8; Match level="QueryCoverage=97%, HitCoverage=98%, E-value=0.0, Identity=68%"; Hit description =Chromosome chr7 scaffold_20, whole genome shotgun sequence
  Pfam annotation: Domain name=DUF1726; Domain location=106-200; Score =193.1; E_value=6.9e-55; Accession=PF08351.2; Description=Domain of unknown function (DUF1726)
  Pfam annotation: Domain name=DUF699; Domain location=278-456; Score =285.0; E_value=1.5e-82; Accession=PF05127.5; Description=Putative ATPase (DUF699)
  Pfam module annotation: Pfam domain module=DUF1726::DUF699; Domain location=106-200::278-456
MRKRIDERIRTLIENGVKTRHRSMFVIIGDKSLDQIVNLHYMLSKAQMKSKPTMLWCYNHKLQLSSKKEKRHRQIQKLRLRGLLDHEKVDAFSLFMETKDITYCLYKDSEKILGNTFGMCILQDFETLTPNLLARTIETVEGGGLIVLLLGSLSSLTSLYTMVMDVHKRFRTESHSEAAGRFNERFLLSIASCKACLVMDDEMNILPISSHIRSITPVLVNEDAEGLSKAKQGLKKLKEQLSENYLVGLIRKCCTLDQGHAVVTFLDAILSKTLRGTVALLAGRGCGKSAALGLSIAGAIAAGYSNIFVTAPSPDNLKTLFEFILKGFEALDYKEHINVVKSGKNTYILPHEHEKLSLAELLVVDEAAAIPLSMVKSLLGPYLVFLSSTVNGYEGTGHSLTLKLLHQLEAQSNTFSKSTEGTDSGYLFKKIELSESIRYASGDPIESWLNKLLCLDVSNAIPNLSSRFLPPCSECDLYYVNRDTLFSYHRDSELFLQRMMALYVASDYKNSPNDIQLMADAPAHHLFVLLGPVDESKNQLPDILCVIQVSLEGQISRQSVKQSLSNGHIPSGDQIPWKFCEQYQDTVFPSLSGARIVRIATHPDDMKHGYGSQAVELLIRYYEGRLTPISGIDVDDEVQTSQIRVTEAAEKVSLLEENIKPRKELPHLLVHLRERRPEKLHYIGVSFGLTLDLFRFWRKLKFAPFYISQIPNTVTGEHSIMVLKPLNNDEIKVDGSNQWGFVSPFYQDFRQRFFRLLASNFRGMEFKLAMSILDPKINFEEQDPSKTASHKFMGSVREYLSPHDMKRLKAYVSNFADFNLHLILDLVPILARLYFEEKLPVKLSYVQASVLLCIGLQNHNILYIEGQMKLERQQLLSEFRRIMKLFYNYLNGLASKEIESTLPRMKEIVMEPHSVSVDDDLNNAAKQVEDGMKLKAEAPVTPELLQRYAIVEGESDLETVLQNNRGKIPIGGLISVKSSSKPEMMKRSRKNDKKRTRFFWSHNHFFWWNCSYNHKLSKRRRTIQD

SEQ ID NO: 141026 - protein, 77 aa, Glycine max
  Coding DNA Sequence Number=SeqID_49341
  Homolog annotation: Hit_ID=A7NZV1; Match level="QueryCoverage=64%, HitCoverage=10%, E-value=5e-09, Identity=61%"; Hit description =Chromosome chr6 scaffold_3, whole genome shotgun sequence
MGLVGDAFKWLRARWNSMLESLSQGVSILGWPMATKQFYNLKLLEREVEVAGGKNFETKCEDIVVWGLEGGRGRGCW

SEQ ID NO: 141027 - protein, 414 aa, Glycine max
  Coding DNA Sequence Number=SeqID_49342
  Gene Ontology: Mol. function=hydrolase activity, acting on glycosyl bonds; Cellular component=cellulose and pectin-containing cell wall; Biological process=cell wall organization and biogenesis
  Homolog annotation: Hit_ID=Q2HUB1; Match level="QueryCoverage=92%, HitCoverage=100%, E-value=1e-168, Identity=74%"; Hit description =Glycoside hydrolase, family 28
  Pfam annotation: Domain name=Glyco_hydro_28; Domain location=73-403; Score=317.3; E_value=2.9e-92; Accession=PF00295.8; Description =Glycosyl hydrolases family 28
MVYVQKKAYAYTFASCAYREKKEFFFTVLIILSVITPGLSSTTTSFNVLQYGAVGNGQTNDSPAFLKAWKAACQSNSHISRLIIPAKRTFLLKPTTFSGPCKSNYTYIQLSGNIIAPKTKSEYSGFHTNTWLGFSFVNGLAISGKGTIDGRGSAWWQQPCVGNPLPAVTFNRCNRLQLKGYTSINPARSHMTLTSCKKGIISNIRLIAPGTSPNTDGIDISGSTDIQVLNSFIATGDDCIAISAGSSKIKITGITCGPGHGISIGSLGTRGETDIVEDVHVENCTLTETLTGVRIKTWQGGAGYARRITFEKIRFVRANNPIIIDQFYCPHRSDCQNQTRAIKISDVTYKGIVGTSLTDKAINLSCDQNVGCSNIVLDHVYITPSVPGQKVFSYCHNAHGIATHTKPSVKCLLK

SEQ ID NO: 141028 - protein, 271 aa, Glycine max
  Coding DNA Sequence Number=SeqID_49343
  Gene Ontology: Mol. function=tetracycline:hydrogen antiporter activity; Cellular component=cytoplasm; Biological process=response to antibiotic
  Homolog annotation: Hit_ID=A7QAQ9; Match level="QueryCoverage=76%, HitCoverage=43%, E-value=2e-79, Identity=73%"; Hit description =Chromosome chr5 scaffold_72, whole genome shotgun sequence
  Pfam annotation: Domain name=Diphthamide_syn; Domain location=1-159; Score=-146.4; E_value=0.0024; Accession=PF01866.8; Description =Putative diphthamide synthesis protein
MGSKNPSVIAMEQVGLYIALEDWRGNYLRDKAWTTTCSFGLDMMIQLLLMLCSHSMPILPGVGILVGTLGVAGYLHIINQMMELITGAGKKAYTLVMGRPNPAKLANFPECDVFLYVSCAQTALLDSKEYLAPVITPFEAMIAFNRGSQWTGAYVMEFRDLINLPQMEVGNQEEEARFSFLKGGYVDDFENQENAEEERETLALVNATEKALQLQNNSNALMKGNARSGVEFLANRSYQGLNMSSENASPEPYLIGRRGRASGYEDEKKKQ

SEQ ID NO: 141029 - protein, 119 aa, Glycine max
  Coding DNA Sequence Number=SeqID_49344
  Homolog annotation: Hit_ID=A9PHG7; Match level="QueryCoverage=52%, HitCoverage=41%, E-value=6e-13, Identity=64%"; Hit description =Putative uncharacterized protein
MQHQHGGFRFRLLVYLSSTAGKMSGALLGGKKKLTQQYQTRPCSSKSTEHQNYTSSSQEDLVYVGKLVAGSFAGGAAIKYGSALFPEITTPNLVVALLLILTPVLVAVFLLIKESRTNP

SEQ ID NO: 141030 - protein, 295 aa, Glycine max
  Coding DNA Sequence Number=SeqID_49345
  Gene Ontology: Mol. function=oxidoreductase activity, acting on single donors with incorporation of molecular oxygen, incorporation of two atoms of oxygen; Cellular component=cytoplasm; Biological process=flavonoid biosynthetic process
  Homolog annotation: Hit_ID=A7QQA0; Match level="QueryCoverage=81%, HitCoverage=76%, E-value=1e-71, Identity=55%"; Hit description =Chromosome undetermined scaffold_141, whole genome shotgun sequence
MEGISIAAIQACTRNGPKWGGTTSTLCLPPPYAINYGTSSSLLDKVRQVAREFFEQPMEQKKIISKGVEEFEGYGADPVPEEGQSLDWSDRLFLDVSEDTRKPSLWPENPSSLRDAVEEYSAKMREATNLISKAIAKSLDLEENCFLNQFGEQALLQGRISQRGRKTKSKKILYEKYAPRSTIKDGQVDSHLNDKFVLFCHIMTNGIFKSPVHRVLANSKRERISVAMFYTPEPNKEIGPEQSLVNEEQPRYYADTHWKYYQRGMRAIHVAKDITVVARLLESRALNKIKPIDAN

SEQ ID NO: 141031 - protein, 261 aa, Glycine max
  Coding DNA Sequence Number=SeqID_49346
  Gene Ontology: Mol. function=NADH dehydrogenase (ubiquinone) activity; Cellular component=mitochondrial respiratory chain; Biological process=electron transport
  Homolog annotation: Hit_ID=A7PUK9; Match level="QueryCoverage=75%, HitCoverage=67%, E-value=6e-76, Identity=74%"; Hit description =Chromosome chr7 scaffold_31, whole genome shotgun sequence
  Pfam annotation: Domain name=Complex1_24kDa; Domain location=75-246; Score=137.8; E_value=3.1e-38; Accession=PF01257.10; Description =Respiratory-chain NADH dehydrogenase 2
  Subcellular localization annotation: CTP_CleavageSite=27; ConfidenceScore=5.62e-01
MFSYTTPFTSPSLLSLSLSLCDLLRVVASSSKMLARLAASRFNEIRQIFRQPSRAFSTALNYHLDTPDNNPKLPWEFTEANQAKVKEILSHYPSNYKQSATIPLLDLAQQQHGGWLPVSAMDAVAKIVEVPPIRVYEVATFYSMFNRAKVKAYYAFMLSMLLIHINTGQSLSGPTCFQVGKYHLLVCGTTPCMIRGSRGIEEALLKHLGVKRNEVTPDGLFSVGEMECMLRASPGAAVKLCLGDLLVMGSNPETTSLHMQG

SEQ ID NO: 141032 - protein, 423 aa, Glycine max
  Coding DNA Sequence Number=SeqID_49347
  Gene Ontology: Mol. function=DNA binding; Biological process =regulation of transcription
  Homolog annotation: Hit_ID=A5CA72; Match level="QueryCoverage=86%, HitCoverage=89%, E-value=2e-75, Identity=43%"; Hit description =Putative uncharacterized protein
MDGIEDDARYPPNPYGYGYQNSLYSPPVDTEYALDDNDENEEHVQLEGEDEVDVDQSNNLQLPQKDDDEEDGMDGGGDENDDDEEEEAEENKQIDYYPTKSDEDEVEWHPKKQKLKSLISTYELAPRVPAPSVAATAPSVPKPSSGGRNSLTDWTERETFVLLDAWGDRFLQHGRKSLRCEEWQQIAKMVSQVSKIERTDTQCRNRLDTLKKKYKKEKAKFPDSDGGACKWVYFKSMDELMASPPQQAGLSCGVDSGEYVFMNPRVHLNHANGLDEMRDSPDNTESTGEEGSDGPQAKKRKKRRGSGEASSFRLLADSIQKFSKIYEKIENSKRQQMVELEKMRMDFHKELETQKRQILENLRCEISKLEQRNDDNDDSAENGFYNVHNYPLPPKSHLNSYPAIPPHAPRDAGTHVGMWHVPC

SEQ ID NO: 141033 - protein, 107 aa, Glycine max
  Coding DNA Sequence Number=SeqID_49348
  Homolog annotation: Hit_ID=A9PF13; Match level="QueryCoverage=30%, HitCoverage=7%, E-value=3e-09, Identity=84%"; Hit description =Putative uncharacterized protein
LTERNGEEHYTEEQEEQNGEEGSQEEAVVVDADSTDGAVLVNGNEADEEWGTNNEGAPACATSLGPIKTVGSSFWDFYLRSSQGATKRFYGLCPEFCHFARGMNNIP

SEQ ID NO: 141034 - protein, 390 aa, Glycine max
  Coding DNA Sequence Number=SeqID_49349
  Gene Ontology: Mol. function=transferase activity; Cellular component= transcription factor complex; Biological process=positive regulation of transcription, DNA-dependent
  Homolog annotation: Hit_ID=A7P7G9; Match level="QueryCoverage=96%, HitCoverage=38%, E-value=1e-168, Identity=81%"; Hit description =Chromosome chr9 scaffold_7, whole genome shotgun sequence
  Pfam annotation: Domain name=TPR_1; Domain location=43-76; Score=1.1; E_value=4; Accession=PF00515.19; Description=Tetratricopeptide repeat
  Pfam annotation: Domain name=TPR_1; Domain location=77-110; Score =30.8; E_value=5e-06; Accession=PF00515.19; Description =Tetratricopeptide repeat
  Pfam annotation: Domain name=TPR_2; Domain location=230-263; Score =6.6; E_value=4.6; Accession=PF07719.8; Description=Tetratricopeptide repeat
  Pfam annotation: Domain name=TPR_2; Domain location=43-76; Score=0.2; E_value=28; Accession=PF07719.8; Description=Tetratricopeptide repeat
  Pfam annotation: Domain name=TPR_2; Domain location=77-110; Score =33.4; E_value=8.1e-07; Accession=PF07719.8; Description =Tetratricopeptide repeat
  Pfam annotation: Domain name=TPR_2; Domain location=9-42; Score=0.6; E_value=25; Accession=PF07719.8; Description=Tetratricopeptide repeat
  Pfam module annotation: Pfam domain module=TPR_1::TPR_1::TPR_2::TPR _2::TPR_2::TPR_2; Domain location=43-76::77-110::230-263::43-76::77 -110::9-42
MGASLPPKEANLFKLIVKSYETKQYKKGLKAADTILKKFPDHGETLSMKGLTLNCMDRKSEAYELVRQGLKNDLKSHVCWHVYGLLYRSDREYREAIKCYRNALKIDPDNIEILRDLSLLQAQMRDLSGFVETRQQLLTLKSNHRMNWIGFAVAHHLNSNASKAIEILEAYEGTLEDDYPPENEWCEHGEMLLYKISLLEECRFFQKALEELQKKELKIVCVLLVEVDKLAYKEQEVLLLVKLGRLEEGEKLYRTLLSMNPDNYRYYEGLQKCVGLYSKNGHYSPDEIDRLDALYKTLGQQYKWSSAVKENPLPQYGDFLLNVEWEINCEMRIPLDFLQGDKFHEAADNYIRPLLTKGVPSLFSDLSSLYNQLGKELGERGEKVSNGWNA

SEQ ID NO: 141035 - protein, 242 aa, Glycine max
  Coding DNA Sequence Number=SeqID_49350
  Gene Ontology: Mol. function=transferase activity; Cellular component= transcription factor complex; Biological process=positive regulation of transcription, DNA-dependent
  Homolog annotation: Hit_ID=A7P7G9; Match level="QueryCoverage=92%, HitCoverage=24%, E-value=1e-103, Identity=82%"; Hit description =Chromosome chr9 scaffold_7, whole genome shotgun sequence
  Pfam annotation: Domain name=TPR_2; Domain location=10-43; Score =15.7; E_value=0.17; Accession=PF07719.8; Description=Tetratricopeptid e repeat
  Pfam annotation: Domain name=TPR_2; Domain location=120-153; Score =1.1; E_value=22; Accession=PF07719.8; Description=Tetratricopeptide repeat
  Pfam module annotation: Pfam domain module=TPR_2::TPR_2; Domain location=10-43::120-153
MEKEPPSTLMWTLFLLAQHYDRRGQYEIALFKINEAIDHTPTVIDLYSVKSRILKHAGDLVAAAAFADEARCMDLADRYVNSECVKRMLQADQVALAEKTAVLFTKDGDQHNNLHDMQCMWYELASAESHFRQGNLGMALKKFLAVEKHYADITEDQFDFHSYCLRKMTLRTYVEMLKFQDQLHSHAYFHKAAAGAIRCYIKLHDSPPKSTAEEDNDMSKLLPSQKKKMRQKQKKAEARAKK

SEQ ID NO: 141036 - protein, 202 aa, Glycine max
  Coding DNA Sequence Number=SeqID_49351
  Gene Ontology: Mol. function=metal ion binding
  Homolog annotation: Hit_ID=A7P7H0; Match level="QueryCoverage=58%, HitCoverage=26%, E-value=1e-19, Identity=43%"; Hit description =Chromosome chr9 scaffold_7, whole genome shotgun sequence
MDVTSLGSNSNTQTDQHPLLMEQPETRNGHQHVIDITRNGEALTTSYRNDQHSEMHLTQNQDQPAGDAQDSSHQTTSSSAPRLNSRNSASLRRGDGYGHRGRSPLNSGLWISVELVVTVRMKIPRPHYLHGLWAMGLVVLPHFPFSTGVFETVIKAMNKIPLKHLKDLLEAILQIVLILPSMFLMSQMRRMVTLHNQPQETL

SEQ ID NO: 141037 - protein, 104 aa, Glycine max
  Coding DNA Sequence Number=SeqID_49352
DISLSTAIPLGLEVTLQVKELLDEGLVAPLIELVRNHVPSWEDAQEKGVKRTSPKYQEHRDLRSNPFQGEGMMQSYPPMVLDKRLQEDWARAAKEGPRILMNLR

SEQ ID NO: 141038 - protein, 94 aa, Glycine max
  Coding DNA Sequence Number=SeqID_49353
FKGLTAENSLSQHIRGYILCGTSRGYIYLGIVILRTREGTSLVDQFKWRVHPLGFFKENKGGYIPCGSVQVEGKSTWFFQREQGRVHPLWIFGL

SEQ ID NO: 141039 - protein, 98 aa, Glycine max
  Coding DNA Sequence Number=SeqID_49354
VCDIYPCIELAYGLTKYVKYSDSKSIQMPKQRRITSLKIENEASLDLRTNPFQEGGSDEDITKDHEALEGPMTRGRLKQAQHVIETRLVICIAAIDDD

SEQ ID NO: 141040 - protein, 106 aa, Glycine max
  Coding DNA Sequence Number=SeqID_49355
MCLNAVLVEFSPTRGIYGRCLIRIRLNYHEESRSPTGNLVPLDIEIEATLRRNRAERRRKLLQDRTVASILEEETYFSDLLSPDSPSSRESATQLPKVITMVEEHE

SEQ ID NO: 141041 - protein, 83 aa, Glycine max
  Coding DNA Sequence Number=SeqID_49356
  Subcellular localization annotation: CTP_CleavageSite=41; ConfidenceScore=5.35e-01
MDCYIRAFFRTLRLRFIPFQSNPSPSIGYPSLSQGVATYPSAGGRRVTRGCVFQERNARGVATNVYLRKTSEKPEKTWSTNFK

SEQ ID NO: 141042 - protein, 60 aa, Glycine max
  Coding DNA Sequence Number=SeqID_49357
MEAFSLQNSFLGWYSWFVLKVVFFVADLGIAFVDNWAVGKEKVFYWMSNDIVGLVGNLAV

SEQ ID NO: 141043 - protein, 48 aa, Glycine max
  Coding DNA Sequence Number=SeqID_49358
MLMHNPPIWALQKIPPEGGYFWRKQPCSPGRAELAWASWAATTSPILL

SEQ ID NO: 141044 - protein, 180 aa, Glycine max
  Coding DNA Sequence Number=SeqID_49359
MSSELAQSFKISSVSIYDGTQSDIRVKSYCSLNYSSELQHSISRVSIYYGTQSEHPSKKLLSFELAQSSELQHSISSVSIYDGTQSDIRVKRYCRLNCSELQHSISSVSIYYGTQSDIRVKSYCRLNLLRGSTFNFERLDILRDSIGHPSKKLLSFELAQSFNIQFRASRYMTGLNQKSE

SEQ ID NO: 141045 - protein, 166 aa, Glycine max
  Coding DNA Sequence Number=SeqID_49360
MRFKHTPTQIFNPEILFGVWWRMKLKQILDIERQRGISEDHIENLVSIVIIHRPYFMEQGKLWSRNEAQVWGTFEVYPLEESYRHQLARHLCEINNYSYKNVDPNLPSSSQRPKESYPTDRIIPQNTDDGQIRTEFYVPEPEFQKAEDLADDYSSLEQDGKTIMLN

SEQ ID NO: 141046 - protein, 137 aa, Glycine max
  Coding DNA Sequence Number=SeqID_49361
MKAWVIGGRITLLGVTGTPNDWQRPVINAGNPKALLDLSGSRGCLDGIHQLTLQQREVGVMIAGQDVAEQQCHPYLGQGGHAGAHDPHPPPGSGLGKILTRGSPRNWLRTSTSKGIYWPLTHDRMSRMPPSVDQALA

SEQ ID NO: 141047 - protein, 165 aa, Glycine max
  Coding DNA Sequence Number=SeqID_49362
MGCISYNPALAIRQLGYPMRGAPLEEELAHVISRGFIKTNVETLQKVRKAWEVVQKKDKELRGNNNGPIGGYRKWLKAHVQGLDWLPSLRTAKSEEVEAPEEDEEVQALRAKLEQAQTVKERFKSAALKIRKENAELRDMNIATTKALEQENKRARREAHGRNKF

SEQ ID NO: 141048 - protein, 175 aa, Glycine max
  Coding DNA Sequence Number=SeqID_49363
  Gene Ontology: Mol. function=phosphoprotein phosphatase activity; Biological process=intracellular signaling cascade
  Homolog annotation: Hit_ID=A7R8Y3; Match level="QueryCoverage=84%, HitCoverage=43%, E-value=2e-21, Identity=38%"; Hit description =Chromosome undetermined scaffold_3090, whole genome shotgun sequence
MVTFYGCKLNMFQNMFRIGKKTKNYTSDELSPFIKFLWEPYTATVMSVLPPICLVGSVAWCAMVPFICFHVVEWHQPDRVLRQFGMQQPILECPSQPPNIHGITLKDKQDGNWGQLFAPMISQWNNRVEFRVDVYPRQEGLLSFNSDYMVRYRRKMKMFVDPKDANTATLVFICF

SEQ ID NO: 141049 - protein, 89 aa, Glycine max
  Coding DNA Sequence Number=SeqID_49364
AQGVPMNPKRIKVIPEWPTPPTPLIELVRNCVPSWEDAQEMGKDPEYEEPRDLRSNPFQGGGNDAILSRKGIGNLLKEASQGGELGYER

SEQ ID NO: 141050 - protein, 174 aa, Glycine max
  Coding DNA Sequence Number=SeqID_49365
  Gene Ontology: Mol. function=aspartic-type endopeptidase activity; Biological process=DNA integration
  Homolog annotation: Hit_ID=Q2A9Z5; Match level="QueryCoverage=35%, HitCoverage=17%, E-value=1e-09, Identity=43%"; Hit description=Gag -pol polyprotein, putative
SSESEEAKREESSEEIYPQEDGQPLVVKEKCKEVSVSSKRLAKKETHFTIKTNIKETFPLRQPPHFLFCKKTLANIATPLGLKFIPQVKKLLDKGLVCKSLNPCAFLVPKIGVPMNPKRIKVIPEWPTPPSIRKIWGFHDLTNFYKRFVPYFSILVAPLIELLLREEAHSFKKL

SEQ ID NO: 141051 - protein, 103 aa, Glycine max
  Coding DNA Sequence Number=SeqID_49366
MRVVAEALSASLRVSHHVVYTHSINSCADMVDAFHRRFYSVARKVTYMELAATKHMREPHTWLELANNLALANTATPAGIGTHPNLQLLIELQNQVYIEGARI

SEQ ID NO: 141052 - protein, 36 aa, Glycine max
  Coding DNA Sequence Number=SeqID_49367
NLRPVRKPFPLAAVTTERRGESVSEEAEFPVQPGGH

SEQ ID NO: 141053 - protein, 159 aa, Glycine max
  Coding DNA Sequence Number=SeqID_49368
MKECALRCPHQTRARARVMGEVEEVQEQIKVGMEALKEQMATMMKAMMSIKEIMEVNVAAIVAISTIAEVNLTSPYGLNQINHPTSDMVGDEDKARNKGKEPLEGLGGPMARARTKKAKEALQKVLTMLFEFRPQVTSGEASGLLIAPCSKKSRGCHFC

SEQ ID NO: 141054 - protein, 149 aa, Glycine max
  Coding DNA Sequence Number=SeqID_49369
MADQGGKGNRPPRRTLALLSLIGSHPFAGMDHEDPYTHLSTFMELCSTMGASNEDVEAVYLKAFPFSLAVGGTMVSKSPEEAIVIIDSIAASDYQSHHDRALTQRKAHGDGQQEEEAHYLQNQAIRPQQNFQGSYQGYRGGSGSNQPYG

SEQ ID NO: 141055 - protein, 95 aa, Glycine max
  Coding DNA Sequence Number=SeqID_49370
MHGVATNVYLWKTSEKPKETGQNENSKFGSCIYVWRKFFEVDKSRAFAPTYPPLKRKSDLRSSSLCVNQVIVFYLKGDHFKALDLKNDPFYLVRN

SEQ ID NO: 141056 - protein, 73 aa, Glycine max
  Coding DNA Sequence Number=SeqID_49371
MTLSLRKTRQQVSRLPYRPQETPPPPLMGINLSLKEVPNQVTCPQLQVFFLLKNYEYLLTKFVIFSWNMKYET

SEQ ID NO: 141057 - protein, 45 aa, Glycine max
  Coding DNA Sequence Number=SeqID_49372
MPPRKLSAKRSRRDAAAEGTSAAPEFDSHHFRSAKHQQRFEAIKG

SEQ ID NO: 141058 - protein, 91 aa, Glycine max
  Coding DNA Sequence Number=SeqID_49373
MSVRSAVHVSSIIKREASDDWETRSSVVFRRKEEGVETRVVIMERAGRTKSVSYLCYPFISDERYLAPFVAQYVKSRDVPRIKRKQAYAIL

SEQ ID NO: 141059 - protein, 153 aa, Glycine max
  Coding DNA Sequence Number=SeqID_49374
  Gene Ontology: Mol. function=metal ion transmembrane transporter activity; Cellular component=integral to membrane; Biological process=metal ion transport
  Homolog annotation: Hit_ID=A8APS5; Match level="QueryCoverage=76%, HitCoverage=43%, E-value=9e-46, Identity=78%"; Hit description =Putative uncharacterized protein
MGFGIALAVALHNIPEGLAVAGPVYAATGSKRTAVFWAGISGMAEILGGVLAWLILGSLVSPVVMAAIMAAVAGIMVALSVDELMPLAKEIDPNNNPSYGVLCGMSVMGFSLLALRSCAWRYSIRSSIVTTGMLCRRAKVMHSGARAMVPSSL

SEQ ID NO: 141060 - protein, 96 aa, Glycine max
  Coding DNA Sequence Number=SeqID_49375
  Subcellular localization annotation: CTP_CleavageSite=40; ConfidenceScore=5.03e-01
MASKTRKGIHLSSKGLRFKANPFLRSLHREALQSFLPICMCSISEDDMPFNKNKPRRLPMGALWQAICPESKTSSQWYSNLSCLAHNLLTKVEISS

SEQ ID NO: 141061 - protein, 244 aa, Glycine max
  Coding DNA Sequence Number=SeqID_49376
  Gene Ontology: Mol. function=anthranilate synthase activity; Cellular component=cyanelle; Biological process=glutamine metabolic process
  Homolog annotation: Hit_ID=Q1GYF4; Match level="QueryCoverage=77%, HitCoverage=100%, E-value=2e-90, Identity=83%"; Hit description =Anthranilate synthase, component II
  Pfam annotation: Domain name=GATase; Domain location=59-244; Score =304.0; E_value=2.9e-88; Accession=PF00117.19; Description=Glutamine amidotransferase class-I
  Pfam annotation: Domain name=Peptidase_C26; Domain location=55-226; Score=-93.9; E_value=0.0031; Accession=PF07722.4; Description =Peptidase C26
  Pfam module annotation: Pfam domain module=GATase::Peptidase_C26; Domain location=59-244::55-226
MDVAIAIRTAVIKDSKLYVQAGAGIVADSVPQSEWEETQNKAKAVIRAAELEKEPDMLLMIDNYDSFTYNLVQYFGELGQDVHVHRNDEITLEQIKAMKPEKIVISPGPCTPNEAGISVPLIHEFAGKIPLLGVCLGHQSIGQAFGGKIIKAKTLMHGKTSLIHHTNTGVFRNLPNPYTATRYHSLVIERETIPDCLEITAWTEDGEIMGVKHKTLAVEGVQFHPESILTEYGHELLDNFLKGY

SEQ ID NO: 141062 - protein, 115 aa, Glycine max
  Coding DNA Sequence Number=SeqID_49377
  Subcellular localization annotation: CTP_CleavageSite=69; ConfidenceScore=5.75e-01
MQWRFQSQKRCKDNLKLTRSKRRTMVTSRKMKGQTRVLFSTETARQVGRFRFSRRVPLSVGLQRRTTALCAHSGHLVKDPNGQILENCLVKLQTKFREDPTVNKSKESFLPRQLM

SEQ ID NO: 141063 - protein, 142 aa, Glycine max
  Coding DNA Sequence Number=SeqID_49378
  Homolog annotation: Hit_ID=O52175; Match level="QueryCoverage=57%, HitCoverage=94%, E-value=4e-32, Identity=84%"; Hit description =Salmonella berta plasmid pBERT, complete plasmid sequence
MAYERGGDFLEDARKILNREVRGPRQSRFSIGSAPLTSITKSDPQISGGETRQDYKDTRRFPLAAPSCALLFLPFGLPVSFRCYGRVCLIPRLTLSSGYAVRSHLDCMHEPPVQSDRCALSGNYRLESARRDMQKHHWQQPL

SEQ ID NO: 141064 - protein, 84 aa, Glycine max
  Coding DNA Sequence Number=SeqID_49379
MNEVLSKLRGLQTYVGERFDSLNGRIDAIDARFEGMDTRITQLEEDELNCHHQKGGDCRSKDFDVLMMPKDHAFLKFNSQIIKE

SEQ ID NO: 141065 - protein, 200 aa, Glycine max
  Coding DNA Sequence Number=SeqID_49380
MGDQEETQEQMKADMSALKEQMASMMEAMLGMRQLMEKNAATAATISSAAEADPTLLATAHHPPSNIVGRGRDTLGHDGSPHLGYNRAAYPYGLPPNYSPPVLQDDAGHIASPVLEREPPQQPEEGHKDPQDYARRDVEFYPPVPEGPAPSTLPQPNIATQPIVLSTEGPFPVTEERRKLDLLEETLRAVEGFGDYPFVT

SEQ ID NO: 141066 - protein, 137 aa, Glycine max
  Coding DNA Sequence Number=SeqID_49381
MIMRGQDIYSSQDEATTSHSSSESEEAKREKSSEEIYPQEEGQPLVVKEKCKEVSVSSKSLANKETYFTIKTNIKETFPLRQPPYFLFCKKTLASIATPLGLEFIPQVKKFDQGVPTDPKRIKVSREGAQSMKNLGI

SEQ ID NO: 141067 - protein, 44 aa, Glycine max
  Coding DNA Sequence Number=SeqID_49382
MPRAHKSTTHHSAYFGKRALETGRGVAFAGIPRFFQQEGSEDKA

SEQ ID NO: 141068 - protein, 38 aa, Glycine max
  Coding DNA Sequence Number=SeqID_49383
MVDGRKEEEGCLCHMSPFEWSKKGPLSLLAVTHTQPQK

SEQ ID NO: 141069 - protein, 134 aa, Glycine max
  Coding DNA Sequence Number=SeqID_49384
  Pfam annotation: Domain name=zf-CCHC; Domain location=33-50; Score =31.8; E_value=2.5e-06; Accession=PF00098.14; Description=Zinc knuckle
MTKRREKFIKKRRIDRRQNFNNGRKSQDDSQVLRCYKCNQIGHIKANCPSNEEWSEKSEKKRFDERRTKKAYIAWDDNDSSDGSEKEINLLTKDYESDENISQELKARRKSMILISEDLDTLILKKVISKPFSY

SEQ ID NO: 141070 - protein, 153 aa, Glycine max
  Coding DNA Sequence Number=SeqID_49385
MTNPLNESISCFLIRVDPWVLVPIAFRGLHDLAIRGLHVLAFRELHVLAFRGLHVLTFRGLHILALEDYTSSPSEGYTPSPSEDYTSSPSEDCTSLPSEGYMSSPLEDYMSSPSEDYMSSPSEDYASQPSEDYTTSEGYTPSPLEDYTSSLLE

SEQ ID NO: 141071 - protein, 106 aa, Glycine max
  Coding DNA Sequence Number=SeqID_49386
MRLAKKESVSSMRLAKKESHFEIKTNIKETSPLGKPPHLLLCKKTLVSTVTPLGLKVIPQVKELLDEGLVRKSLNPCTLLVPKIGIINMKIQKKGFPRTLRDKGHS

SEQ ID NO: 141072 - protein, 32 aa, Glycine max
  Coding DNA Sequence Number=SeqID_49387
MTKENRGGACHPARPGEPGCFLQKQPPSGGTS

SEQ ID NO: 141073 - protein, 144 aa, Glycine max
  Coding DNA Sequence Number=SeqID_49388
MQQVQSFRATRNISQSLDAILHRKGPVTRAMSKRLQEDWARAAEEGLSYPNFVRGPLLDDMRPFFGPCEVLGIHHWAICEIPGHAEKPKKYIDAQSGFRGFRNTSVKFPKTMGKHIPLNIGEREKKKDENQIRKQFRKASVTFP

SEQ ID NO: 141074 - protein, 137 aa, Glycine max
  Coding DNA Sequence Number=SeqID_49389
ESHPQRHLVDPEKSNRALGFPARVTGLFQFYGALVPPASSCHCDIGIVPARHPVDPKKSNRVLELPALITGLCQFYGVLVAPSKVIRPPTNRAFIKKYCVPRQAQGETPQQPRDGRQRATNALPPPLEFTSAHPQKG

SEQ ID NO: 141075 - protein, 29 aa, Glycine max
  Coding DNA Sequence Number=SeqID_49390
ACRTVGHDICQGVGLVSSPGVKGCPTLFP

SEQ ID NO: 141076 - protein, 66 aa, Glycine max
  Coding DNA Sequence Number=SeqID_49391
MGAYAKDGKLLIHFFQESLTGAVVTRYTNLEGPNGCNYRAYARGGTDLSKNTPKGGGIWQHKWFPQ

SEQ ID NO: 141077 - protein, 102 aa, Glycine max
  Coding DNA Sequence Number=SeqID_49392
VPPVQLLTGWCVTAKAPPDISAGKCSGHAARRVPFAIQAAQLLGRAIGAGLFAITPAGERGMCCKAIKLGNARVFPEFDLIVLSKSGLVLGELVDCFLQAFE

SEQ ID NO: 141078 - protein, 75 aa, Glycine max
  Coding DNA Sequence Number=SeqID_49393
MWLDIISVDLVHMFWKRLCFLDQGLCEVEVSIKEEIETISKRFEELDVCDKVTLKSKLRDIAYPDQNSMCPPPSK

SEQ ID NO: 141079 - protein, 68 aa, Glycine max
  Coding DNA Sequence Number=SeqID_49394
MEQVSIGHQNWGEFYRLFYCKIPFLVGVLVGFVVDLGMTFVDKWVVGKEKGCYLLSNDIVGLVGNLAV

SEQ ID NO: 141080 - protein, 71 aa, Glycine max
  Coding DNA Sequence Number=SeqID_49395
MEMLRKHYGIASANLREYEVPRRQNPFLFTPPPIYSKIGEELATQLAQASKVASSRSNRLLEEESGRPKWA

SEQ ID NO: 141081 - protein, 153 aa, Glycine max
  Coding DNA Sequence Number=SeqID_49396
MEKRKGGIPLLMWGLPKHPVDRNEGNLGGIRNGIIGGYHEWLKVCTRGLDLLSKLKIINEENFEAPKEDEETSGKSVPGYKKKMQLPQEPLNKKPRGLARKSMTVTNSVELCGAATTNMLAIITKYQEELNLATTHEHRVADEYAQVYAEKEA

SEQ ID NO: 141082 - protein, 46 aa, Glycine max
  Coding DNA Sequence Number=SeqID_49397
DFLSVVPLVTIFQRNERGFEALVLTGRIILGYLLRWGPNMDSRNQS

SEQ ID NO: 141083 - protein, 77 aa, Glycine max
  Coding DNA Sequence Number=SeqID_49398
MNVLLRAVHVSSTFEFGAEFHDCLSADPQGNPPYSTFVRSTMNKKKEEVEMRVVITERAGRTKSVSYLCFPLIFDER

SEQ ID NO: 141084 - protein, 88 aa, Glycine max
  Coding DNA Sequence Number=SeqID_49399
MTEIVCAEDDVNLRVSTGLLAAIDKSMTEIVCAEDDVNLRVSTGLLAAIDKRYLRMSRDSSFSMTEIVRTEDDINLRVSTDLLAAIDK

SEQ ID NO: 141085 - protein, 111 aa, Glycine max
  Coding DNA Sequence Number=SeqID_49400
MMEAMMSMKKIMEANPVAVVTTNIVAKMNPMHPFGLNQMNHPTSSMVGKDLGSTGGPHDVQIQNEHAFPPYGLPLNYTPPNVAYTPNKNVNNSTPIPIESQQPQTAHAHVS

SEQ ID NO: 141086 - protein, 81 aa, Glycine max
  Coding DNA Sequence Number=SeqID_49401
MRKCGRVRLPSFIVDHRVVPGDMSRGSGDLGDVRRAPGSQQIKGTKTTKQGGLCGGWPAEAKMVSGNRLPRECNRLPGLKT

SEQ ID NO: 141087 - protein, 115 aa, Glycine max
  Coding DNA Sequence Number=SeqID_49402
MTKARQKGVRKEKEGDACHPDRPGELGCFLQKQPPSGGTSWKAQVGLNFMDCALTLPFNFRHVTELHRLCYDAFLLASDMFGNFTNCLTMGAKYLEVVKRGSHPDNGWSPDEIRV

SEQ ID NO: 141088 - protein, 127 aa, Glycine max
  Coding DNA Sequence Number=SeqID_49403
MYPPLELIHKRCTLSCSQSTQVEVPSTCSTKDVPSNVLRQSSQAGEERHKKNSGGWSLANSFWQREKGMKKMNSTILFSRFGKPENFGKLLAKEEEEEVQRDSMVVKDYSSCLVKRTIRRVITFRKT

SEQ ID NO: 141089 - protein, 160 aa, Glycine max
  Coding DNA Sequence Number=SeqID_49404
MASNPNNLGKKGCMGRNMSALIGWRNHPNLRWTSPPQQQQHVPPIQQQQQSQQRQQATEAPPQPSLEELVRQMTIQNMQFEQETRASIESLKNQMGQMATQMNQAQSQNSDKLPSQIVQNPKNMSAITLRSGNQIQVPPPVAAPAPEPSSFLVHLTKRMR

SEQ ID NO: 141090 - protein, 115 aa, Glycine max
  Coding DNA Sequence Number=SeqID_49405
  Homolog annotation: Hit_ID=A5BP71; Match level="QueryCoverage=65%, HitCoverage=19%, E-value=9e-12, Identity=48%"; Hit description =Putative uncharacterized protein
  Pfam annotation: Domain name=zf-CCHC; Domain location=88-105; Score =18.9; E_value=0.0021; Accession=PF00098.14; Description=Zinc knuckle
MVIIINAEACGYVSLNYYQYIDVVYTNEHILKAYSPQWWPLGNEAAIPSSNDAWTLIPDPTTIRAKGWPKSTRIRNEMDWVEPSEHRQKCSRCGAEGHNRRRCPMQFERGSCSNH

SEQ ID NO: 141091 - protein, 118 aa, Glycine max
  Coding DNA Sequence Number=SeqID_49406
GVVLAEVLLADSRFTRPDMGFHPTKLNFVPSDADEAPLDVSICLHAFGIVGCGSFSGVKSCEREVRPIPSRPLCWGTLEDFKVPHVNHCPHIVPLKSVVSDDACPGACFVQRDATTLS

SEQ ID NO: 141092 - protein, 118 aa, Glycine max
  Coding DNA Sequence Number=SeqID_49407
MASKVSEQTMEGLEETGAEAGAGKDEVGATVEVEGAEVGRAQDEGASDLLPLALRGPRKVTVRSSRSDSPDLALGGDEGRKAKPRGVMLGNQSNLTRDEVPEVHIHPLNDVINQPSLV

SEQ ID NO: 141093 - protein, 191 aa, Glycine max
  Coding DNA Sequence Number=SeqID_49408
  Gene Ontology: Mol. function=nucleic acid binding; Biological process= protein amino acid phosphorylation
  Homolog annotation: Hit_ID=A3AA33; Match level="QueryCoverage=76%, HitCoverage=35%, E-value=5e-45, Identity=60%"; Hit description =Putative uncharacterized protein
  Pfam annotation: Domain name=WD40; Domain location=113-149; Score =8.9; E_value=2.5; Accession=PF00400.23; Description=WD domain, G -beta repeat
  Pfam annotation: Domain name=WD40; Domain location=158-189; Score =7.0; E_value=4.4; Accession=PF00400.23; Description=WD domain, G -beta repeat
  Pfam annotation: Domain name=WD40; Domain location=34-72; Score=33.6; E_value=7e-07; Accession=PF00400.23; Description=WD domain, G-beta repeat
  Pfam module annotation: Pfam domain module=WD40::WD40::WD40; Domain location=113-149::158-189::34-72
MEIEEMQQGLLRLSRNHHQGYVNTGSTTIVYMVNNALTKLQEHKKVITGIAIPVGSDKLYSGSTDGTVRIWDCHTGQCAKVINLGAEVTSLISEGSWIFVGLQNAVKAWNIQTMSEFTLDGPKGRVRAMTVGNNTLFAGAEDGVIFAWRGSSKADSPFELVASLTGHTKAVVCLAVGCKMLYSGSMDQSIK

SEQ ID NO: 141094 - protein, 34 aa, Glycine max
  Coding DNA Sequence Number=SeqID_49409
MPSINESHYADDVHDHGNTTSIPSAVRYAVRGHV

SEQ ID NO: 141095 - protein, 151 aa, Glycine max
  Coding DNA Sequence Number=SeqID_49410
  Homolog annotation: Hit_ID=A5BY78; Match level="QueryCoverage=75%, HitCoverage=6%, E-value=9e-09, Identity=30%"; Hit description =Putative uncharacterized protein
MDKREEEFVEVEAQEGSPVNEHDLEEERHEDHEVPIILGQPYLSIASCVLGIGEECLVSENEGEELACIEELDVPEHKSTGHVMFETLENSRPMENPKVELKTLPAHLKYVFKEDNEAKLVIISSSLQKKEEDQLIQILKSRQSRYWLAHL

SEQ ID NO: 141096 - protein, 52 aa, Glycine max
  Coding DNA Sequence Number=SeqID_49411
NFPSLDYRVKPISCFYEKVHQVKLKYGSNHLAKIGAKDGSCYIVASSTVKHI

SEQ ID NO: 141097 - protein, 159 aa, Glycine max
  Coding DNA Sequence Number=SeqID_49412
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
  Subcellular localization annotation: CTP_CleavageSite=53; ConfidenceScore=5.37e-01
MGSSMKRFSSSFIVFKKHGDDKESLKFALRRRRNQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141098 - protein, 223 aa, Glycine max
  Coding DNA Sequence Number=SeqID_49413
  Homolog annotation: Hit_ID=Q5XM22; Match level="QueryCoverage=40%, HitCoverage=67%, E-value=2e-17, Identity=47%"; Hit description =Resistance-like protein HAAS-2
MGHMYACRGYGISIRQDARPDSGLLQLVLICYTCATHVHVVHLDTFRDLAHSGSYAWGAPALVHMYDQLNEASQNTTRQIAGYLTLLQIYEHFPSVHDGVTDDGYDETSPRACRRLTTKACMKGLLASSYQTRLDALTITNVSRDYMEWFFMISNLFMTTTQAGDQPRHPPVPQHEAYVEPAISEVPMAAEGGLSQASDPPRHVVDACEAIAERLERVLNLRM

SEQ ID NO: 141099 - protein, 73 aa, Glycine max
  Coding DNA Sequence Number=SeqID_49414
MAVEEDSPAQKLLDEEGATVLRGKVVEGPQLLVVSGVVAVVGLVEECMVCLGQQHFGRKEQAAVVVVAEGWTI

SEQ ID NO: 141100 - protein, 28 aa, Glycine max
  Coding DNA Sequence Number=SeqID_49415
MAQKKVLNSKAVSHFYLALCGMIIACSF

SEQ ID NO: 141101 - protein, 278 aa, Glycine max
  Coding DNA Sequence Number=SeqID_49416
KRLTNLVDGSIDVALVKEFYANLYISEGPSPKQAKVRGHLVKIDIDSLNTFLETPVVLAEGETLPTYSRYCRLPSDPREIEAALCIPGRGFILNAEGHPGRIQRKDLMTLAQVWSVLSYSNLAPTSHTFDLTVDRARLIFGLVSRMDINIGALISSQMTSIAQSNSSRLGFPALIIALCRARGVVSDSLTFERLSPIINLTYIRKNCWNPDDLRVAIRGARRARARARPADLPSTSIAPTQYPLQQLFQSQLRWILSALNPCFRAFIRDKSIPSIKKF

SEQ ID NO: 141102 - protein, 310 aa, Glycine max
  Coding DNA Sequence Number=SeqID_49417
CANAAVHRAGLERAQHGGQVAQGPDVDLVGHAGVLHQVLERLDLAAVEILAPHDDVGVGQLAVEAEHQDGRLAGQRQGRRGGGRGGAEDDLAGRQQLVGARAALRIQVFDLQPRFAEIALFERHVAGREERVDAALPVDHAAQLGLGEGDTAADQGDAGQRPGSGQHAAAGGEVGARAHVFLGLDRVWLFGVNNTAAAPDVQQWKTPGCPGVLVVPRKCRPWRLMPRSSWARPSSRLSWRRSWSPSWWPFSWRSWWRSSSPRPSWPAPSSPPSWWRRRRSWPGHGRGRVSPDAVRTRSRSCRRAGAPGKP

SEQ ID NO: 141103 - protein, 84 aa, Glycine max
  Coding DNA Sequence Number=SeqID_49418
MGAKYLEVVKRGLHPNNGWSPDEIRNDHNLSLRFVGHDRAWAVRHKMTIICLCVPPDTIASGWRKGARNDHNLSPPTSRLTVPE

SEQ ID NO: 141104 - protein, 171 aa, Glycine max
  Coding DNA Sequence Number=SeqID_49419
  Gene Ontology: Biological process=transposition, DNA-mediated
  Homolog annotation: Hit_ID=Q1J7G7; Match level="QueryCoverage=22%, HitCoverage=67%, E-value=1e-10, Identity=72%"; Hit description =Transposase
DLPSQWLLFLSAVPPVQLLTGWCVTAKAPPDISAGKCSGRVPFAIQAAQLLGRAIGAGLFAITPAGERGMCCKAIKLGFAHQAYRYRRPRGGARYQLLFPLVRVNFELGVIMVIAVSFGKPVVPAALMNRPTRGERRFAYWALAECILAYYVGTDEGVSEVLHVAGEKRLH

SEQ ID NO: 141105 - protein, 62 aa, Glycine max
  Coding DNA Sequence Number=SeqID_49420
MVKVGTSYVPINVSFSPKVGPGLPAVPPVQQTGWCVTAKAPPDISAGKCSGHAARNHHTRRA

SEQ ID NO: 141106 - protein, 133 aa, Glycine max
  Coding DNA Sequence Number=SeqID_49421
PQIDGNGRDDDHRALTCSPGVMRQPPDRKHRGSRVLSNAGAIVPDPRACKGSGEWLRLAAAGGNYDLNIRQPVEQQRQDLVLVCRPAAQRDTAALFFQQLLFRQKIPAQEERADILFRGKKGFLNIKPANLTQ

SEQ ID NO: 141107 - protein, 116 aa, Glycine max
  Coding DNA Sequence Number=SeqID_49422
SKLRSTGHLSKQTNGLHPLPVKVENPDESLETSNNSFQNCPMCGISCQCQDSTSDSPQISASPHPLDFAPYASGSYSAQWNALGLLHDMHMLRSSRILRKMEVVFVIGSAVDRLCG

SEQ ID NO: 141108 - protein, 104 aa, Glycine max
  Coding DNA Sequence Number=SeqID_49423
MTSRDQVWSFCTLVSSRGGGPDDTRRYLTVICTLLSSRGGGPDDKQRPSLVILHPEADTVFCTFCSSGNNKSFTCGNFMVTRDSRQPRGAKLVSYTDFRPGTFA

SEQ ID NO: 141109 - protein, 258 aa, Glycine max
  Coding DNA Sequence Number=SeqID_49424
VLDAGAHGHRVAGGEQAIADACIDQRVVGQLQGVVGVVPDIAVIAHGGVGLQPIHPWQLVGGMQYSAPARSTCGALAFLRGAARRQLVVGRVQPGHAAPHRQRVCHVQVAIGFDAFVQRDAVLHQARQAAGDQLVDVGATFQPERRQIRIPACRLDLRADLVLLADGRVEHVAGVGVAVAHAAARFQRFDVAGVECDRLAGLEHHGVGRCDRVGVVAALGLVVVVAPARQDRPAAAEIDGIAREHRLLHGLVAAGHHP

SEQ ID NO: 141110 - protein, 36 aa, Glycine max
  Coding DNA Sequence Number=SeqID_49425
PLNCVFVHASSTHEFGAMRSDCLVQFSILYPFFGAP

SEQ ID NO: 141111 - protein, 203 aa, Glycine max
  Coding DNA Sequence Number=SeqID_49426
  Gene Ontology: Biological process=transposition, DNA-mediated
  Homolog annotation: Hit_ID=Q6UUU1; Match level="QueryCoverage=29%, HitCoverage=40%, E-value=2e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLVSALSIPFGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141112 - protein, 126 aa, Glycine max
  Coding DNA Sequence Number=SeqID_49427
  Subcellular localization annotation: CTP_CleavageSite=35; ConfidenceScore=5.07e-01
MEKRLCRGPLTSLLSIFLASSRRKSPYPVRKPFPLAAVRGNDRAHPLSPALAIHNSESARTDQALPEQLRSLKWRGRSPVAQAQLSAACECSVSVLGTPGFTLASADVPACMLVCRIVSGTPSRQY

SEQ ID NO: 141113 - protein, 25 aa, Glycine max
  Coding DNA Sequence Number=SeqID_49428
MTWLDFVECPKVQDEKMENLEMDLM

SEQ ID NO: 141114 - protein, 250 aa, Glycine max
  Coding DNA Sequence Number=SeqID_49429
  Gene Ontology: Mol. function=transporter activity; Cellular component= integral to membrane; Biological process=transport
  Homolog annotation: Hit_ID=A1G0R7; Match level="QueryCoverage=95%, HitCoverage=22%, E-value=1e-114, Identity=90%"; Hit description =Acriflavin resistance protein
MAGLLLLGILGYRKLPVSALPEIDAPSLVVTTQYPGANATTMASLVTTPLERQFGQISGLELMTSDSSAGLSTIILQFSMDRDIDIAAQDVQAAIRQATLPSSLPYQPVYNRVNPADAAIVTLKLTSDTRPLRDVNNYADSILAQRLSQVQGVGLVSIAGNVRPAVRIQVNPAQLSNMGLTLEELRSALTQANVNAPKGSLNGKTQSYSIGTNDQLTSAAEYRDTIISYKNGRPVRLSDVAKVVDGVEND

SEQ ID NO: 141115 - protein, 290 aa, Glycine max
  Coding DNA Sequence Number=SeqID_49430
  Gene Ontology: Cellular component=membrane
  Homolog annotation: Hit_ID=A1FT84; Match level="QueryCoverage=43%, HitCoverage=35%, E-value=2e-48, Identity=76%"; Hit description =Putative uncharacterized protein
  Pfam annotation: Domain name=DUF6; Domain location=156-277; Score= -1.7; E_value=0.086; Accession=PF00892.11; Description=Integral membrane protein DUF6
  Subcellular localization annotation: CTP_CleavageSite=15; ConfidenceScore=5.08e-01
RCRRRTVGRGFPRARRAAVVQRPATVVRSLSGLRPDRRSHVAASMEAAGAAAGPRRMDRPAVAEPGREPGVFPVASHGGAVGRWRGGVLDCRPDSGGGHPGWRARAGGGAAEAAAAGAGPVRARRGTGWLGSADVRAPGNPVAAAPDRPAVRVRRAVLVGVVLDRHDWSLLTGVTTGGLALLLVPMAFIGHTGSHSAAQWSGFWAISAGVAVVASILGNAFWNRASRLLPLTLTGQMIVFETLFALLYAFAWQQRWPTLLEALAIVFLVAGVMLCAHAHRTPRAIAEHAG

SEQ ID NO: 141116 - protein, 62 aa, Glycine max
  Coding DNA Sequence Number=SeqID_49431
MEDAQAGLGNQFVGLRIRFDDGGCTKSARMHERQSLHGASNKLLEDARTRLGNQFMGLRTQW

SEQ ID NO: 141117 - protein, 65 aa, Glycine max
  Coding DNA Sequence Number=SeqID_49432
MGAKYLEVVKRGSHPNNGWSPDEIRKWLRNLASLSDTMVLGKPRSLTTSLEKSFEMWKASSTLWQ

SEQ ID NO: 141118 - protein, 225 aa, Glycine max
  Coding DNA Sequence Number=SeqID_49433
MGDQEEMREQMKADMSALKEQMASMMEAMLSMKQLIEKKAATAAAVSLAAEADPTLLATTHHPPSNIVGRGRDTLGHDGSPHPGYNRAAYPYGLPPNYSPPVLQEDAGHIASPVHEREPPQQPDEVHKDPQDYARRDVEFYPPIPEGPAPGTLPQPNIAAPPIVLSTEGPPPATERKGGSSISLRKRLRAVGRIWGLSVRRHDRSLLSTRCCYSPEVQSAGLRQV

SEQ ID NO: 141119 - protein, 138 aa, Glycine max
  Coding DNA Sequence Number=SeqID_49434
MTGPLHESNSCFLIRVDPWVLVPITFRRLHVLAIRGLHALPFRGLHVLAFKRLHALILRGLPVLAFKGLHALIFKGLHALTFRGLHALAFSGLHVPLFRRLHALAFRGRHVLAFGGLRSPSPSEGYASSLSVGSISTP

SEQ ID NO: 141120 - protein, 72 aa, Glycine max
  Coding DNA Sequence Number=SeqID_49435
  Subcellular localization annotation: CTP_CleavageSite=34; ConfidenceScore=5.34e-01
MWVQAISLFAQATCAPEFGLPRSFNQRLLVLRVGGAAVKQQESSTTRDPRSLNPFSEIRRREEEISLKRDGL

SEQ ID NO: 141121 - protein, 23 aa, Glycine max
  Coding DNA Sequence Number=SeqID_49436
ISNVRVVEAEATIFEVTERKATT

SEQ ID NO: 141122 - protein, 226 aa, Glycine max
  Coding DNA Sequence Number=SeqID_49437
  Gene Ontology: Mol. function=chitin binding; Cellular component =extracellular region; Biological process=chitin metabolic process
  Homolog annotation: Hit_ID=UPI00006A17C9; Match level="QueryCoverage =91%, HitCoverage=100%, E-value=2e-30, Identity=34%"; Hit description= UPI00006A17C9 related cluster
VRVCSPLLARTCSPLKVRACNPLLARTCSPLQGEGVQPSVGEDVRACSPTKVRTCSPLMVRTCSPLMARACSPLKVRACSPLLARTCSPLQVRTCSPLRVRACSPTKVRTCSPTKVRTCSPLMAWACSPLKVRMCSPLLARTCSPLQARTCSPLRVRACSPTKVRTCSPLMARACSPLKVRACSPLLARTCSPLQARTCSPLKGIGTSTQGSTLMRKQEIDSSRGP

SEQ ID NO: 141123 - protein, 127 aa, Glycine max
  Coding DNA Sequence Number=SeqID_49438
MTRGNPSDLQPFDPEIDRTFHRLVRHHFIPFDHSEHSITGESVHSVIGDFEHPDLEHYNFEHSDSEHSDFAHSENNAQPPPRERTLREMAAPDFTYESLCIQYPDEDVPYVLKTGLIHLLPKFHGLA

SEQ ID NO: 141124 - protein, 88 aa, Glycine max
  Coding DNA Sequence Number=SeqID_49439
METNKGSPVESPTVATYPSAGGRRVTRGMRVPRKEYARSRHQRLFEENVGKTGKDAIYELLSEKVRELYLRTGKVLAPHTSVPRDGSL

SEQ ID NO: 141125 - protein, 86 aa, Glycine max
  Coding DNA Sequence Number=SeqID_49440
MARRDKIWSFCTLCHPEAAGPMTCGDKIWPFRTRLPFRHSRVHGTQRQNLVILHPLSSRGGGPDDMRRFTSSSALTRSVILTFESC

SEQ ID NO: 141126 - protein, 209 aa, Glycine max
  Coding DNA Sequence Number=SeqID_49441
MLPFEFRHVTELHELPNDGCQVPQNGQMKVACHQAKMFSIIHREKDIRELTKQRDLAQSKVEDLLHMVGKDQISGKVVSILKGKISRKMIVQYQSHPAFVVLIVLIHTLETSTILIIMVEIVILMVVITTKKLYPLLAMNPKAVSLLSPVIKTKKLYSLLAMNPKAVSLLSLVINQEANPLLEMNPKSVNLLSPVFNQEDLLLKNSHQE

SEQ ID NO: 141127 - protein, 86 aa, Glycine max
  Coding DNA Sequence Number=SeqID_49442
ASVFNYERLDILWDSMGHPCKNVSRYYGTQSDIRVKSYCRLNFLKASLFIYERLDILRDSIGLASKNASVFNYERLDILWDSMGHP

SEQ ID NO: 141128 - protein, 133 aa, Glycine max
  Coding DNA Sequence Number=SeqID_49443
MGDQEETQKQMKADMSALKEQMASMMEAMLGMRQLMEKNVATAAAIRRGRSTLGHNSNPHLGYNRVAYPYGLPPNYTPPVMQDDAGHVSSLILEGEPHRQPDEVHEDHQEYAQGDVEFYPLIPIEGPTPNTLP

SEQ ID NO: 141129 - protein, 208 aa, Glycine max
  Coding DNA Sequence Number=SeqID_49444
AFRHAVSGIVEPENLRALIAVNTRQRFIAVCVAVYVGQWHIVVYFLQQTKTVPDEAGEGRCSGRLAVQQTLHALADAAPERIVAETHLHLRLVAIARFADDFDQAMLVIIAVAPARLTVILFTGATVYVVAPADAVKLRNTVVRNRCCRATVQWIARAIPAPRIITGLSTFLHQQTARAVVVPERLAERIVVALFADQVVAVVEITPA

SEQ ID NO: 141130 - protein, 31 aa, Glycine max
  Coding DNA Sequence Number=SeqID_49445
MTWLDFVECPKVQDEQMENLEMDLMFNERID

SEQ ID NO: 141131 - protein, 65 aa, Glycine max
  Coding DNA Sequence Number=SeqID_49446
NKRGYISCGSVEVEGTSTWLFKENKGGYISCGSLACRGFYKVERNLKNRWLLGDWMMARIVAEPV

SEQ ID NO: 141132 - protein, 160 aa, Glycine max
  Coding DNA Sequence Number=SeqID_49447
  Homolog annotation: Hit_ID=Q6UUU1; Match level="QueryCoverage=37%, HitCoverage=40%, E-value=1e-18, Identity=78%"; Hit description =Putative uncharacterized protein
MVVDQYETPLGIRYFNFDADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141133 - protein, 238 aa, Glycine max
  Coding DNA Sequence Number=SeqID_49448
MSSRKRKSVGSRPTTQYDTRRFHYFEAWTRYTDNVLGRHILAERKVEIYYTELDEFKAELERRNFHKCLTNLANSSIDLALVKEFYANLYNPEGPSPKQVRIRGHLIRIDADNLNAFLEIPVVLAEGESLPAYSRYCRMPTDIREIEAALCIPSRGFILNAKGHPGKILRKDLTTIAQVWSVLSYSNLAPTSHTSNLTVDRARLIFGLVTQLDMNVEALISRQITSMAQSNSSRLGFP

SEQ ID NO: 141134 - protein, 194 aa, Glycine max
  Coding DNA Sequence Number=SeqID_49449
  Homolog annotation: Hit_ID=A4PP05; Match level="QueryCoverage=49%, HitCoverage=26%, E-value=8e-08, Identity=36%"; Hit description=IMP dehydrogenase/GMP reductase, putative
MTGIKGAPYRRCLDTLSETDVCWMPYAQIVVYVRPKRVLRQFGYLQTVPMPPVCDSLTGDDIDDRWLHFSDHLVPLGELCVVPVQVAPDYMEWFFRISHPFVTWTEETVALRHPPPPHHEEFVEPPIPEVSVATDLPTHSVDLGAIAEDLERVINLGMVIEGTDLHDIMTRCLRRARGDAADGSLRPRQRRRID

SEQ ID NO: 141135 - protein, 107 aa, Glycine max
  Coding DNA Sequence Number=SeqID_49450
  Subcellular localization annotation: CTP_CleavageSite=2; ConfidenceScore=5.02e-01
MSCNSFKTAVPVRHINARLFLRSDPSPRGRSGGPLALLRQLAKGGCVQGDYSWVTPGCSSRSAFMWQEKKGCTGASAEYVNTTHYSGRISLTELATARSFDCGDAQN

SEQ ID NO: 141136 - protein, 276 aa, Glycine max
  Coding DNA Sequence Number=SeqID_49451
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDRLMFQLLSRIHIFLDILPHSDNYLIHRLSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141137 - protein, 159 aa, Glycine max
  Coding DNA Sequence Number=SeqID_49452
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=74%, HitCoverage=96%, E-value=7e-25, Identity=55%"; Hit description =Putative uncharacterized protein
  Subcellular localization annotation: CTP_CleavageSite=14; ConfidenceScore=5.24e-01
MTMITPSSKLTLTKGNKSWMSRKIWILLKSWNINRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141138 - protein, 17 aa, Glycine max
  Coding DNA Sequence Number=SeqID_49453
RSTSLEPEFQLTINLDP

SEQ ID NO: 141139 - protein, 140 aa, Glycine max
  Coding DNA Sequence Number=SeqID_49454
MNPDFTNHEAGARGRRALGLMASGALAFKTRWFTGFCNSHQVSHFATFFIDARAEISVAESHCIAGVCVCREDEEAGRTGRRGHPLPPDGSVDFSQRRGQRTAHVAAIRTLHRTIQSVGATGGVYKGQGRSQRELMTRAY

SEQ ID NO: 141140 - protein, 80 aa, Glycine max
  Coding DNA Sequence Number=SeqID_49455
EFLQPVGDKPLVLSARRIERPSGSELTHPPFSAAGVIRERPAPIALRATVAQHSLNAAMADSVPTVKAAQCKRKAALSGG

SEQ ID NO: 141141 - protein, 143 aa, Glycine max
  Coding DNA Sequence Number=SeqID_49456
MKADLSALNDQMTSISEVMLKLQKAIEDKAAATASSTVREAEPVLQPALNPGRDRNTAVFGRRYSPQAYPYGLPPDFTPRATPEDLSQALTFEGQLPPYDNYPGQDDEEGDTHLGPRLHLKDPSPHELPQPNIVRHIRLHPHP

SEQ ID NO: 141142 - protein, 193 aa, Glycine max
  Coding DNA Sequence Number=SeqID_49457
MDNKEGVQEQMKADLSALKDQMASITEAMLKLQKTIEDNGTVAASNIAREAEPVLQPVINLGRDRNTTGFNRRYSPQAYPYGLPLDFTPRTAPDDLSHAPTFEGQLPPHADYPLQEDDEGDAHLGPLLPFKEPAPHELPQPKIVCYIPSPSALVKELVPFAKDKGKIDLLEERLGAVEGLGNYPFSDLAYMCL

SEQ ID NO: 141143 - protein, 294 aa, Glycine max
  Coding DNA Sequence Number=SeqID_49458
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVAKNLAEFCLCSNAFWKAGFKSDELGYLAGENQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141144 - protein, 71 aa, Glycine max
  Coding DNA Sequence Number=SeqID_49459
  Subcellular localization annotation: CTP_CleavageSite=41; ConfidenceScore=5.03e-01
MTRCSPPGGTKGARYRKVSRVSSGPPPLDDKRVRITVRYLRVSSGPPPLDDTRVQNDQILSQRVIGPAASR

SEQ ID NO: 141145 - protein, 30 aa, Glycine max
  Coding DNA Sequence Number=SeqID_49460
CPNHNLDDVAQMHIFYSGLKPQTKMILDAS

SEQ ID NO: 141146 - protein, 287 aa, Glycine max
  Coding DNA Sequence Number=SeqID_49461
  Homolog annotation: Hit_ID=A7R0W6; Match level="QueryCoverage=86%, HitCoverage=69%, E-value=6e-08, Identity=22%"; Hit description =Chromosome chr12 scaffold_326, whole genome shotgun sequence
  Subcellular localization annotation: CTP_CleavageSite=44; ConfidenceScore=5.37e-01
MAEPSKKRKGSSSRSQRHSDAQDTPIPSSISSSSLFSSEEQRTRCTNLFSSHSIIDPKFIDMDFFSDESFKCIQAFHNSNLIPFMSLKLPVYSELVKVFYSNLEIQESTLIFEVYRIKMVIDQSLFYDLTQLSSDGVSFEGALDDDWKFDFSVHDACRLVCTNQTDMTGRLLASSLALESCILHYLIVRILLPRSSNLAQVSKEDLIVMWAIHTGRQIDWAHLVRYHMHKALRLNAPLPYPQLVTLSLQHFNIPLDSEPYVPIKRSFLIGAAMVASFGYRKERDGSG

SEQ ID NO: 141147 - protein, 54 aa, Glycine max
  Coding DNA Sequence Number=SeqID_49462
TPQQPGNGRQRAIDAPPPPPEPLSSSTKAEALPMTHGRLADDQVQSQRKMNPEP

SEQ ID NO: 141148 - protein, 100 aa, Glycine max
  Coding DNA Sequence Number=SeqID_49463
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=3e-11, Identity=35%"; Hit description= UPI00006A17C9 related cluster
  Subcellular localization annotation: CTP_CleavageSite=91; ConfidenceScore=5.74e-01
MARVCSPLKVRTCGPLKVRACSPTKVRTCSPLMARACSPLKVRTCSPTKVRTCSPLMAKACSPLKVRTCSPLMARACSPLKARTCSPLKVRVLVPKGSPL

SEQ ID NO: 141149 - protein, 162 aa, Glycine max
  Coding DNA Sequence Number=SeqID_49464
MEGDQSYTQWHMQMMLSGLQYKYSPTFINHDAHVPKPANVNADDPLRELMKYSFDLYDKPLQITFDGRFLGIVDASTSIFITYSDVIEIIAGDKSLNISVIQLWLMYIHEWSQIFSQGFMYAFLEPQSLVCSKDRRSECEQYLERWLKESDREVYIGPYFHQ

SEQ ID NO: 141150 - protein, 69 aa, Glycine max
  Coding DNA Sequence Number=SeqID_49465
MALKKKHNRVMASLTLLGKMSRMAMDTEKNSSFPFWTKYDKLEYSGVELAERPGHQLTVSVHFHALDIH

SEQ ID NO: 141151 - protein, 152 aa, Glycine max
  Coding DNA Sequence Number=SeqID_49466
MGSSQKPSLKKRFYQVKIKSLEVISLRELGQLMGQLQRQAFCKAYSKIWDLAMVEVSMEPIASLSQYYDQPLRNGGSQSTKEVFGGKGKGPWQIKANGLSLLTSLALSIFGVVLFPNMEGLVDLAAIDAFLAFHHGKESPVVAILAMYDTGM

SEQ ID NO: 141152 - protein, 27 aa, Glycine max
  Coding DNA Sequence Number=SeqID_49467
GKGNKAMKVSTEIKCKKLADSKSSWTL

SEQ ID NO: 141153 - protein, 144 aa, Glycine max
  Coding DNA Sequence Number=SeqID_49468
  Subcellular localization annotation: CTP_CleavageSite=32; ConfidenceScore=5.34e-01
MASFSHLQSQMQSQGVAVPPEPVVGPSPSGPRVSTKGSCVDPSGNDPETGDFDRCGSYIEADPARLVAIGRVYEGSTVVHNTPARLSVEEALHTFLAWPTHLVKSLSQQVAVSPPKPPPKPDPEVDDPLYLMTLTIPELFLRPY

SEQ ID NO: 141154 - protein, 87 aa, Glycine max
  Coding DNA Sequence Number=SeqID_49469
MGESLTEQCRVKVEGLRVMNFFSRRRSNDAAAVRQRMQALSGMIGRKASVGGFLSSPSNPRAQPLDRRWKLPSWSTVGAEGNFPVER

SEQ ID NO: 141155 - protein, 85 aa, Glycine max
  Coding DNA Sequence Number=SeqID_49470
MSQHITVIVVDSVPLQRTLADDGHPAQGTLSCLGLDDAPQPKSKAPARWIVVKCNRQKGTTECGYYVMHWMSTIILGSFRNNWEA

SEQ ID NO: 141156 - protein, 70 aa, Glycine max
  Coding DNA Sequence Number=SeqID_49471
MGVLGRDLKVLQRVAEPSAVRGSVFWLPQGRAGRSGSEAQVVMQVRGERSSPLGHALCTTKRRASEGRKY

SEQ ID NO: 141157 - protein, 147 aa, Glycine max
  Coding DNA Sequence Number=SeqID_49472
METKKKYGSRDLPIMWLRSLLRNQVNRSSPRPRGPHLPRREPLLAPLLAEAQLVKTIMGLYMRPVVESCDQSGKSQGPVGLIRVQRGEVGIMIARLDVAEQQSHPDLSQGGHVGAHDPHPSSSSSPGKILPRYTQQLGDGLLIKGIL

SEQ ID NO: 141158 - protein, 186 aa, Glycine max
  Coding DNA Sequence Number=SeqID_49473
  Gene Ontology: Mol. function=transferase activity, transferring glycosyl groups; Cellular component=cell outer membrane
  Homolog annotation: Hit_ID=Q7P5Z5; Match level="QueryCoverage=86%, HitCoverage=54%, E-value=8e-18, Identity=31%"; Hit description =Hypothetical exported 24-amino acid repeat protein
  Pfam annotation: Domain name=MORN_2; Domain location=105-126; Score =12.0; E_value=2; Accession=PF07661.4; Description=MORN repeat variant
  Pfam annotation: Domain name=MORN_2; Domain location=129-151; Score =19.6; E_value=0.012; Accession=PF07661.4; Description=MORN repeat variant
  Pfam annotation: Domain name=MORN_2; Domain location=154-175; Score =14.9; E_value=0.3; Accession=PF07661.4; Description=MORN repeat variant
  Pfam annotation: Domain name=MORN_2; Domain location=28-49; Score =17.5; E_value=0.049; Accession=PF07661.4; Description=MORN repeat variant
  Pfam annotation: Domain name=MORN_2; Domain location=52-73; Score =24.3; E_value=0.00044; Accession=PF07661.4; Description=MORN repeat variant
  Pfam annotation: Domain name=MORN_2; Domain location=76-97; Score =7.4; E_value=11; Accession=PF07661.4; Description=MORN repeat variant
  Pfam module annotation: Pfam domain module=MORN_2::MORN_2::MORN _2::MORN_2::MORN_2::MORN_2; Domain location=105-126::129-151::154 -175::28-49::52-73::76-97
MKYIFLLLFSASSLAIAQKPCGFKDGLQEGTCKQFFENGQVKEIAEWKKGKLDGDAIFYYENGKVQAKGEYKKDYKIKEWAYYDKNGILTSKEVFRNGEKNVYDNTSTGTFYSPSGTITEISNYKFGKLNGESKVFYENGKSVKQIGYYENGIATGKWKMLYPSGKVQRETEFANDKWNGNTRSLP

SEQ ID NO: 141159 - protein, 55 aa, Glycine max
  Coding DNA Sequence Number=SeqID_49474
MTKLGLCLSSGPPPLDDKRVRITGQYDKDYGAADKSKALAPTYPPMRNSDLRSSG

SEQ ID NO: 141160 - protein, 168 aa, Glycine max
  Coding DNA Sequence Number=SeqID_49475
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=30%, HitCoverage=50%, E-value=6e-24, Identity=100%"; Hit description=LacZ protein
MKHFTDTLISANIGTKAGTGPPLEVDGIDKLDEHFALHIVYANHGCNTNSHGWEYRFGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSGDRYTCQR

SEQ ID NO: 141161 - protein, 87 aa, Glycine max
  Coding DNA Sequence Number=SeqID_49476
MKALTFGIFRHLLDTGGRSTVFQGVFCGYLGMVALLEGSDRESTSVATLSLDAGGVYFTERPYYFDMQMALAWALSGDTWVWSRSLS

SEQ ID NO: 141162 - protein, 429 aa, Glycine max
  Coding DNA Sequence Number=SeqID_49477
  Homolog annotation: Hit_ID=A7P5Q2; Match level="QueryCoverage=88%, HitCoverage=87%, E-value=5e-67, Identity=40%"; Hit description =Chromosome chr4 scaffold_6, whole genome shotgun sequence
  Pfam annotation: Domain name=DUF247; Domain location=32-416; Score =340.8; E_value=2.4e-99; Accession=PF03140.6; Description=Plant protein of unknown function
MEGQISDSLSKQQCLKTTLTNELQNVQPPEMYAFDMQCIYRVPPVIRETNPKAYTPQIVSIGPLHKARDAGKEDIIFESMEELKVKYLKAFLNRTQIPMGTFVVTLQALEDKIRSCYAVRIKYNSDDFLKMILIDGCFIIELFLRLYRYNYWRGKDPVLLKDWMRMQIKSDLILLENQLPFFVLKQLYNLAGMNQEFPSFLHISFNCLKRVGCGTWCPTESPKHFTDLMRTSIISSSKFVLRKEEECKVIKHVYSAGQLREAGLKFKVSPNENECLLDLTYSSDGVLTMPILNIADDSEVFFRNIVAFEECHLSDDTNIITQYRKILDFLINTEKDVNVLVDKKIIVNWMGDANAVATMVNSLGSNIGMPRFNPVYFSLCNSLNDFYESPCNKYKAIFKHDYFNTPWKIASTVAAIGKGMGEWKGVGRD

SEQ ID NO: 141163 - protein, 197 aa, Glycine max
  Coding DNA Sequence Number=SeqID_49478
MTTLTQIWMTLLLTNILPSDHNFDLPLPKCQLVYAILTWMSIHVAQLIADAIYIFAGMAPTRHPLDPDKSNRALGFPALISGLCQSFGVPVTPSKVIRPPISRAFIEKYCTQRQVQGDAPQTADAPPPHQVGPAGLFDTEQYLRHLVRQQAANHRAHVRTHDCLYQMSLSLQSQGFTSFLYGPMNCVFVHASSTFEF

SEQ ID NO: 141164 - protein, 130 aa, Glycine max
  Coding DNA Sequence Number=SeqID_49479
MNLRGRQVEIADPLCPFCNNLDEDAAHLFFNYSKVLPLWWETVSWVKSVGAFPKEPKDHFMHHNRSNATRTRLFVSLEDDSNTLIAVPDITQITTSDNNSNQEEIMTTNSRGNNRPKRNTHRPKYLSDFV

SEQ ID NO: 141165 - protein, 85 aa, Glycine max
  Coding DNA Sequence Number=SeqID_49480
  Homolog annotation: Hit_ID=A7QL08; Match level="QueryCoverage=48%, HitCoverage=56%, E-value=4e-12, Identity=90%"; Hit description =Chromosome undetermined scaffold_116, whole genome shotgun sequence
MEKNGAPNNVSSQTKNYEIALSFWGDGLKKDLRVSRVVPGGSLNAFLFLLIGVISQRLAMVKKKGEQAHLESAVQRIVVCCVREG

SEQ ID NO: 141166 - protein, 79 aa, Glycine max
  Coding DNA Sequence Number=SeqID_49481
MATIALSSRYGSKLAYDTGIWGGSYRLFAAKFLPWLVFWFVLKVVFGIGHVAGMTITARVSPSFSSSSFAPVFAFIKAG

SEQ ID NO: 141167 - protein, 118 aa, Glycine max
  Coding DNA Sequence Number=SeqID_49482
LAGAERPVVHVDPTTGKASGPHKKKLRTYFGIVARDKVDVTYENWKATPTAQKDLIWVDIQASDSRTKKKLLQTVGKRWRQFKADLTRKWALAADQDSVDDIVCEKYDISKEKWAQFC

SEQ ID NO: 141168 - protein, 191 aa, Glycine max
  Coding DNA Sequence Number=SeqID_49483
HALRCPYQTRARARVMGKVEEAPEQMKADMEAMKEQMATMMEAMMSMKKIMEANAVTVAAISAIAKVNPMPPSGLNQMNHPTSDMAHEIPHHNLADFEPCLGFATKGQAVGGIPMPNTLEGPQFRPQPQPLHFAVGRAPPAMAEKGKVDHLKERLRAIEGDVLSEDGGIPKLKVPDFDKYKGTTCSKNHLK

SEQ ID NO: 141169 - protein, 173 aa, Glycine max
  Coding DNA Sequence Number=SeqID_49484
MEGLRLDDSSTSRCRQHAWSLVAEAKVTNFCFISGNHTTWKPAPRWKSYFNGSWTGGSSKCPREIGKNRIFACSRQKGRFPQPPKPYNKVVPWKYTPPAFGERAATEVDSLSAKWPGVRSPSLGELPSKGKTPMIQEPTDTATPSKEVDPPVVKEAEKKEGLQGKAVTLGRGS

SEQ ID NO: 141170 - protein, 148 aa, Glycine max
  Coding DNA Sequence Number=SeqID_49485
  Homolog annotation: Hit_ID=A5BYV1; Match level="QueryCoverage=99%, HitCoverage=14%, E-value=4e-07, Identity=28%"; Hit description =Putative uncharacterized protein
MELLILRAGLREEERTSIARFLSGLNTKVRDKKERPSPRKFRGLTSKSKEDEGKTIEKPTLRLVPKQRLAILNVSNVYGRGHIASQCPTNKTMIMKGQDIYSIQEETTSSPSLVEVKMKQGMKSLLRKSIPMKKVTLMIRRLLGGQLL

SEQ ID NO: 141171 - protein, 146 aa, Glycine max
  Coding DNA Sequence Number=SeqID_49486
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=32%, HitCoverage=24%, E-value=2e-16, Identity=87%"; Hit description =Chromosome chr4 scaffold_32, whole genome shotgun sequence
  Subcellular localization annotation: CTP_CleavageSite=73; ConfidenceScore=5.16e-01
LKRLEISQPALSKTLLHSRFSFSSHLKSARNRSVDTHIAPHSFRYYQKPLARTHRTSYRRKVEENPTLLLELCGSKKPYTALGIVEGAQSSKLSTLPVNKLDESYTPSKVSIRDDDGFHNLKEIKTVELVKATGWVYLSLSGADPR

SEQ ID NO: 141172 - protein, 103 aa, Glycine max
  Coding DNA Sequence Number=SeqID_49487
  Subcellular localization annotation: CTP_CleavageSite=81; ConfidenceScore=5.29e-01
MLLSSNVIYICVRVVMLVRMVRTRLFAAVRVKSCPGMHSSCVTTSLSGCARTVGPPPISGGGLGTMWSTLKMRTRSPLKVRACSPLKVRACSPLLARTCSPLK

SEQ ID NO: 141173 - protein, 156 aa, Glycine max
  Coding DNA Sequence Number=SeqID_49488
MAPTRHPLDPDKSNRALGFPALITGLCQSFGVPVTPSKAADAPPPHQAGLAGSFDTEQYLRHLVRQQAANHQAHVQTHDCLYQMSLSLQSQGFTSFPCPTPDQFRAKVAWPGDWPEAQAGEAPAGAPAEAPDEADEAREDEEMTDLLDFLGGSGAT

SEQ ID NO: 141174 - protein, 35 aa, Glycine max
  Coding DNA Sequence Number=SeqID_49489
MSKVGRFEGLGMEGRRKEEEAAQGFLKNVVEAAYW

SEQ ID NO: 141175 - protein, 84 aa, Glycine max
  Coding DNA Sequence Number=SeqID_49490
MSSNLVQPCPPSFQLGYCRLEVRPEVYTTSIISDDESREGNTGDPTVDFEQEASQTEDEEDEDIGLPPELERIIAQEDLEMRSH

SEQ ID NO: 141176 - protein, 60 aa, Glycine max
  Coding DNA Sequence Number=SeqID_49491
MKMSRKFSKNFSSKFEFLEFNIHLGSTFQPAIQSPKLKFTIDTIIKKPKSSRKGSQSKTL

SEQ ID NO: 141177 - protein, 107 aa, Glycine max
  Coding DNA Sequence Number=SeqID_49492
MYPLLFSVTTTQVDIPSNVLRQSSQAVSPLKLCEGGNKRILRREESKEFSDCVILNSLTWEKGDTKEFRRLVLRSFGKGRRETQKEFRRLVLGEFFLAKGEGIEKDE

SEQ ID NO: 141178 - protein, 82 aa, Glycine max
  Coding DNA Sequence Number=SeqID_49493
  Gene Ontology: Mol. function=DNA-directed RNA polymerase activity; Cellular component=chloroplast; Biological process=transcription, DNA-dependent
  Homolog annotation: Hit_ID=Q9THV5; Match level="QueryCoverage=91%, HitCoverage=6%, E-value=5e-28, Identity=73%"; Hit description=DNA -directed RNA polymerase subunit beta''
MEVLMAERANLVFHNKVIGGTAIKRLISRLIDHFGMAYTSHILDQELMTFLTIPSKGWLVQDAEQQSFILEQHHHLWEMYMQ

SEQ ID NO: 141179 - protein, 34 aa, Glycine max
  Coding DNA Sequence Number=SeqID_49494
MARLSFNCTNNIAEYEAFALGIQAAIDFKVKLLK

SEQ ID NO: 141180 - protein, 213 aa, Glycine max
  Coding DNA Sequence Number=SeqID_49495
  Homolog annotation: Hit_ID=Q6WAY3; Match level="QueryCoverage=99%, HitCoverage=8%, E-value=1e-07, Identity=30%"; Hit description =Gag/pol polyprotein
  Pfam annotation: Domain name=G-patch; Domain location=46-90; Score =27.1; E_value=6.6e-05; Accession=PF01585.14; Description=G-patch domain
MLVSCPSSVPYVEAAEESLETAFQSFEVVSCASVETSPLLSCLSNAALMVARVMLRHGYEPGMGLGKDSHRNADVVDIRGNPYKYGLGYEPGKLGRRNAPSRLRADRAWPGHVSQCFTSAGIMFEEEVAAIGEESPQDSPSFVRPCHPNSQVGNWRVMSQSEVYIADSICEGRFFEDPNNEGLIIDFDREVSQTINEEEEEDVLSPELERLIA

SEQ ID NO: 141181 - protein, 97 aa, Glycine max
  Coding DNA Sequence Number=SeqID_49496
MYNRYGKKTLEMGFEDQKINFDLFEENKSVPEHNICFPFAKHKPRAKRIFCHVLSGESLALSTQPLHLKLIWSAKLAKAKLSPFQFDLNSAKRWPAH

SEQ ID NO: 141182 - protein, 88 aa, Glycine max
  Coding DNA Sequence Number=SeqID_49497
MERDEKRLEYRFCCLSEENTGEEDNEGGIGAVDALILIGEIKRKMKKKKIAIYGSRFDEEMSEIGRFGGLGMEVRRKEEGAAQEILKT

SEQ ID NO: 141183 - protein, 55 aa, Glycine max
  Coding DNA Sequence Number=SeqID_49498
MTIRGGDRGNCFKLRRRRWIHHWRLWVWAQAEQPCWVSPMEVELQAKLLTQENVP

SEQ ID NO: 141184 - protein, 323 aa, Glycine max
  Coding DNA Sequence Number=SeqID_49499
MDEQRLERQLDNNIFIDGVKVFVNRPKFERGKVVNTREKGTFIRGEGDIPQVYKDGNGDKADQVENNIRDKPRSYATVVKEPVHGETEPMKSLVVMPGSDKTNYSPVILQSTKANSEWISKAWTARLKNRGMFERLEEELKWVVEDDSSPCYWADDWVIFPDMDESKAARLIDQEKDNGSTPISELQKWSPEIRPTHRLTWVLLWGLPLTVWEEELMAKVLAEVGEVVEVDEYVEARRRLDVARILVRTQKEPSLQANIPAIIDGIEYVLQVVEDTTSLGRSKKCPYHVSWLPPSPYSTQPNTPASGDVLPPRVFSGVDFPDG

SEQ ID NO: 141185 - protein, 183 aa, Glycine max
  Coding DNA Sequence Number=SeqID_49500
  Homolog annotation: Hit_ID=Q6UUU1; Match level="QueryCoverage=32%, HitCoverage=40%, E-value=2e-18, Identity=78%"; Hit description =Putative uncharacterized protein
DRARKTPSGPGEVQQGLGVFSSDYGPLSVLRSACCPQQAGNRRTAATSRAPQLIYKGWSVAYDPWPTSRRPSPKPKISKIGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141186 - protein, 118 aa, Glycine max
  Coding DNA Sequence Number=SeqID_49501
AGAVDESWIGCSGSTTGVDGWVSSGVVSSSAGAGAGHLSIKLLHAHNGGQAQALKALLDNGLPPVDALEHGVQHLWCNGAVEEEGAGVSDAEVEGASNLLPLAFLGPLKVTVGSSRFQ

SEQ ID NO: 141187 - protein, 108 aa, Glycine max
  Coding DNA Sequence Number=SeqID_49502
MNSRFKRRNQEDFTREVFFKGLTARELCLNTLEGTSFVVQVEGTSTWVIVTENKRGYISCGSVQVEGTSTWLFKENKGGYIPCGSLLVKDFTRLKINLKDRRSLGDWM

SEQ ID NO: 141188 - protein, 94 aa, Glycine max
  Coding DNA Sequence Number=SeqID_49503
  Gene Ontology: Mol. function=protein binding
  Homolog annotation: Hit_ID=Q2HVB4; Match level="QueryCoverage=96%, HitCoverage=34%, E-value=3e-23, Identity=46%"; Hit description =BTB/POZ; MATH
MKKDDQEIVVIDMEPKALLHFVYRDTLLEDEELFMLDSSFFPSLSESFIAKLLAAGEKYAVMHADGFEYLKKNYPLLQSELLKTGVGCEKEDYI

SEQ ID NO: 141189 - protein, 180 aa, Glycine max
  Coding DNA Sequence Number=SeqID_49504
MTGIAQVLQQAVAGQFLTAQQGQGIERCQLGIEFVALVAVEWLAVFLAALEAEVDLLVDDQAVGIRQCLLQFALLRTALAEHLLQLWHVQGGVALGHRQGLAGLELDQLALAVGGFLGRASQLLLECLKLLFAVFFAEQQVPGSVPAPVAGPSAPVSVAQPWGRPRHPWAGKSCSGCSGC

SEQ ID NO: 141190 - protein, 184 aa, Glycine max
  Coding DNA Sequence Number=SeqID_49505
FQEPSYEPDKAKELRRTSLGQTLVISRRSQLEEAKVDKASESVQNLGGLVGSPKRWALASIRIVKKEALSRVAARVPAYEDLKEKSMIRDRGPKDTDRQARSSGEVRTTFYSCYRGKLQLEALGNESSGGYYFTSLTSETEKKKKGAEQLRRLGDGAKRHYLHYFFSSQTSRDWISDQRVELML

SEQ ID NO: 141191 - protein, 64 aa, Glycine max
  Coding DNA Sequence Number=SeqID_49506
VRLRFRSVPKPQGKLEDSASVEGFLSAVGDGEIAWDVRNGFGGKKGEEMTFFLSYTKAKAETLK

SEQ ID NO: 141192 - protein, 73 aa, Glycine max
  Coding DNA Sequence Number=SeqID_49507
TPTGNLVPMDLEIEATLRRNRVERRRKLLQDRTVASILEEETHFSDSLSPDSPSSRESTTQLPEATTMADEQN

SEQ ID NO: 141193 - protein, 208 aa, Glycine max
  Coding DNA Sequence Number=SeqID_49508
MAPQKFKIIPHKVDAHVAKPANVDADDLMRGLIKYSFDIYDKPVEFEFDGSNFGIVDAPTSIFLTYYDVSEIIAGDKSLNISVQQLWLIQILGQGSMYAFLEPQSLVVSKDTRGECQQYLERWLKESNREVYVGPYFHQKPDMHIKAAINSVMTKLKTSSSPESKAAAPKWIEVKSQVQTGCYECGYYMMHWMWNIITSEIKSDWSMY

SEQ ID NO: 141194 - protein, 17 aa, Glycine max
  Coding DNA Sequence Number=SeqID_49509
MDTRLRVIGDPMNGVQR

SEQ ID NO: 141195 - protein, 246 aa, Glycine max
  Coding DNA Sequence Number=SeqID_49510
  Subcellular localization annotation: CTP_CleavageSite=53; ConfidenceScore=5.50e-01
LHVLAFRGLHALTFRRLHGLAFKRTTHAHHQRTTRPRLQRATRPRLRRTTRPRFQRAACPRLQRTTRPHHQRTTRPRLQRTTHPHLKRATRLHLQRTTRPRLQKAARPRLERTKQDYMFSPFRGLHVLHFKGLHALTFRGLHALAFRGIHAHTFKGLHALAFRGLHALTFRGLHVLTFRRLCILAYRGLRILTFRGLHVLSFRGLHVSPSEGHTPSSLEDYPSSPSEGNTPPPSENYMSSPFRGIH

SEQ ID NO: 141196 - protein, 69 aa, Glycine max
  Coding DNA Sequence Number=SeqID_49511
MAINSWGSEYGFDGGGCTNRTWQSIGLDCGGCMNDNQFMGLRIRFDGGGCTNSTRQSIRGTPDSMVEDA

SEQ ID NO: 141197 - protein, 117 aa, Glycine max
  Coding DNA Sequence Number=SeqID_49512
MVEDAQTALDSQFMGLRARWWRMHEWQSIHGGCMNDNQFMGLQIRFDDGGCTNSARQSIRGDPDSMAINSWDSKLDGGGCMNDDQFMGLRIRLDGGGCTNTTWQSIRGAPDSIVEDT

SEQ ID NO: 141198 - protein, 101 aa, Glycine max
  Coding DNA Sequence Number=SeqID_49513
MCAKLPSKLALDSFGWGGPVNTAPEVKIHGGGAIDYSFGRRRHTCALSIFYALCGGCKGVIGNILPSIGSCEKCLGGVSPGVVALIWCHFDGSLGDVGAQI

SEQ ID NO: 141199 - protein, 143 aa, Glycine max
  Coding DNA Sequence Number=SeqID_49514
  Gene Ontology: Mol. function=protein disulfide oxidoreductase activity; Cellular component=cytoplasm; Biological process =deoxyribonucleotide biosynthetic process
  Homolog annotation: Hit_ID=P68688; Match level="QueryCoverage=51%, HitCoverage=85%, E-value=1e-28, Identity=78%"; Hit description =Glutaredoxin-1
  Pfam annotation: Domain name=Glutaredoxin; Domain location=59-125; Score=31.0; E_value=4.4e-06; Accession=PF00462.15; Description =Glutaredoxin
  Subcellular localization annotation: CTP_CleavageSite=72; ConfidenceScore=5.95e-01
MPRKNSSVASGFFAMNAGAASQSLTSSSAPITASTPSASSSSTGLGNVARLRMVQGSSVFICFCCSCPYCVRAKELATKLTSERDDFNYQYVDIQATGITKADLEARAGKPVSTVPQIFLDDQHIGGYTEFAAWTKENLGIEA

SEQ ID NO: 141200 - protein, 47 aa, Glycine max
  Coding DNA Sequence Number=SeqID_49515
MRWVLTLVVSEEVEPFGHTYSLVVFHELSRFDCCSHIGFVFLMSAIP

SEQ ID NO: 141201 - protein, 109 aa, Glycine max
  Coding DNA Sequence Number=SeqID_49516
MDSRRFQVSVPGSSHPSKTFLEEMYRQFLDASSIGACRPRIFFINGFLCFLEDEWQRNGERERERRRHFKEKMSLEEAHHHRRPWIRAWRKNEMNEGRGREEHEILCSK

SEQ ID NO: 141202 - protein, 144 aa, Glycine max
  Coding DNA Sequence Number=SeqID_49517
MASRKRKATAFRPQKPYDTTRFISEGAWERYEQNVHSRNILPERNINLYVTEYDEFCRELERRRWHKALTWQPDGHIDVALAKEQVRVRGKLIKFYGDTLNTFLETPMVLEPGERYTAYTRSALEALKEGFDYSGVDLERLVIF

SEQ ID NO: 141203 - protein, 101 aa, Glycine max
  Coding DNA Sequence Number=SeqID_49518
MWGIPFILEPNQTPTCIMSSHSTNLEPKILTHHNPYPRKQKGKEGKFPIKEKAKKEKKGNSQSKSGRKQKGKKGNSQSKSGRKQKGEKEKKKRRRRRKESP

SEQ ID NO: 141204 - protein, 160 aa, Glycine max
  Coding DNA Sequence Number=SeqID_49519
  Homolog annotation: Hit_ID=Q84VH5; Match level="QueryCoverage=79%, HitCoverage=18%, E-value=5e-48, Identity=76%"; Hit description =Envelope-like protein
  Subcellular localization annotation: CTP_CleavageSite=21; ConfidenceScore=5.13e-01
MATAPKETSSPGSPSVPSSPSSTKAPSNQEQPEFHIQPIQMIPGQAPVPEKLIPKRQQGMKTSENPSLATSPREVDMEMDKKIRSIVSSILKDASVPDAEKDVPTSSTPNVSVPDAEKDVPTSSTPNAEALPSPSEEELTEEEDQATEETPAPRAPEPAP

SEQ ID NO: 141205 - protein, 260 aa, Glycine max
  Coding DNA Sequence Number=SeqID_49520
  Gene Ontology: Mol. function=beta-lactamase activity; Cellular component=outer membrane-bounded periplasmic space; Biological process=beta-lactam antibiotic catabolic process
  Homolog annotation: Hit_ID=A3RIY0; Match level="QueryCoverage=98%, HitCoverage=67%, E-value=1e-140, Identity=91%"; Hit description=Beta- lactamase
  Pfam annotation: Domain name=Beta-lactamase; Domain location=1-242; Score=121.3; E_value=2.8e-33; Accession=PF00144.15; Description=Beta- lactamase
MRLLGEISLGDPVTRYWPELTGKQWQGIRMLDLATYTAGGLPLQVPDDVTDNASVLRFYQNWQPQWKPGTTRLYANASIGLFGALAVKPSGMSFEEAMTKRVFKPLRLDHTWINVPKAEEAHYAWGYRDGKAVHVSPGMLDAEAYGIKTNVKDMASWVVANMAPDALQDSSLKQGIALAQSRYWRVGAMYQGLGWEMLNWPVDAKTVVGGSDNKVALAPLPAKEVNPPVPPVKASWVHKTGSTGGFGSYVAFIPDKQLGI

SEQ ID NO: 141206 - protein, 61 aa, Glycine max
  Coding DNA Sequence Number=SeqID_49521
MSFCGRAKARLTGALSKGGKMVGKTEGNRRWTLKSDPFYLLKTEENEERTMNVEERLKIFA

SEQ ID NO: 141207 - protein, 56 aa, Glycine max
  Coding DNA Sequence Number=SeqID_49522
MHDVIEEQARGLSATMHHQKKKTLDEASLLSSESETQHDHKSTSTPYGSYRPGYRA

SEQ ID NO: 141208 - protein, 329 aa, Glycine max
  Coding DNA Sequence Number=SeqID_49523
  Homolog annotation: Hit_ID=Q1H4T3; Match level="QueryCoverage=100%, HitCoverage=49%, E-value=1e-111, Identity=61%"; Hit description=ResB- like protein
  Pfam annotation: Domain name=ResB; Domain location=1-327; Score= -106.8; E_value=5.4e-06; Accession=PF05140.5; Description=ResB-like family
MIKEWQVYKEHASEKSLRLFSHQASLPTQQSPAALQDQLGVFLTSERYRFKIQQQANGDTLIAAKLGTHQRLGYIFTHAAIVVICFGGLLDGNLPFKVQELLGMKQVETRDISSRKVPAESRLGVNNLSFRANMTLPEGERDNVAFVRVRDGYLVQDLPFTVALKDFRIEHYATGMPKSFESDIEIIDPELSKPIEATIRVNHPYIHRGIAIYQSDFQDGGSQLKFKLWDLSAANSDGFDVDGVILQKGSLGDGAQKMTVEFNEFRQFNILNLSPDGKGKPHNVGPNTTLKLRNASGQAREYVNYMQPLQLDGRAYFVSGMRETVQDEF

SEQ ID NO: 141209 - protein, 70 aa, Glycine max
  Coding DNA Sequence Number=SeqID_49524
MMLSSNIIYICVRVVMLVRMIHTRLFVAARVKSCPGMHSSGVIASLFGCALSFALLQDQGVAPELIKGNY

SEQ ID NO: 141210 - protein, 51 aa, Glycine max
  Coding DNA Sequence Number=SeqID_49525
MAQNDHNLSLCAIGHDRLWMAKRVSMTEIVGRPTKARLLLLRILNEELRPT

SEQ ID NO: 141211 - protein, 278 aa, Glycine max
  Coding DNA Sequence Number=SeqID_49526
  Gene Ontology: Mol. function=transporter activity; Cellular component= membrane; Biological process=transport
  Homolog annotation: Hit_ID=P0A2J2; Match level="QueryCoverage=100%, HitCoverage=90%, E-value=1e-121, Identity=83%"; Hit description=High- affinity branched-chain amino acid transport system permease protein livH
  Pfam annotation: Domain name=BPD_transp_2; Domain location=1-262; Score=191.9; E_value=1.6e-54; Accession=PF02653.7; Description =Branched-chain amino acid transport system  permease component
MVYGIIGMINFAHGEVYMIGSYVSFMIIAALMMMGIDTGWLLVAAGFVGAIVIASAYGWSIERVAYRPVRNSKRLIALISAIGMSIFLQNYVSLTEGSRDVALPSLFNGQWVVGHSENFSASITTMQAVIWIVTFLAMLALTIFIRYSRMGRACRACAEDLKMASLLGINTDRVIALTFVIGAAMAAVAGVLLGQFYGVINPYIGFMAGMKAFTAAVLGGIGSIPGAMIGGLILGIAEALSSAYLSTEYKDVVSFALLILVLLVMPTGILGRPEVEKV

SEQ ID NO: 141212 - protein, 47 aa, Glycine max
  Coding DNA Sequence Number=SeqID_49527
  Homolog annotation: Hit_ID=Q69F85; Match level="QueryCoverage=95%, HitCoverage=2%, E-value=2e-07, Identity=62%"; Hit description=Gag -pol polyprotein
SGVGIILEGLYNITLEQALKINFRASNNQAEYEALIADLKLARELGA

SEQ ID NO: 141213 - protein, 93 aa, Glycine max
  Coding DNA Sequence Number=SeqID_49528
  Homolog annotation: Hit_ID=A5C6R1; Match level="QueryCoverage=61%, HitCoverage=5%, E-value=4e-10, Identity=54%"; Hit description =Putative uncharacterized protein
  Subcellular localization annotation: CTP_CleavageSite=62; ConfidenceScore=5.20e-01
MDILLPIVLKSSTITGKKKNLPAPVPTLTPEMVQEMIVSAFSALGLLGKASLPSSPWYFDSSASNHMTNNVAALTNVTNYSGSTLKEDNREWA

SEQ ID NO: 141214 - protein, 179 aa, Glycine max
  Coding DNA Sequence Number=SeqID_49529
MTLTYKNRRITRPFRLARFGDDADAGSRQARQGASAGVGGCRGWLNYAASEQIVLRVHHMRCEIPHRCVRRKYRIRPHFAIQAAQLLGRAIGAGLFRYYAQLRKGMCCKAIKLVTPGFSQSRRVKRRPVNCNTTHYRANWSSTAVAAALELVDPPGCRNSIVHQAVRKGQLDPLPQDPK

SEQ ID NO: 141215 - protein, 179 aa, Glycine max
  Coding DNA Sequence Number=SeqID_49530
  Homolog annotation: Hit_ID=Q6WAY6; Match level="QueryCoverage=90%, HitCoverage=25%, E-value=6e-14, Identity=30%"; Hit description =Putative uncharacterized protein
MARIAKVFEISAQELDRVKQNKNGVVGIPRKHLEEKAKALADQGEWVSFVDVLALLVFGVILFPNVDGLVDLAAINAFLAYHHSKESPAITILADAYDILERRCEKSGTRIVCCTPALYVWLVSHLFHHESRPVYALQGHHMCAEKGKANWEQLLASMVGASINWFPRWKKGRVGVLSS

SEQ ID NO: 141216 - protein, 124 aa, Glycine max
  Coding DNA Sequence Number=SeqID_49531
MEEGYAASSEVGQVHLRMRKMLLVEIEKSFASQVLQGKVAKEPQLFVVSRVVVVVVVVAGLVEERKVCLGQQHFENKVVVVVAAVVKDSTIKVGMIPPPGLVPVAGEHKLQVVQLLQIAAQKGK

SEQ ID NO: 141217 - protein, 73 aa, Glycine max
  Coding DNA Sequence Number=SeqID_49532
MEETHEIPHHDLANFEPCLGYTVEGQAVGGIPLQNTLEGPQYHPQPQPSRCTAVKNPHDYGRRWGNTQKMRNC

SEQ ID NO: 141218 - protein, 179 aa, Glycine max
  Coding DNA Sequence Number=SeqID_49533
  Gene Ontology: Mol. function=metal ion binding; Cellular component =integral to membrane; Biological process=ubiquitin cycle
  Homolog annotation: Hit_ID=Q2HV66; Match level="QueryCoverage=100%, HitCoverage=100%, E-value=5e-42, Identity=51%"; Hit description=Zinc finger, RING-type
  Pfam annotation: Domain name=zf-C3HC4; Domain location=108-149; Score= 29.7; E_value=1.1e-05; Accession=PF00097.16; Description=Zinc finger, C3HC4 type (RING finger)
  Subcellular localization annotation: CTP_CleavageSite=47; ConfidenceScore=5.06e-01
MSSDHFPHLGLGYSIAIALAFLFLLSTLLLSSYLCCRHNRRRHTQTTASAAASDGGIVLPRVIFVAEDDDEDADACMVVGLDQSVINSYPRFQFNKDSDARNIINTTCSICLCEYKDSEMLRMMPECRHYFHLCCLDSWLKLNGSCPVCRNSPLPTPLSTPLQEVVPLSQYAADRRRNR

SEQ ID NO: 141219 - protein, 369 aa, Glycine max
  Coding DNA Sequence Number=SeqID_49534
  Gene Ontology: Mol. function=methyltransferase activity; Cellular component=cytoplasm; Biological process=fatty acid biosynthetic process
  Homolog annotation: Hit_ID=Q2HRW2; Match level="QueryCoverage=91%, HitCoverage=99%, E-value=4e-86, Identity=49%"; Hit description=Beta -ketoacyl synthase; SAM dependent carboxyl methyltransferase
  Pfam annotation: Domain name=Methyltransf_7; Domain location=37-368; Score=473.7; E_value=2.3e-139; Accession=PF03492.6; Description=SAM dependent carboxyl methyltransferase
MERYQLSLHMNDGNKEQSYANNSSMQRRVISKTKTILEETIMRLLYCDSSPSCMKVADLGCSAGPNTLLVISNIIDMVYKASTHLNHEPPTLQFYLNDLFGNDFNSIFKSLPDFCKRLIEDKGHNFGPCFINATPGSFYGRLFPNNSINLFHSSYGLHWLSQDPLLGSSEASLLNKGHCYIVNTSPPEVYKAYLKQFQQDFKLFLKSRSKELVPGGAMLLVLLGRNEIPPTVNGWEPISLILNDMFLEGLIEEAKLDSFNIPVYQPTVEEIRHVIQEEGSFYVQRLEIFIQPLGESINDGGDDSFLDGNLKAESVAKHMRAIMEPLLSTKFGAEVINELFTRFQKKIMQLMEVEKSEWATLMISMIKTA

SEQ ID NO: 141220 - protein, 355 aa, Glycine max
  Coding DNA Sequence Number=SeqID_49535
  Gene Ontology: Mol. function=D-erythro-sphingosine kinase activity; Biological process=activation of protein kinase C
  Homolog annotation: Hit_ID=A7PZN5; Match level="QueryCoverage=90%, HitCoverage=91%, E-value=1e-113, Identity=63%"; Hit description =Chromosome chr15 scaffold_40, whole genome shotgun sequence
  Pfam annotation: Domain name=DAGK_cat; Domain location=64-189; Score =34.5; E_value=1.6e-07; Accession=PF00781.15; Description =Diacylglycerol kinase catalytic domain (pres
MALGRVIYVAHTVCIRSELQPMAPDRIGSSSSSRQRDLVFVVNPLARKAELLVISLGIKFNFWKYWTIIGTQINCKKLEFQVLMGGQICESITSGPCHAIDITREAIREGADAVIAVGGDGTLHEVVNGFFWAGKPVVSQVKESTHSTALGLIPLGTGSDFARTFGWSSLGLRSMIDVGVITGESCDHHYFINVADIHLSAKAGFYASRYKRFGNLCYVIGALQAFIGHQNQDMRIRFNDGPWETCPQVTALCIGNAKYFGGGMKITPNADPFSRNLEVVTLQNFKWYDFVLKLHKLYSGTHLSVKNVSDRSVLSIEVEDISGMGGGIYIQSDGEHLGFLPKKISVVPAAIEMIL

SEQ ID NO: 141221 - protein, 55 aa, Glycine max
  Coding DNA Sequence Number=SeqID_49536
MVGFGGYDDMKVVVVMMVAAWVATLHVRDDIIVRGVVVDVGAEFIDEGLEGVPAW

SEQ ID NO: 141222 - protein, 212 aa, Glycine max
  Coding DNA Sequence Number=SeqID_49537
  Gene Ontology: Mol. function=DNA binding; Cellular component=nucleus; Biological process=metabolic process
  Homolog annotation: Hit_ID=A7PZI8; Match level="QueryCoverage=90%, HitCoverage=59%, E-value=6e-51, Identity=56%"; Hit description =Chromosome chr15 scaffold_40, whole genome shotgun sequence
  Pfam annotation: Domain name=Myb_DNA-binding; Domain location=18-63; Score=51.8; E_value=2.4e-12; Accession=PF00249.22; Description=Myb -like DNA-binding domain
MEDQNKKVRKPYTITKSRENWTDQEHDKFLEALHLFDRDWKKIEAFVGSKTVIQIRSHAQKYFMKVQKNGTSEHVPPPRPKRKAAHPYPQKASKNALTISQVARPLQSSSALSESSHIYRPDSSSVVRTPVSSVPLPSWVYNVTPPVSLPRVTKDDMVMMSQQINPFSSSNESTPRGWPISKQTDQGDQGKPTIGKVYRKVVLPVEAFFSRK

SEQ ID NO: 141223 - protein, 530 aa, Glycine max
  Coding DNA Sequence Number=SeqID_49538
  Gene Ontology: Mol. function=structural constituent of ribosome; Cellular component=ribonucleoprotein complex; Biological process =translation
  Homolog annotation: Hit_ID=A9PJP8; Match level="QueryCoverage=40%, HitCoverage=81%, E-value=3e-98, Identity=81%"; Hit description =Putative uncharacterized protein
  Pfam annotation: Domain name=Ribosomal_L5; Domain location=84-140; Score=101.1; E_value=3.3e-27; Accession=PF00281.10; Description =Ribosomal protein L5
  Pfam annotation: Domain name=Ribosomal_L5_C; Domain location=144-238; Score=151.1; E_value=3e-42; Accession=PF00673.12; Description =ribosomal L5P family C-terminus
  Pfam module annotation: Pfam domain module=Ribosomal_L5::Ribosomal_L5_ C; Domain location=84-140::144-238
  Subcellular localization annotation: CTP_CleavageSite=44; ConfidenceScore=5.76e-01
MATAPSLLHSSGSSFFSQFRAFQFSSSSLFPHGNRHGNAVVSVKASASGVVLVEKSEAEKANRLKTAYTEKIIPLLMEEFSYTNKHQVPKIEKIVVNCGIGDAAQNAKGLDAAISDLALITGQRPIKTRARASLATFKIREGQPLGIAVTLRGNMMYSFLDRVINLGLPRTRDFQGVNPNSFDGHGNYSIGIKDQGVFPEIRADVVGKPRGMDICIVTTANTDQEAQKLLALMGMPFREGSGPATTIRKKKLKSHHFDAKSKGRGRRLGHAINYVAMSALKLPTLPKTLEGVISQEKFEKSRAYSLDKSHFHFVHEFVTIVIDSTILYFGVLPWFWKISGDFMTIASLNAENEILHTLAFLAGVMIWSQITDLPFSLYSTFVIEARHGFNKKGGPYLAIYLWAFTFGLSIVMMTLYPVLIAPLFNKFTPAVEVWGWEDLELGLDEEQSILVFGRSIPEEGHNSLTNNCWVKAVIIIIKLMELGWVDLPDGQLREKIEKLASSLNYPLKKLFVVDGSTRSSHSNVRNIDLL

SEQ ID NO: 141224 - protein, 33 aa, Glycine max
  Coding DNA Sequence Number=SeqID_49539
MTVEQTKSKLKDRNTPTSNKEPEPMDIPAETLK

SEQ ID NO: 141225 - protein, 56 aa, Glycine max
  Coding DNA Sequence Number=SeqID_49540
MDTIYIMHEVQLMWDLGISQYIPFMSSTYWAWCVNHKWWVLVAAEAKTRSQGQNLL

SEQ ID NO: 141226 - protein, 106 aa, Glycine max
  Coding DNA Sequence Number=SeqID_49541
  Subcellular localization annotation: CTP_CleavageSite=72; ConfidenceScore=5.59e-01
MADSKNLIKKALWPNSLSNSSGPKTSNTSQHETPPKIAIKDVFYSSRPSNPPNTSTTTSPSGTPLPKMRDVFARRKGKGSGGYAGHGHQEHWREKWLKNLKSHYAS

SEQ ID NO: 141227 - protein, 67 aa, Glycine max
  Coding DNA Sequence Number=SeqID_49542
MSGVLALIQKELSNFKLYSYADDEAASVSPQILQFVASALSGYVAEHLDSPMDLSFERRLSAKAFVA

SEQ ID NO: 141228 - protein, 410 aa, Glycine max
  Coding DNA Sequence Number=SeqID_49543
  Gene Ontology: Mol. function=protein binding; Cellular component =nucleolus; Biological process=ribosomal small subunit biogenesis and assembly
  Homolog annotation: Hit_ID=A7P2C0; Match level="QueryCoverage=77%, HitCoverage=35%, E-value=9e-63, Identity=48%"; Hit description =Chromosome chr1 scaffold_5, whole genome shotgun sequence
MSYARTPPQSIGRPRALRVEAAHALENAIRISDYKLPNVLNRKLSKKSKYHLSDGEENDFEGIDSLGRDDFEDEMLPDDIDAETDEKLDLVQRSMQIPGETSADDGEENRHKSKKEVMEEIISKSKFYKVWDISVIKAMAQKAKDKEENENLVEELDKDFTSLVQSEALLSLTEPNKMNALKALVNKSISNDQSNKDQMSATRTMDNSVQEKPDDYDKLVKQMGLEMRARPSDRTKTPEEIAQEEKEGLEQLEEERQKRMVAAEDSSDEDNEDSEKPFEQKPRSISGDDLGDSFSVNEQIMTKKGWVDEILERRDEEDSSSEDDDGEDPDNLGSSEDADEGSDEDLDEHEKDLSLKDWEQSDDDDIGADLEDEDDSDENIETAAEDLDEVKGSDAAVHIKKQKEMLLLKV

SEQ ID NO: 141229 - protein, 201 aa, Glycine max
  Coding DNA Sequence Number=SeqID_49544
  Gene Ontology: Mol. function=oxidoreductase activity; Cellular component=cytoplasm; Biological process=metabolic process
  Homolog annotation: Hit_ID=Q9FI45; Match level="QueryCoverage=59%, HitCoverage=37%, E-value=4e-45, Identity=72%"; Hit description =Carbonyl reductase-like protein
  Pfam annotation: Domain name=adh_short; Domain location=37-160; Score= -31.6; E_value=0.0015; Accession=PF00106.16; Description=short chain dehydrogenase
MGHKEKSKDLKEKRLQQISLLRTIPYSDHQRWWSKETVAVVTGGNRGIGFEICRQLAGHGVTVVLTSRDESVGVESAKVLQEGGFTEVACHQLDILDPSSINQFAEWLKENYGGLDILFHVNWPFLKAKFQVLMIWMLLLGYLASMNPLDVIQTRDGGYLASMNPLDVAMARKEAPKLAMQMSRPFVLASYQSLTGFKLYL

SEQ ID NO: 141230 - protein, 223 aa, Glycine max
  Coding DNA Sequence Number=SeqID_49545
  Gene Ontology: Mol. function=oxidoreductase activity; Cellular component=integral to membrane; Biological process=electron transport
  Homolog annotation: Hit_ID=Q5XMI8; Match level="QueryCoverage=95%, HitCoverage=34%, E-value=2e-61, Identity=50%"; Hit description=Iron reductase
  Pfam annotation: Domain name=Ferric_reduct; Domain location=143-223; Score=-0.9; E_value=0.00087; Accession=PF01794.10; Description =Ferric reductase like transmembrane component
MDVEAVKRSPSQEKYGRVQSAIRLLVLVVFLGWIFVWIVTPTNTYQQKWQPRLQAKTNSIFGAQGAMLLVYTFPILFIAVLGCVYVHIAKKGNGFGKESSYGKKREVSIWKRLVLVRGPLGIVSGTEMVFFWEKKLDIASVRLALVGNICLAFLFFPVARGSSVLPLLGLTPESCIKYHIWLGNVAMTLFTAHGICFIIYWTVTDKLSKVLKNPYYYLSFGAL

SEQ ID NO: 141231 - protein, 805 aa, Glycine max
  Coding DNA Sequence Number=SeqID_49546
  Homolog annotation: Hit_ID=A7PZM7; Match level="QueryCoverage=99%, HitCoverage=90%, E-value=0.0, Identity=52%"; Hit description =Chromosome chr15 scaffold_40, whole genome shotgun sequence
MSTLPIICFRDGSPPLPDALNTSLKDSATSGINDLDVERCFPMQKNITMKLTNNQISPGVWYIGLFNGIGPTRTQSKMNFQPMISVLQIIRGPSFSFIANISVEACTNSMMRGDFCNSSVYPLSCAESDVSNALEAKMNKSMLESLVTCKSNFEAFCVHEGMPNFFSLDIMNVAEEIIITAANIRFNVSRSNDISLMCFVRHGAMPSVTSNDYNINIAKGPLVIHSPLIGRWYISIVPVNLTKTQDNSVRVCYSVESQVLQCPLGKAGPNCTMDSYLLQNFKQLKIWNFNFLLKGEKLKFSSYSLLQETPSEFVEYRSGTFVRRGSTPFESYYLPVVGGASYDSANFPLEPLLDDSSYSGEPDNIWTYFLLNIPRGAAGGNIHIQLSSDMKISYEVYARFGGLPSLDSWDYYYANKTRRSDPSMFFTLYDSSDNKVNFYIMYAREGTWGIGLRHLNTSSDSMKGLTIMSISLERCPKRCSSHGECKFSFDASGLTSYRHEPRKSSAKTFLVLDTLVMIETHGKKIECRIVDFSGCIFCSCDRNHGGFDCSIEIVTHQGHVRQSIFLIVSNAAAILPAYWALRKKALAEWVLYTSSGISSGLYHACDVGTWCALNYNVLQFMDFWLSFMAVISTFLYLATIDEVLKRAIHTAVAILTALMAATKATRSSNVILVIVIGALGLFIGWLIEISTKYRSLSFSIGISFNFSHCFQTIKQWLYNLVKTLLRRYHWAFALAGFLALAMAAISWTLETSETYWFWHSIWHITIYTSSFFFLCSKANIEDTENQLPTNGNYELTHQDSLPRTG

SEQ ID NO: 141232 - protein, 935 aa, Glycine max
  Coding DNA Sequence Number=SeqID_49547
  Gene Ontology: Mol. function=GTPase activator activity; Cellular component=integral to membrane; Biological process=regulation of small GTPase mediated signal transduction
  Homolog annotation: Hit_ID=Q2HUD0; Match level="QueryCoverage=100%, HitCoverage=92%, E-value=0.0, Identity=80%"; Hit description=WD40 -like
  Pfam annotation: Domain name=RIC1; Domain location=534-854; Score =317.1; E_value=3.2e-92; Accession=PF07064.4; Description=RIC1
MAYGWPQVIPLEQGLCPSAQKIVYLKVINRTLLVVSPTHFELWSTSQHRVRLGKYKRDSDSLQREGENLQAVWSPDAKLIAILTSAFFLHIFKVQLSDKRIHTGGKQPSALCLATISLLLTEQVPFTAKDLSVSNIVSDNKHMLLGLSDGTLYSMSWKGEFYGAFQFYPQPTASFDNSQMPLTLENGLSPKSHPKVLMSNHIIPRKSEINQLELCLPLRFLFVLYSDGELVSCSVSKKGLKQVDCIKAEKRLACGDAVCASVALEQQILAVGTKRGIVELYDLAESVSLIRAVSLYDWGYSMDDTGPVSFIAWTPDNSAFAVGWKLRGLTVWSVSGCRLMSTIRQIGLSSVSSPISKPNHDCKYEPLMGGTSLMQWDEYGYRLYAIEVGSSERILSFSFGKCCLSRGVSGTTYIRQVIYGEDRLLIVQSEETDELKMLHLKLPVSYISQNWPVQHVAASQDGMYLAVAGLHGLILYDIRLKRWRVFGDVTQEQKIQCKANGELSLLDLDDGRERNLTDSVELFWVTCGQSEDKTNLIEEVSWLDYGHRGMQVWYPSPGANSFKQEDFLQLDPELEFDREVYPLGLLPNAGVVVGVSQRMSFPASAEFPCFEPSPQAQTILHCLLRHLLQQWWVAAGSDGARRMAVRGQVSISQMLCEEAAAALMLEFTVTQDKKEASSSVEPNQGDKIEEALRLAELSAEKPHFSHCLEWLLFTVFEADISRPNVNKNQISVVKHAKRSLLEKTCDLIRNFPEYLDVVVSVARKTDGRHWADLFTAAGRSTDPFFPFDLFNSSYTNFNDVVIKLTQATLDESLYELAGELVRFLLRSGREYDQASNDSDKLSPRFLGYFLFRSSEQKQSLDKSTSFKEQSSHVTSVKNILENHASYLMSGKELSKLVAFVKGTQFDLVEYLQRERYGSARLENFASGLELISQKV

SEQ ID NO: 141233 - protein, 559 aa, Glycine max
  Coding DNA Sequence Number=SeqID_49548
  Gene Ontology: Mol. function=DNA binding; Cellular component =intracellular
  Homolog annotation: Hit_ID=Q2HUC6; Match level="QueryCoverage=94%, HitCoverage=75%, E-value=1e-142, Identity=53%"; Hit description =ELM2; AT-rich interaction region; Homeodomain-related
  Pfam annotation: Domain name=ELM2; Domain location=353-405; Score =37.5; E_value=4.8e-08; Accession=PF01448.15; Description=ELM2 domain
  Pfam annotation: Domain name=Myb_DNA-binding; Domain location=451 -501; Score=31.2; E_value=3.8e-06; Accession=PF00249.22; Description =Myb-like DNA-binding domain
  Pfam module annotation: Pfam domain module=ELM2::Myb_DNA-binding; Domain location=353-405::451-501
VYEYLDETKSCVSDSVKGKKSDSNGDEFDNVCDFLDGRELCDTNRVKGVSPESNGDKKVQSKGLVDLDMLDDGTDEHIIRNLCSLNTERNILEEFDGGKILTVDASDAESNMPRLSDGSKCCDNDDDDDSDEVLILDPSGVDKEIFGRKRKRESKSEMLSWITSIAKNPCDSTVGSIPEKSKWKFYSSQEIWKQVLLFREAVFLKKDFETTSEQLNWQWSSVVLSENTFAGEKGGSWTRNYSRSGIVAHHCSAWIQLKQKILASVSFKGQKMHPSMYDDRVGAMYNLRQRLKCDKRVLLGKTTSGGVSLASSGGTHVDLERTPSSHAEDRAEKLLPDSGTAHSSLDRCARVHIPLGPNHQAEVPEWTVITYEVDSKWLGTQIWPPKTVNSKCRLFERDPIGEGRQNSCGCQVQGSVECVRFHIAKRRAKVKLELGEAFHQWNLHKVGEEVGGSWTEQEEKKFKDVVKSNPASLDKCFWDHLFKTFPKKSREDLVSYYFNVFLLQRRAYQNRHTPDNIDSDDDESEFTPLRKVFGHQTPKPRSFTLLSPKKATFKRENNK

SEQ ID NO: 141234 - protein, 165 aa, Glycine max
  Coding DNA Sequence Number=SeqID_49549
  Gene Ontology: Mol. function=phosphoric monoester hydrolase activity; Cellular component=cytoplasm; Biological process=dephosphorylation
  Homolog annotation: Hit_ID=Q2HVZ9; Match level="QueryCoverage=70%, HitCoverage=58%, E-value=2e-51, Identity=79%"; Hit description =Tyrosine specific protein phosphatase and dual specificity protein phosphatase; Putative tyrosine phosphatase
  Pfam annotation: Domain name=Y_phosphatase2; Domain location=16-148; Score=102.9; E_value=9.5e-28; Accession=PF03162.4; Description =Tyrosine phosphatase family
MGMIVDFENDQNDAVLVPPPNFAMVEDCVFRSSFPTPSNFPFLQTLNLRSIIYLCPEPYPEGNLEFLRSQNIRLFQFGIEGKTDVSMPVLKDSIMDALKVLIDVRNHPILVHCKRGKFQESSQKGQDASDINHKLAILQKENAVLLERLETLKRELEEERLKCSS

SEQ ID NO: 141235 - protein, 102 aa, Glycine max
  Coding DNA Sequence Number=SeqID_49550
  Gene Ontology: Mol. function=protein binding; Cellular component =membrane; Biological process=ribosome biogenesis and assembly
  Homolog annotation: Hit_ID=A7PV91; Match level="QueryCoverage=81%, HitCoverage=28%, E-value=3e-37, Identity=93%"; Hit description =Chromosome chr4 scaffold_32, whole genome shotgun sequence
  Pfam annotation: Domain name=UPF0016; Domain location=20-93; Score =108.7; E_value=1.7e-29; Accession=PF01169.10; Description =Uncharacterized protein family UPF0016
MEEFPGFPPHYTSWSLAMGKSFILTFLAEWGDRSQIATIALATHKNAIGVAVGATIGHTICTSLAVVGGSMLASKISQRSVATVGGLLFIGFSISSYFYPPL

SEQ ID NO: 141236 - protein, 166 aa, Glycine max
  Coding DNA Sequence Number=SeqID_49551
  Homolog annotation: Hit_ID=Q2HTK5; Match level="QueryCoverage=82%, HitCoverage=55%, E-value=8e-09, Identity=28%"; Hit description=H+ -transporting two-sector ATPase, alpha/beta subunit, central region
MTPGFGELNPLGLSQLNLSIKLSMKDNLIKRQIQVDNDLCPFCHSQPETASHLFFTCGKIMPMWWEFLSWVKEDKVFHCRPMDNFLQHYSSAASKVSNTRRIMWWIAATVSIWRLRNDIIFQNQDFDITRLTDNSLFLLWTWLRGWERNFQIPYYCWSSNMSTAFS

SEQ ID NO: 141237 - protein, 587 aa, Glycine max
  Coding DNA Sequence Number=SeqID_49552
  Gene Ontology: Mol. function=protein kinase activity; Cellular component=centrosome; Biological process=protein amino acid phosphorylation
  Homolog annotation: Hit_ID=Q0WL65; Match level="QueryCoverage=100%, HitCoverage=74%, E-value=0.0, Identity=68%"; Hit description =Putative uncharacterized protein At2g40730
  Pfam annotation: Domain name=HEAT; Domain location=157-193; Score =13.1; E_value=0.3; Accession=PF02985.13; Description=HEAT repeat
  Pfam annotation: Domain name=HEAT; Domain location=196-232; Score =14.4; E_value=0.19; Accession=PF02985.13; Description=HEAT repeat
  Pfam annotation: Domain name=HEAT; Domain location=234-271; Score =10.5; E_value=0.72; Accession=PF02985.13; Description=HEAT repeat
  Pfam annotation: Domain name=HEAT; Domain location=314-350; Score =24.9; E_value=0.00031; Accession=PF02985.13; Description=HEAT repeat
  Pfam module annotation: Pfam domain module=HEAT::HEAT::HEAT::HEAT; Domain location=157-193::196-232::234-271::314-350
MELAKSDWDAIKKSPPWAIDSWGMGCLIYEVFSGLRLGKTEELRNIGSIPKSLLPDYQRLLSSMPSRRLNTSKLIENSEYFQNKLVDTIHFMEILSLKDSVERDTFFRKLPNLAEQLPRQIVLKKLLPLLASALEFGSAAASALTALLKMGSWLSAEEFNVKVLPTIVKLFASNDRAIRVALLQHIDQYGESLSAQAVDEQVYPHVATGFSDTSAFLRELTLKSMLILAPKLSQRTMSGSLLKYLSKLQVDEEPAIRTNTTILLGNIGSYLNEGTRKRVLINAFTVRALRDTFPPARGAGIMALCATSSYYDITEVATRILPNVVVLTIDPDSDVRTKAFQAVDQFLQIAKQHYEKTNAADTTGVAGVGSSSVPGNASLLGWAMSSLTLKGKPSDHAPVASASSTAITSTSSNGTAGIETPSTAPARVNSTSDLAEHPVPTSPTSTDGWGELENGIDEEHGSDRDGWDDLEPLEESKPALANIQAAQRRPVSQPISHTKQASNLLSKSTPKLNKDEDDDLWGSIAAPAPKTARPLNLKSAQTDDDDPWAAIAAPAPTTKAKPLSTGRGRGAKPAAPKLGAQRINRTS

SEQ ID NO: 141238 - protein, 280 aa, Glycine max
  Coding DNA Sequence Number=SeqID_49553
  Gene Ontology: Mol. function=nucleic acid binding; Cellular component= nucleus
  Homolog annotation: Hit_ID=Q9SWF9; Match level="QueryCoverage=81%, HitCoverage=66%, E-value=1e-120, Identity=77%"; Hit description=Zinc finger CCCH domain-containing protein ZFN-like
  Pfam annotation: Domain name=zf-CCCH; Domain location=232-258; Score =43.6; E_value=6.8e-10; Accession=PF00642.15; Description=Zinc finger C-x8-C-x5-C-x3-H type (and similar)
  Pfam annotation: Domain name=zf-CCCH; Domain location=75-101; Score =44.5; E_value=3.9e-10; Accession=PF00642.15; Description=Zinc finger C-x8-C-x5-C-x3-H type (and similar)
  Pfam module annotation: Pfam domain module=zf-CCCH::zf-CCCH; Domain location=232-258::75-101
MAISVELVVLNTLRNGGGRKEIKPSMRVACHPFSLSVVSGIIYLHLFEKWFHHPRDKAGIAGRVALNILGYPLRPNEPECGYYLRTGQCKFGNTCKFHHPQPNNMVLSMRSSPVYPTVHSPTTPGHQSYATGITNWSSSSYIPSPRWQGPSSYAPLILPQGMVSVSGWSAYSGQMGSDSPQQTMANGQSYGTSRQSEPANSGSQGAYSQFRSGSVPVGFYALQRENIFPERPDQPECQFYMKTGDCKFGAVCRFHHPHERMIPAPDCVLSPIGLPLRPVS

SEQ ID NO: 141239 - protein, 100 aa, Glycine max
  Coding DNA Sequence Number=SeqID_49554
  Subcellular localization annotation: CTP_CleavageSite=55; ConfidenceScore=5.42e-01
MAKANTHLRRASSSSSDISVYLDADNTSVPAASSGPIDRNPSSSMLSLSPSRNAEAAPVAQPADQVNGKNAAVAKVDRSKGSSALALAKFLDEKVPFKKK

SEQ ID NO: 141240 - protein, 105 aa, Glycine max
  Coding DNA Sequence Number=SeqID_49555
MTTLTWIWMTLLFSNILPSDHNANLPCKWIAPTRRPVDPKKSNRALGFPTLVMGLCQSYRVLVPPARSCHRDIGKDRAHKTPSGPEEVQQGPGVSSSGYGPLSVL

SEQ ID NO: 141241 - protein, 162 aa, Glycine max
  Coding DNA Sequence Number=SeqID_49556
MVAPPDSIPLIEQFNEMVAWPGTQPSLHREDEGPTTQVPQLMEDESSEATIPEPFDIGEEAEETQVRQVAVVTPERSLEPTLEPSAPVVNLPSPQPTTDPSTPLLQMPEDLTMPVLAVDTSPPTTLVLQLTDEEDGQTQDTQDQSQEFLFLMILFAFDLLLF

SEQ ID NO: 141242 - protein, 121 aa, Glycine max
  Coding DNA Sequence Number=SeqID_49557
  Gene Ontology: Mol. function=NAD+ diphosphatase activity; Biological process=isoprenoid biosynthetic process
  Homolog annotation: Hit_ID=Q5PKA4; Match level="QueryCoverage=67%, HitCoverage=31%, E-value=3e-34, Identity=85%"; Hit description=NADH pyrophosphatase
MEESGIKVKNLRYVTSQPWPFPQSLMTAFMAEYDSGDIVVDKKELLSAEWYRYDDLPLLPPPGTVARRLIEDTVAMCRAEYDRLMSPGSHGLGHYMRQAGSLSSGIQSHPHATSGRFHVAV

SEQ ID NO: 141243 - protein, 50 aa, Glycine max
  Coding DNA Sequence Number=SeqID_49558
MNKDGANSQANVVKSVEDEDDVFLTTNYEVAKTKWVMDSAASKHIVEIDR

SEQ ID NO: 141244 - protein, 201 aa, Glycine max
  Coding DNA Sequence Number=SeqID_49559
MTTLTQMWMTLLLSNVVPSDHNSDLPLPKCQLVYAILTRMNVHVAQLIADTIYLFAALITSLCQSFEVPVTPSKVIRPPITWAFIEKYCTPRQAQGDAPQAADAPPPPHQADPAGSLGMVQYLQHLVRQQAANHRGQQGQGFAPFACPTPDQFRAEVAWPGDWPEAQAGEAPAGAPGDAEEARMDEKMTDLLGFLGGSGPT

SEQ ID NO: 141245 - protein, 41 aa, Glycine max
  Coding DNA Sequence Number=SeqID_49560
MTIQDLQEHEMELLRLNQHEENDKKKKGIALKASPSNQEES

SEQ ID NO: 141246 - protein, 134 aa, Glycine max
  Coding DNA Sequence Number=SeqID_49561
MAPKKLSTKRSRRDATGEGSSAASEFDSHRFWSAKHQQRFEAIRGWSFHRERRVQLREDEYSDFQEEIARRHWTPLVTPMAKFDPEIVLEFYANAWPTEEGVRDMRLWVRGQRIPFDVDALSQFLGDPLILEED

SEQ ID NO: 141247 - protein, 142 aa, Glycine max
  Coding DNA Sequence Number=SeqID_49562
MQSQGLALPPKPLAGPSGPRVSTKGSYVDPSGNDPETGNSDWCGLYIEADPNCLVALGTVYEGSTVVHNTHLLPGQVKVGVEEVTDADAPVLVSTDEVSLAGQAIHTFLAWPTHLVKSLSQQLCLWQNHLKSPIRRSMIRFI

SEQ ID NO: 141248 - protein, 70 aa, Glycine max
  Coding DNA Sequence Number=SeqID_49563
  Gene Ontology: Mol. function=transferase activity, transferring glycosyl groups; Cellular component=nucleus; Biological process =nucleoside metabolic process
  Homolog annotation: Hit_ID=A7ZPU1; Match level="QueryCoverage=100%, HitCoverage=33%, E-value=6e-29, Identity=91%"; Hit description =Uracil phosphoribosyltransferase
MIATIDLLKKAGCHSIKVLVLVAAPEGIAALEKAHPDVELYTASIDQCLNDKGYIVPGLGDAGDKIFGTK

SEQ ID NO: 141249 - protein, 31 aa, Glycine max
  Coding DNA Sequence Number=SeqID_49564
MAYGKLIEMKGRVNLGLKRLWEKLGLCKGGK

SEQ ID NO: 141250 - protein, 113 aa, Glycine max
  Coding DNA Sequence Number=SeqID_49565
VDSRGSHAAARVKSCPGMYSSYAIASVSGCARTVGLPPISGGGLRTDKSKLLAPHPGAQMWSPMKARACSPTKAKACSPLKVKACSPMKGRTCSPLKARTCSPLKVRTSSPSE

SEQ ID NO: 141251 - protein, 73 aa, Glycine max
  Coding DNA Sequence Number=SeqID_49566
MGEDLWPLVRNELIKELGRWSHEYMNLFGGTERFEQLKLSLLVDGFSKVSVDKWMDITDMGYVIVFIMRYNLL

SEQ ID NO: 141252 - protein, 142 aa, Glycine max
  Coding DNA Sequence Number=SeqID_49567
MDNEEGVQEQMKADLSALKDQMASISEVMLKLQKTIEDKATTTASSTVREAEPVLQPALNPGLDRNTGVFGRRYSLQAYPYGLPPDFTPRATPEDLSQAPTFEGQLPPYEDYPGQDDGEGDTHLGPLLHLKDPSPHELPSRT

SEQ ID NO: 141253 - protein, 114 aa, Glycine max
  Coding DNA Sequence Number=SeqID_49568
MEPPVRGKYGKEEEKTGVTHFKSFWVGTIGQLPYPNFVRGPLFDGMQPLLNHFEKSKENIVARSVKFRNMPETKRKHCYAIRKDVPPEGGCFWRKQPSSPGRAGWQAPPSFSYK

SEQ ID NO: 141254 - protein, 110 aa, Glycine max
  Coding DNA Sequence Number=SeqID_49569
MAPKKLSAKRSRRDAAAEGTSATPEFDSHRFRSAEHQQRFEAIKGWSFHRERRAQLRDNEYTDFQEEIARRHWTSLVTPMAKFDPDIVLEFYANAWPTEEGVRDMRSWVK

SEQ ID NO: 141255 - protein, 38 aa, Glycine max
  Coding DNA Sequence Number=SeqID_49570
CTICGGAHESGCCIAIEEHPTREVNYMGNQPRKNFNTG

SEQ ID NO: 141256 - protein, 87 aa, Glycine max
  Coding DNA Sequence Number=SeqID_49571
MGRNILPERKVELYHTKLDNFKAELERRNFHKRLTNLADESIDLALVKEFYANLYSSEDRPPKQSRVRGHLVKIDADNLKRIPGDTC

SEQ ID NO: 141257 - protein, 92 aa, Glycine max
  Coding DNA Sequence Number=SeqID_49572
MDRARLVYGLVTNMDMNIGALILGQISSIAQSNSSRLGFLALIIALCRARGVTSNSLTYESLNLAINLAYIKKNCWNMDDLTVNFRGARKRA

SEQ ID NO: 141258 - protein, 87 aa, Glycine max
  Coding DNA Sequence Number=SeqID_49573
MACLDQQHSGKEGQAIVAVVVIVVVEDLPISDLDDSSNLDCIYCLKHHNYSAVVGFAVEGVYYKCLQHRLQLLIDSRLLQEGQRSVW

SEQ ID NO: 141259 - protein, 75 aa, Glycine max
  Coding DNA Sequence Number=SeqID_49574
MSNLNVDEDDDDDYLVSKSYVEESLDEDDSVDGISDTDDKVTDMIQPVRIVHPAEGAQGIENPFWNDALHYNNIN

SEQ ID NO: 141260 - protein, 83 aa, Glycine max
  Coding DNA Sequence Number=SeqID_49575
MDLRGDGDPATNVIANWHIKDSELIQSELPPTIQYQLPKVKDNSDKLVMATPFKTKDVNEEITLKDIRSLMEQANYTNKYLQV

SEQ ID NO: 141261 - protein, 160 aa, Glycine max
  Coding DNA Sequence Number=SeqID_49576
MKADIEAMKEQMATMMEAKMIMKKIMEASAVAVVATSTVAKYGRPHDVKIQNEHAFPPHGLPPNYTRPNVVYTPNEDVNKCSLRADNLIIYMSLNRWGRHMKFPTTIKPTSGLASDMPLKGKQLLVYPYKTLWRALSIIPNYTSCIPQQVKTLMLWQNGK

SEQ ID NO: 141262 - protein, 47 aa, Glycine max
  Coding DNA Sequence Number=SeqID_49577
QHHISQTLEIDTTEVRNSYPARALDRKLKVDWARDAREGPRVLMSLR

SEQ ID NO: 141263 - protein, 61 aa, Glycine max
  Coding DNA Sequence Number=SeqID_49578
MEVVVVIIKKGENVNHENFDDIKKNLLEKEGDVNHASFDGVEKKSHVCHHQKGGECECMYI

SEQ ID NO: 141264 - protein, 149 aa, Glycine max
  Coding DNA Sequence Number=SeqID_49579
MGDGQPCRMAEFIVGILIGGGILGRYISTMTSRLYIKIWLGRQVVGIKLDFGKIIGWGRIATCNRNILSSLSLRRHLFEYEEGVAVAFMEEISAYPIQCHLKDNLLWKADPSGMYSIRSLSALFVILSRRRQAIFFSNAIRLLACGGNP

SEQ ID NO: 141265 - protein, 38 aa, Glycine max
  Coding DNA Sequence Number=SeqID_49580
MGVQIAPRPTWALWNIPPEGGEEGKKEGVGYRARIRNH

SEQ ID NO: 141266 - protein, 35 aa, Glycine max
  Coding DNA Sequence Number=SeqID_49581
MGPITRAMAKRLQEDWAIDVGKGPRVLMSLRGSKV

SEQ ID NO: 141267 - protein, 55 aa, Glycine max
  Coding DNA Sequence Number=SeqID_49582
MAGQNDRAITDALQALTQAIGNQNRGEAAGVVEYQGLGRFQQNNPPAFNGGYNPD

SEQ ID NO: 141268 - protein, 252 aa, Glycine max
  Coding DNA Sequence Number=SeqID_49583
  Homolog annotation: Hit_ID=Q3BKH8; Match level="QueryCoverage=25%, HitCoverage=86%, E-value=8e-17, Identity=69%"; Hit description =Putative uncharacterized protein
CRKAKEVGDLMTGEPTTEAPVNGGRNYNGPKVAKFLVGCGLPAPGQKDPMKLHCFLGLALGFSCAAKPSVRYHSGRARILTLCQDLRAEGQSQVSSGQTEIGPFECKGRRELDCKTTRRAGTKVGLSDPTCRVKGRRSTDKVTLGIQADLPQELTSTGSMFQGLGCSPIKAVRELGSERRETVRSISGVGVRALRGPFPSTRGPGRTHLWCASYRAHGKRWVAKASGSTAETAMGSLPQRGWSERSFENSRE

SEQ ID NO: 141269 - protein, 131 aa, Glycine max
  Coding DNA Sequence Number=SeqID_49584
  Homolog annotation: Hit_ID=Q6WAY4; Match level="QueryCoverage=62%, HitCoverage=15%, E-value=1e-09, Identity=40%"; Hit description =Putative uncharacterized protein
MGTNQNGKRFYQVKVKGLDVTSLKELGRLMGPLQRQAFCKIYGKILDLTVVEVFTEAVVSIAQYYDQPLRCFTFGDFQMVPTIEEFEEILGCPLGGRKPYLFSGFLPSLSKIAAVVGDSAKELDCMKQIQN

SEQ ID NO: 141270 - protein, 138 aa, Glycine max
  Coding DNA Sequence Number=SeqID_49585
METCLAVEELLQQMIDRGRLEVGDEGREEQHICMQSADERSLEGLTFGDIFHQGRSFTKAPSWYPSAVTPVRAFGHTGNSHQQPCVAKAPTQRGSPRGSNSDINSSRPDLLPSLIANHLAVVTPGKASNSFQSGGRMT

SEQ ID NO: 141271 - protein, 95 aa, Glycine max
  Coding DNA Sequence Number=SeqID_49586
SSDMRDYLMVTRTFRQPGANEPIEARRLTSSSAAFVIVTRESGDMRGYHMVTRTYRQQGENEPVDARRPTSSSSPFVDLTREADIVFSTFCRADP

SEQ ID NO: 141272 - protein, 158 aa, Glycine max
  Coding DNA Sequence Number=SeqID_49587
MILRGQDIYSSQDKATNSPSSSESEKAKGGESSEEIYPQEEGQPLVVKEKCKEVSVSSKRLAKKETHFTINTNIKETFPLRQPPHFLFCKKTLASIVTPLGLDFIPQVKKLLDEGLFRKSLNPCALLVPKIDKDLASQRILLRKLLKEATRELLEEAS

SEQ ID NO: 141273 - protein, 205 aa, Glycine max
  Coding DNA Sequence Number=SeqID_49588
  Homolog annotation: Hit_ID=A7UQU7; Match level="QueryCoverage=68%, HitCoverage=23%, E-value=3e-21, Identity=38%"; Hit description=IMP dehydrogenase/GMP reductase, putative
ALRDLTLVGRYAWGAIGLVHMYDQLNDASLSTSRQLAGYITLLQCWIYEHFPSAAECNVDSDYDEVSPRACRWITTKKTVKKVSTATYRQHLDRLRIPDVCWMPYSEHRPVQDFHPISCFSRLVHWGPIVVRYRPKRVMRQFGYFQCTHAHHIHQWVSYDDIDDTWTHYLDHLATAGDLCVVSGQCAPDYIDWFFCISHPFMIVA

SEQ ID NO: 141274 - protein, 97 aa, Glycine max
  Coding DNA Sequence Number=SeqID_49589
  Gene Ontology: Biological process=transposition, DNA-mediated
  Homolog annotation: Hit_ID=Q1J7G7; Match level="QueryCoverage=40%, HitCoverage=55%, E-value=2e-15, Identity=97%"; Hit description =Transposase
MAKVGTSYVPINVSFSPKVGPGLPGIYSAQSASGDAAQLTDLVYDGVFEVLQWLLFLSAVPPVQLLTGWCVTAKAPPDISAGKCSGHAARNHHTRRA

SEQ ID NO: 141275 - protein, 120 aa, Glycine max
  Coding DNA Sequence Number=SeqID_49590
MEPIASLAQYYDQPLRCFIFGDFQLSPMVEEFEEILGCPLGGRKPYLFSGSLCGAGFTPFFQEGRPVYPLQGYRSCVEKGKANWDQLLASMGGRLLIGSLARRKEESRFYLHAKDVQMFP

SEQ ID NO: 141276 - protein, 183 aa, Glycine max
  Coding DNA Sequence Number=SeqID_49591
MTGPLDESISCFLIKVDPWVLVPITFRGLYVLAIRGLHILACRGLHTLAFRRLRVLIFSVLHIHTLTEYKGSCPQDTQWTRRSPTGPWGFQLWLRASVSPTRCPVPPAKSCHRDIGMAPTKTPSGLGEVQQGPGVSSSGIAPARHPVDPKKSNRVLELSSSNYGSLSVLRSTCHLQQGHQAPY

SEQ ID NO: 141277 - protein, 255 aa, Glycine max
  Coding DNA Sequence Number=SeqID_49592
MAPKKLSTKRSRSDAHGESSSASMEFDSHRERRVQLIEDEYSDFQEEIARRHWTPLVTPMAKLDPEIVLEFYANAWPTEEGVRDMRLWVRGQWIPFGTDAFSQFLGHPLILEEDHRCEFSQRRDQASGFDKEAIAQLLCIPWQDFARTAAGRRVWIMRTSMTTLTHIWMTLLLSNILPSDHNFDLPLPKCQMVYTILTRMTIHVARIIVDAIYLFAGTAPTRHPLDPERSNRALGFLALITGLCQFCGVLVIPSK

SEQ ID NO: 141278 - protein, 59 aa, Glycine max
  Coding DNA Sequence Number=SeqID_49593
MTCCSRRNKRMTKLGLCLSSGPPPLDDKKVRITVRYLRVSWVQNDQTWSLLVIGPAASG

SEQ ID NO: 141279 - protein, 128 aa, Glycine max
  Coding DNA Sequence Number=SeqID_49594
  Subcellular localization annotation: CTP_CleavageSite=50; ConfidenceScore=5.33e-01
MVKVGTSYVPINVSFSPKSWPRASRYQQGHQDLFILRSDLPSQHRRTSALASVAVTLRVTTTPAALNAPLQGASHSPFRLRNCWEGRSVRASSLLRQLAKGGCAARRLSWVTPGFSQSRRCKTTASEL

SEQ ID NO: 141280 - protein, 275 aa, Glycine max
  Coding DNA Sequence Number=SeqID_49595
  Homolog annotation: Hit_ID=Q84VH5; Match level="QueryCoverage=100%, HitCoverage=41%, E-value=1e-120, Identity=80%"; Hit description =Envelope-like protein
MDKKIRSIVSNILKNASVPDADEDVPTSSTPDVAVPDAEKDVPTSSTPNAEVVSSPSKEEQATEETPAPRAPEPAPGDLIDLEGVESDEEPIANRLAPGIAERLQSRKGKTPIKRSGRIKTMAQKKSTPITPTKSRRSKVAIPSKKRKEISSSDSDDDVELDVSTSKRAKKSGRKVPGNVPDAPLDNISFHSIGNVDKWKYVYQRRLAVERELGRDALACKEIMDLIKAAGLLKTVTKLGDCYESLVREFIVNIPSDITNRKSDEYQKLFVRGKC

SEQ ID NO: 141281 - protein, 115 aa, Glycine max
  Coding DNA Sequence Number=SeqID_49596
  Gene Ontology: Mol. function=unspecific monooxygenase activity
  Homolog annotation: Hit_ID=Q6I666; Match level="QueryCoverage=42%, HitCoverage=61%, E-value=8e-18, Identity=91%"; Hit description =Cytochrome P450 like_TBP
  Subcellular localization annotation: CTP_CleavageSite=38; ConfidenceScore=5.24e-01
PTYPTPLKSFHKVGLESSSTGSSFPADSAKPVPLAVVSLDSRQGHGRHRGGAPIRPIVSRITIHWPSFYNVVTGKTLALPNLIALQHIPLSPAGRGGCGGYASVTATLASADVRR

SEQ ID NO: 141282 - protein, 681 aa, Glycine max
  Coding DNA Sequence Number=SeqID_49597
  Gene Ontology: Mol. function=tRNA-pseudouridine synthase activity; Cellular component=cytoplasm; Biological process=tRNA pseudouridine synthesis
  Homolog annotation: Hit_ID=Q8ZBP8; Match level="QueryCoverage=50%, HitCoverage=97%, E-value=1e-113, Identity=60%"; Hit description=tRNA pseudouridine synthase D
  Pfam annotation: Domain name=IspD; Domain location=10-221; Score =333.0; E_value=5.4e-97; Accession=PF01128.10; Description =Uncharacterized protein family UPF0007
  Pfam annotation: Domain name=TruD; Domain location=336-674; Score =486.0; E_value=4.7e-143; Accession=PF01142.9; Description=tRNA pseudouridine synthase D (TruD)
  Pfam annotation: Domain name=YgbB; Domain location=202-343; Score =223.9; E_value=3.6e-64; Accession=PF02542.7; Description=YgbB family
  Pfam module annotation: Pfam domain module=IspD::TruD::YgbB; Domain location=10-221::336-674::202-343
MNQLSSSADVIAVVPAAGIGSRMQAACPKQYLTIGPLTLLEHSVARLLAHPAVKQVVVPVSPDDGWFDSLPLAQDARVLRVTGGETRAESVLAGLQTIRHSAWVLVHDAARPCLHPDDLARLLAVREHSKVGAILAAPVRDTMKRAEPGKGAIAHTVERDDLWHALTPQFFPHALLTACLTRALNEGATITDEASALEYCGYHPELVSGRSDNIKGFIAHSDGDVALHALTDALLGAVAMGDIGKLFPDTDPAFKGADSRGLLREAWRRIQQKGYRIGNVDVTIIAQAPKMLPHVPQMRVNIAEDLGCHMDDVNVKATTTEKLGFTGRGEGRSGMSELLYLHGVPAATGVIKASPEDFVVIEDLGYPYDGEGEQLLVRIRKIGCNTRFVAEAIAKFLGVHQRDLSYAGMKDRHAVTEQTLCFRVPGTAMPNLAGFQLEGVEILQVIRHKRKLRTGALAGNAFRLVVRQVSDRAQVESRLQQIQQQGVPNYFGEQRFGRGGNNLTQARLWVEEKFRPRDRSMKGILLSAARSQLFNQLTSARLQRDGALDRVQPGDALQLSGRGSWFVAQADELPALQQRVDNHELRITAPLAGRGEPGTQGETLAFEQQQLAGAADLLGLLERERVDAARRAMLVVPKDLQWNWWDDVTLELQFWLPAGSFATSVVRELLSNGAAAPLGDE

SEQ ID NO: 141283 - protein, 874 aa, Glycine max
  Coding DNA Sequence Number=SeqID_49598
  Gene Ontology: Mol. function=transferase activity, transferring phosphorus-containing groups; Cellular component=cytoplasm; Biological process=sulfate assimilation
  Homolog annotation: Hit_ID=Q83JX8; Match level="QueryCoverage=53%, HitCoverage=97%, E-value=0.0, Identity=80%"; Hit description=Sulfate adenylyltransferase subunit 1
  Pfam annotation: Domain name=APS_kinase; Domain location=764-874; Score=210.1; E_value=5.5e-60; Accession=PF01583.11; Description =Adenylylsulphate kinase
  Pfam annotation: Domain name=GTP_EFTU; Domain location=301-513; Score= 243.3; E_value=5.5e-70; Accession=PF00009.18; Description=Elongation factor Tu GTP binding domain
  Pfam annotation: Domain name=GTP_EFTU_D2; Domain location=536-601; Score=40.1; E_value=7.8e-09; Accession=PF03144.16; Description =Elongation factor Tu domain 2
  Pfam annotation: Domain name=MMR_HSR1; Domain location=304-447; Score= 17.0; E_value=3e-05; Accession=PF01926.14; Description=GTPase of unknown function
  Pfam annotation: Domain name=PAPS_reduct; Domain location=29-257; Score=479.2; E_value=5.1e-141; Accession=PF01507.10; Description =Phosphoadenosine phosphosulfate reductase family
  Pfam module annotation: Pfam domain module=APS_kinase::GTP_EFTU::GTP _EFTU_D2::MMR_HSR1::PAPS_reduct; Domain location=764-874::301 -513::536-601::304-447::29-257
MDQNRLTHLRQLEAESIHIIREVAAEFSNPVMMYSIGKDSSVMLHLARKAFYPGTLPFPLLHVDTGWKFREMYEFRDRTVKAMGAELLVHRNPEGVAMGINPFVHGSAKHTDIMKTEGLKQALNKYGFDAAFGGARRDEEKSRAKERIYSFRDRFHRWDPKNQRPELWHNYNGQINKGESIRVFPLSNWTELDIWQYIFLENIEIVPLYLAAPRPVLERDGMLMMIDDDRINLQPGEVIKQRMVRFRTLGCWPLTGAVESEAQTLPEIIEEMLETPMNTVIAQQIAEQGGVEAWLTAQQHKSLLRFLTCGSVDDGKSTLIGRLLHDTRQIYEDQLSSLHNDSKRHGTQGEKLDLALLVDGLQAEREQGITIDVAYRYFSTEKRKFIIADTPGHEQYTRNMATGASTCDLAILLIDARKGVLDQTRRHSFIATLLGIKHLVVAINKMDLVAYSQETFEQIKQDYLDFAAQLPDDLDIRFVPMSALEGDNVATPSVTMPWYSGPTLLDVLETVELKRVVDTQPMRFPVQYVNRPNLDFRGYAGTLASGTVSVGQRVKVLPSGVESSVARIVTFDGDLQQAAAGEAITLVLNDEIDISRGDLLVDAAADLQAVQSATVDVVWMAEQPLQPGQSYEVKIAGKKARGRVEKILHQVEINTLEKRAVDSLPLNGIGLVEVTFDEPMVLDAYQQNPVTGGMIFIDRLSNVTVGAGMIHQPLSAARSQAGQYSDFELELNALVRLMAQHDENVVWHDHPVTRAEREQQHGHRGVVLWFTGLSGSGKSTVAGALEQALHRLGVSTYLLDGDNVRHGLCRDLGFSDEDRKENIRRVGEVAKLMVDAGLVVLTAFISPHRAERQMVRDLLGDGQFIEVFVDTPLA

SEQ ID NO: 141284 - protein, 300 aa, Glycine max
  Coding DNA Sequence Number=SeqID_49599
  Gene Ontology: Mol. function=glucarate dehydratase activity; Biological process=metabolic process
  Homolog annotation: Hit_ID=P0AES3; Match level="QueryCoverage=100%, HitCoverage=67%, E-value=1e-153, Identity=84%"; Hit description =Glucarate dehydratase
  Pfam annotation: Domain name=MR_MLE; Domain location=39-139; Score =82.0; E_value=1.9e-21; Accession=PF01188.12; Description=Mandelate racemase  muconate lactonizing enzyme, C-terminal domain
MLGYLLYVGDRRKTSLPYQSQTDDPCDWYRLRHEEALTPDAVVRLAEAAYEKYGFNDFKLKGGVLRGGEEAEAVTALAKRFPQARVTLDPNGAWSLNEAILLGKQLKGVLAYAEDPCGAEQGYSGREVMAEFRRATGLPTATNMIATDWRQMGHTLSLQSVDIPLADPHFWTMQGSVRVAQMCHDFGLTWGSHSNNHFDVSLAMFTHVAAAAPGAITAIDTHWIWQEGNQRLTKEPLQIKGGMVQVPQKPGLGVELDMDQVMQAHALYQQHGLGARDDAQAMQFLVPNWTFDNKRPCLVR

SEQ ID NO: 141285 - protein, 179 aa, Glycine max
  Coding DNA Sequence Number=SeqID_49600
  Gene Ontology: Mol. function=galactarate dehydratase activity
  Homolog annotation: Hit_ID=Q6D170; Match level="QueryCoverage=59%, HitCoverage=20%, E-value=3e-47, Identity=88%"; Hit description=D -galactarate dehydratase
  Pfam annotation: Domain name=GD_AH_C; Domain location=1-178; Score= -146.9; E_value=5.5e-06; Accession=PF04295.4; Description=D -galactarate dehydratase  Altronate hydrolase, C terminus
  Subcellular localization annotation: CTP_CleavageSite=40; ConfidenceScore=5.04e-01
RQRETAGVSAGVGTQCGGSDAFSGVTANPAVGFASDLLVRCGATVMFSEVTEVRDAIHLLTPRVVNEAVGKRLLEEMAWYDDYLSQGQTDRSANPSPGNKKGGLANVPDCRSAVTRTAPDAARADLRRHAGQRFCLWHPADGFRHYAAGVYHRARHALRPGGNSGDQDGDAQRAGEPLA

SEQ ID NO: 141286 - protein, 124 aa, Glycine max
  Coding DNA Sequence Number=SeqID_49601
WTPYDLSVTDLVLCLPLALDLVAYWSAMCRRQHSNLFADELRDAVLLDESSISRGPDALAGELDNSKTLLDFFGSTGCLAGGYGHPVGLIEARNQSWKPQGPVGLFRVHWGVIGIAVAGQNVAK

SEQ ID NO: 141287 - protein, 146 aa, Glycine max
  Coding DNA Sequence Number=SeqID_49602
  Homolog annotation: Hit_ID=Q6UUU1; Match level="QueryCoverage=58%, HitCoverage=55%, E-value=7e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVLLSVTGCHSAVWRVCLIPRLTLSS

SEQ ID NO: 141288 - protein, 105 aa, Glycine max
  Coding DNA Sequence Number=SeqID_49603
  Gene Ontology: Mol. function=protein serine/threonine kinase activity; Cellular component=integral to membrane; Biological process=protein amino acid phosphorylation
  Homolog annotation: Hit_ID=A3B2K8; Match level="QueryCoverage=92%, HitCoverage=15%, E-value=5e-15, Identity=42%"; Hit description =Putative uncharacterized protein
MAQGLCCYLSLKEMKQATNNFDEPNVIGVGGFGKVYKGVIDNGFKVAIKDRIRNQGHVSTPLKGSFGYLDPEYFRRHQLTKKSDVYSFGVVLSEALYLRKVALDT

SEQ ID NO: 141289 - protein, 140 aa, Glycine max
  Coding DNA Sequence Number=SeqID_49604
MVPAGEVCIVLGQCASDYMDWFFHISHTFMTSGHASDPLLDVHALQPQVVPQALQTDISHVPEPGAPSTSARPAVEEPRHAVEVCHGIAERLERHLSLGVVTSGSSTHEVIEECLRMVRSVTQDQVVYVRSRRKRRTDQT

SEQ ID NO: 141290 - protein, 72 aa, Glycine max
  Coding DNA Sequence Number=SeqID_49605
MARVAQGGVEFYPPIPVEGLGTATLWSQAPATSQTHYICLVNIIRRLSSRRPRKEGTRSPFEESESCEGTLR

SEQ ID NO: 141291 - protein, 194 aa, Glycine max
  Coding DNA Sequence Number=SeqID_49606
  Homolog annotation: Hit_ID=Q6UUU1; Match level="QueryCoverage=30%, HitCoverage=40%, E-value=2e-18, Identity=78%"; Hit description =Putative uncharacterized protein
RVPFAIQAAQLLGRAIGAGLFAITPAGERGMCCKAIKLDIKGTPETGLQIPGFHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141292 - protein, 356 aa, Glycine max
  Coding DNA Sequence Number=SeqID_49607
  Pfam annotation: Domain name=zf-CCHC; Domain location=132-149; Score =13.0; E_value=0.017; Accession=PF00098.14; Description=Zinc knuckle
MKREKLVSYSSHNSCKSLSEELRDYYEGRHRSHLRPHSRRRENERKPQEVNIELPYFHGKDNVEANLDWEIRVEQQLKRKSTSKSYGSHSSPKKDQGQGILGVRPSKPKDDKGKTIEKQPLKASMQEKTSSMKCFKCLGRVHIISQCPTKKTMIMRGQDIYSSQDEATTSPSSSKSEEAKWEESSEEICPQEEGQPLMVKEECKEVSVSSKRLAKKERHFEIKTNIKEISLLRQPPHFLLCKKTLVSIATSLRLEFIPQVKELLDEGLVRKRLNPCALLVPKIGIIRHQIPKIGGVMNALGGATLFCKITRAPNIFMICVHRDSLGRNNQHENTEKGVPMNPKRIKVIPEWPAPPS

SEQ ID NO: 141293 - protein, 269 aa, Glycine max
  Coding DNA Sequence Number=SeqID_49608
  Gene Ontology: Mol. function=transporter activity; Cellular component= integral to membrane; Biological process=transport
  Homolog annotation: Hit_ID=A0NM47; Match level="QueryCoverage=43%, HitCoverage=41%, E-value=1e-48, Identity=77%"; Hit description =Binding-protein-dependent transport systems inner membrane component
  Pfam annotation: Domain name=BPD_transp_1; Domain location=20-264; Score=2.8; E_value=0.0054; Accession=PF00528.13; Description=Binding- protein-dependent transport s
SIPKDLYEAAAIDGASGWQQFRRVTLPFLAPMIAITVMLRTIWIANFADLIVVMTDGGPAGSTSILSSYIFTTAYRKLDFGYASAMAGVTLLPGGFTLSHFAKHCRADHLDCCGCRLCLFPLSVSRQDGDGGPAAVYADVSAGDDHCADLPVIFDAIPKDLEESAMLEGCTRFQALYRVLMPLTLPGMAATLGFVFTAAWSELLFSLMLINKNEVMTFPVGLLSFVSKFAVSWGEMMAAAVLALIPACLFFAFIQRYLVQGLTAGAVKG

SEQ ID NO: 141294 - protein, 95 aa, Glycine max
  Coding DNA Sequence Number=SeqID_49609
TKEVKVIGQTLNTFLAWPTHLVKRLSEQGVVGPTNPADRPDHEVDDPLYLMTLTIPQLFLKPLQVMWDATLFGLFNEDFPLYIKHEDLSEITQGG

SEQ ID NO: 141295 - protein, 82 aa, Glycine max
  Coding DNA Sequence Number=SeqID_49610
MGAKYLEVSNEGRIPTTNGPGTKFGYDSCPSYLSFIGDKREYRHIISILSNLFLSVDTRRRTTMICLRVLLDTIEPGRQDTE

SEQ ID NO: 141296 - protein, 91 aa, Glycine max
  Coding DNA Sequence Number=SeqID_49611
  Gene Ontology: Mol. function=chloramphenicol O-acetyltransferase activity; Biological process=response to antibiotic
  Homolog annotation: Hit_ID=P62577; Match level="QueryCoverage=98%, HitCoverage=47%, E-value=1e-36, Identity=73%"; Hit description =Chloramphenicol acetyltransferase
  Pfam annotation: Domain name=CAT; Domain location=6-90; Score=-18.1; E_value=9.4e-12; Accession=PF00302.9; Description=Chloramphenicol acetyltransferase
MEKKITGYTTVDISQWHRKRTFLRHFSQLLNTVKKNKHKFYPAFIHILARLMNAHPEFRMAMKDGELVIWDSVHPCYTVFHEQTERFIALE

SEQ ID NO: 141297 - protein, 129 aa, Glycine max
  Coding DNA Sequence Number=SeqID_49612
MEALVSCCNCIFWMVICLTNSSKEVEEEPQLLVIFVQTAANVAALEEEHMACSDQQHSEKKGQSVVVVMEDLSISDLDDSSNLDCICCLKDHNYSVVVGFATEEIAARKDIDLYGDLQKNIDHRLLQHV

SEQ ID NO: 141298 - protein, 27 aa, Glycine max
  Coding DNA Sequence Number=SeqID_49613
MGFTLLHMRGQTSNIVLLGTKSLKWVA

SEQ ID NO: 141299 - protein, 85 aa, Glycine max
  Coding DNA Sequence Number=SeqID_49614
MAQPPPRERTLREMVAPDFTYESLCIQYPDEDVPYILKTGLIHFLPKFHGLAGGSHIYEGLSTFFRGSGKGPAILPCSKVHHELG

SEQ ID NO: 141300 - protein, 128 aa, Glycine max
  Coding DNA Sequence Number=SeqID_49615
MAVPKLEKMQRQAETNKKQRRTMSKGSSQCGVATANNDGLWWLMVVVGDGESAWDVRNGFGRKKEEEMVFFLSYTKARAENAQVRNGLGHGNITHTPDIFSKIPTAAHVASSRSFIKRLPQEASLWLV

SEQ ID NO: 141301 - protein, 125 aa, Glycine max
  Coding DNA Sequence Number=SeqID_49616
TRLVKEKLKVVVTRVRKEYDELKDINMTTTEALERETKKARKEEWSRNKFRGALWGSSNELKLRKAERDKSRMECMVLEDKLKSCQREAMKWMDRFALTLNQELPRLLAKAKAVANTYSAPDEVH

SEQ ID NO: 141302 - protein, 111 aa, Glycine max
  Coding DNA Sequence Number=SeqID_49617
MAYERGGDFLEDARKILNREAFPPGGSLVRSPVPAFRFTGVIPLLWPRLSHSTPDTQFRVGSSLQLDCMHEPPVQSDRCALSGTIVLSPPGRMQSTTGAALVLIKDYLDLR

SEQ ID NO: 141303 - protein, 101 aa, Glycine max
  Coding DNA Sequence Number=SeqID_49618
  Subcellular localization annotation: CTP_CleavageSite=57; ConfidenceScore=5.61e-01
TDGVVRNGKSTARTSALASVAVTLRVTTTPAALNAPLQGASHSPFRLRNCWEGRSVRASSLLRQLAKGGCAARRLSWIETGHGGLCLATHGGWFPWGKKRA

SEQ ID NO: 141304 - protein, 208 aa, Glycine max
  Coding DNA Sequence Number=SeqID_49619
  Homolog annotation: Hit_ID=Q2HW90; Match level="QueryCoverage=79%, HitCoverage=36%, E-value=4e-20, Identity=30%"; Hit description =Putative uncharacterized protein
MVEVSTKAIASLAQYYDQPLRCFTFGDFQLSPMVEEFEEILGCPLGGRKPYLFTGFYPSLARISKIVQISVQELDHRKQVENGVVGIPRKYLETKARILAGVLFPNVDGLVDLAAINVFLAYHNHKESSIVAMLADLYDTFDRRCEKSNTRIVCCTPALYVWLVSHLFRQEVRHACPLESHCSCTEKGGANWDQLLASKEGASVNWFS

SEQ ID NO: 141305 - protein, 58 aa, Glycine max
  Coding DNA Sequence Number=SeqID_49620
MARRDKLWSFCALLSSRGGEPDDMQRQIMAASPMTCGDTIMVIRAFRQSRGMNSAVSG

SEQ ID NO: 141306 - protein, 295 aa, Glycine max
  Coding DNA Sequence Number=SeqID_49621
MRSTLSHRKSHRRKMQHALSRHLALSVLMHLSERAKRVPMALSAWLPANAEPCPHPGKRPTGTLPVSHPRLLGINSRITFISRTFFWKGMSSSHPGCLMNSSRSSRGVVRFDAETINDFLDTPVVLVDGEEYPTYSQYLRTPPDHDDILSTLCTPWGRFVLNVDDAPWKLLRKDLTTLAQTWSVLSYFKLAPTSHTSDINVDRARLIYGLVMKMDLDVGSFISQQISQIAQSSTSRLGFPALIRVPCDIQGGPADPSITFPSGAATKDPAVDEDLIADFARVDWGPWADLGGGST

SEQ ID NO: 141307 - protein, 127 aa, Glycine max
  Coding DNA Sequence Number=SeqID_49622
GESWNLLRADQRIIFAKSWPRASRYQQGHQDLFILRSDLPSQHRRTSALASVAVTLRVTTTPAALNAPLQGASHSPFRLRNCWEGRSVRASSLLRQLAKGGCAARRLSWVTPGFSQSRRCKTTASEL

SEQ ID NO: 141308 - protein, 137 aa, Glycine max
  Coding DNA Sequence Number=SeqID_49623
MDLGISRSCGSAPSQEIEPIFGPCDLCPEPIWSRARKRSETLALQTEAELVETVMGLHMHPVVGRLLANQMPGASGACGAPPCACLNVQYFSMKARVIGGRITLLGVTRTLNDWQRPVINAGKPRALLDLSGSRKCL

SEQ ID NO: 141309 - protein, 189 aa, Glycine max
  Coding DNA Sequence Number=SeqID_49624
  Homolog annotation: Hit_ID=Q6WAY4; Match level="QueryCoverage=82%, HitCoverage=28%, E-value=2e-18, Identity=34%"; Hit description =Putative uncharacterized protein
GSRKACITFLNAYMGHRAAKCCRFYQVKIKGLEVASLRELGQLMGQLQHQAFCKAYGKIWDLATVEVFVEAIASLTKYYDQPLRCFTFRDFQLVPTMEEFEEILGCSLGERKPYLFLGFYPFMERVAKVVKISVQELDRVKQNRNGVVGIPRKHLEGKAKALADQGEWVPFINTFALLIFGVVLFPNME

SEQ ID NO: 141310 - protein, 26 aa, Glycine max
  Coding DNA Sequence Number=SeqID_49625
MVSGASAASVKFPKTLAFFSSVFNVL

SEQ ID NO: 141311 - protein, 103 aa, Glycine max
  Coding DNA Sequence Number=SeqID_49626
MTTQLIHDRVVMECLKGVWETLKGNERCRFRGTIRLTATLLDLEEDPEELPPEPAMDALDLPEDDEDPLPNVDSPEDIMSASEADSTEESGPGGRAISDDSSS

SEQ ID NO: 141312 - protein, 116 aa, Glycine max
  Coding DNA Sequence Number=SeqID_49627
MGRSSTRQFPSWKPGGHGCTKSNLLGESSLHIVVNCPSRLKPTLTKLLLLWYNGTSLACGPDHGPWPLFFLSETFLLTSAYVGVRPYLYWEVDLSPYLSVAAVEGTNHHGTRPQVV

SEQ ID NO: 141313 - protein, 60 aa, Glycine max
  Coding DNA Sequence Number=SeqID_49628
MVIALDGAHVRYVGCCVCSWGVECTYLVEWPIRGGQACVCSWGVECTDLVGWPIRGGQAW

SEQ ID NO: 141314 - protein, 85 aa, Glycine max
  Coding DNA Sequence Number=SeqID_49629
MEKSENKNIGEKKAKKAYITWDDNDLESSNDSEKEVINLCLMGKNYESDEEVTSSNKSISFDELQDAFAELHSESIKLTKLVSSS

SEQ ID NO: 141315 - protein, 277 aa, Glycine max
  Coding DNA Sequence Number=SeqID_49630
  Homolog annotation: Hit_ID=Q652R5; Match level="QueryCoverage=32%, HitCoverage=36%, E-value=1e-16, Identity=53%"; Hit description =Putative uncharacterized protein P0603C10.50
  Subcellular localization annotation: CTP_CleavageSite=79; ConfidenceScore=5.43e-01
MTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFFMVGFFPRVAPPDLRSRWERACTQRVVDGSRTDRLARDWSRAWLIHHFITAKSAMNPDFNQPRGGRALGLMASGATCVQRLDGSRDSAIHTKYRISLRSSSMQEPRYPLPRVIDEEAGRTGRRGHPLPPD

SEQ ID NO: 141316 - protein, 61 aa, Glycine max
  Coding DNA Sequence Number=SeqID_49631
MDDLNSTRTDVEQPRGFVRPNSSRHAPQGADYRNHNRVPTQQGYRKGGIDKTLFVKQDVKT

SEQ ID NO: 141317 - protein, 36 aa, Glycine max
  Coding DNA Sequence Number=SeqID_49632
MDDDLCWFLSCGSFLLEAPNTLPMKGLFVTKLESNE

SEQ ID NO: 141318 - protein, 136 aa, Glycine max
  Coding DNA Sequence Number=SeqID_49633
MSRGSPSSQEIEQFCHLLFHAGLLCIGGGSYRRLPCMGLGPISGPCDLSPKLLWSSDASSIGACRPRIFFINGFLCFLEDKWQRNGERKRERRRHFKEKMSLEEAHHHRRPWIRAWRKKEMNEGRGREENEILCSK

SEQ ID NO: 141319 - protein, 31 aa, Glycine max
  Coding DNA Sequence Number=SeqID_49634
MTSIACYKLERRGGFQVLSPKAYKSVLSSSP

SEQ ID NO: 141320 - protein, 134 aa, Glycine max
  Coding DNA Sequence Number=SeqID_49635
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=38%, HitCoverage=50%, E-value=4e-24, Identity=100%"; Hit description=LacZ protein
WRDSFHVVQDQRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGCGGIRALTARLASADVRRCFCRYAPP

SEQ ID NO: 141321 - protein, 149 aa, Glycine max
  Coding DNA Sequence Number=SeqID_49636
MIPYKSITRLGLYFQNIIEVPSVYHKQWAPDYPNYVVLDYNGKKHHIRVRKFSNRVYIADGLKHFRRDMGIYEGDEYVTVLGVRGHRHFWKLSMHNGLQCFAEPWFQFLTENDLMAGDEVVFYFRPNQLLWEVIARKQTVWDEDEDDSP

SEQ ID NO: 141322 - protein, 125 aa, Glycine max
  Coding DNA Sequence Number=SeqID_49637
MGEAWEVQEKMKAEMEAMKEQMATMMEAMMSMKKIMEGNAVMVAATSAVAKVNPMLPPGLKQMNHPTSNMVGKDLGSTDDPMMCKFKTSTPSRHMACLPNYTPPNMAYTLNENLNNSTPILIENQ

SEQ ID NO: 141323 - protein, 65 aa, Glycine max
  Coding DNA Sequence Number=SeqID_49638
MTIRGGDGGTASSSSEEGGFTTGDCGLCMIMNCPQNKLCSIGTKRHVLQLLTEEMERMTKGCPQL

SEQ ID NO: 141324 - protein, 77 aa, Glycine max
  Coding DNA Sequence Number=SeqID_49639
MDKSLKVGEDEWRERERRITKFCASKEISGLILKAHENPRAFSCISGPIFLESFIQCPWWIGLHHSLPLEKDWTSNP

SEQ ID NO: 141325 - protein, 150 aa, Glycine max
  Coding DNA Sequence Number=SeqID_49640
NLRPVRKPFPLAAVERPSVCESVSEEAEYILKPYYNSLRVLQRRAETLALDRNLMRLAAHPPFRQLESEEARTDRPSQCELASADGNGTRPRRIMLPAGMLCGIVQRTATLASADVRQGLCHDYAKLEITPSVAKGNKSHWYRAPPIEVD

SEQ ID NO: 141326 - protein, 106 aa, Glycine max
  Coding DNA Sequence Number=SeqID_49641
MCMIRLRLLALNEYGSGVIDILIGNVCHIGWCIVGRPAIWWEGILVLNLRIMGGPPILPKSLPAICSFMAFMSAFICSCTFSTSPIILALAQERMQWAMQPMKSMD

SEQ ID NO: 141327 - protein, 377 aa, Glycine max
  Coding DNA Sequence Number=SeqID_49642
  Gene Ontology: Mol. function=transferase activity, transferring pentosyl groups; Cellular component=peptidoglycan-based cell wall; Biological process=peptidoglycan-based cell wall biogenesis
  Homolog annotation: Hit_ID=P02918; Match level="QueryCoverage=99%, HitCoverage=44%, E-value=1e-174, Identity=79%"; Hit description =Penicillin-binding protein 1A (PBP-1a) (PBP1a) [Includes: Penicillin- insensitive ...
  Homolog annotation: Hit description=transglycosylase (EC 2.4.2.-) (Peptidoglycan TGase); Penicillin-sensitive transpeptidase (EC 3.4. -.-) (DD-transpeptidase)]
  Pfam annotation: Domain name=Transpeptidase; Domain location=1-308; Score=28.0; E_value=1.9e-07; Accession=PF00905.13; Description =Penicillin binding protein transpeptidase domain
MFNRATQALRQVGSNIKPFLYTAAMDRGLTLASILNDVPISRWDAGAGADWRPKNSPPTYAGPIRLRQGLGESKNVVMVRAMRAMGVDYAAEYLQRFGFPAQNIIHTESLALGAASFTPMQVARGYAVMANGGFLVDPYFIAKIENEQGGVIFQAQPKIACPQCNLPVIYGDTKKSVALNEESVENVATSNQQQNQTVPQPELEQVPAQPQPAGDQQYAPHVINTPLAFLIKSALNSNIFGEPGWMGTGWRAGRDLKRNDIGGKTGTTNSSKDAWFSGYGPGVVTSVWIGFDDSRALGRTTVSGAIPDQISGYEGGAKSAQPAWDDYMKVALDGVPVQPLTPPDGVVTVTIDRSTGKLANGGGNTRQEYFINGTQPP

SEQ ID NO: 141328 - protein, 227 aa, Glycine max
  Coding DNA Sequence Number=SeqID_49643
  Gene Ontology: Mol. function=sugar:hydrogen symporter activity; Cellular component=periplasmic space; Biological process =carbohydrate transport
  Homolog annotation: Hit_ID=A9M737; Match level="QueryCoverage=68%, HitCoverage=47%, E-value=2e-82, Identity=96%"; Hit description =Rhizopine-binding protein
MEAKDVLAKIGCKGKCGYKKALAECPDVNVLEDQTANWSRAEAQTLMENWLTAHPGQIKGVIGQNDEMALGAIEAIKAANLKVSDFAIAGIDGITDALHAVKEGTMTSILQDANAQAQGALDLAIFHAKKGEYKPQSDIWAQYPDMPFNDGKNKNYNVPWTPVTAQNVDKLLESRKSRCLGGPATYRESHDRDAGPPGSQTRLPRHKMSDQAPQIDLNFPLSGKIAI

SEQ ID NO: 141329 - protein, 216 aa, Glycine max
  Coding DNA Sequence Number=SeqID_49644
  Homolog annotation: Hit_ID=Q6UUU1; Match level="QueryCoverage=27%, HitCoverage=40%, E-value=2e-18, Identity=78%"; Hit description =Putative uncharacterized protein
RVPFAIQAAQLLGRAIGAGLFAITPAGERGMCCKAIKLGNARVFPVTTLNSMLTKALENCRLAKFCKMRKTGKLFDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141330 - protein, 94 aa, Glycine max
  Coding DNA Sequence Number=SeqID_49645
LQDVQFVVELMNLDVVSLMKSKLHMKLTIWGINPKAISIQVDFQDFRTTSSINSRDNNKITLVSNSIETRVVHLQGHNSRCQVSMTKPRSWKRL

SEQ ID NO: 141331 - protein, 143 aa, Glycine max
  Coding DNA Sequence Number=SeqID_49646
  Homolog annotation: Hit_ID=O52175; Match level="QueryCoverage=57%, HitCoverage=94%, E-value=1e-32, Identity=85%"; Hit description =Salmonella berta plasmid pBERT, complete plasmid sequence
MAYERGGDFLEDARKILNREVRGPRQSRFSIGSAPLTSITKSDAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCAGRLN

SEQ ID NO: 141332 - protein, 88 aa, Glycine max
  Coding DNA Sequence Number=SeqID_49647
METLQKELRGSNNGPIGGYRKWLKAHVQGLDWIPSLRTAKREEVEAPEEDEEVQALRTELEQAQTVKERLKSAALKIRKENAELRDIN

SEQ ID NO: 141333 - protein, 85 aa, Glycine max
  Coding DNA Sequence Number=SeqID_49648
MLLWCFALRLPGGTVLLDESSISRGPDALAGGDRVVMLVRMIRTRLFAAARVKSCPGMHSRCVIASLSECARTVGRPPYQGVPRN

SEQ ID NO: 141334 - protein, 208 aa, Glycine max
  Coding DNA Sequence Number=SeqID_49649
  Homolog annotation: Hit_ID=Q6WAY6; Match level="QueryCoverage=47%, HitCoverage=17%, E-value=6e-11, Identity=38%"; Hit description =Putative uncharacterized protein
MELASGVLFSCGSYPNILLIGTRGCINYNPVLAIRQLGYPMRGAPTEESLSPFLVRDFGVQNFKVIQRVHKAWGSPLRKDKELGGIRNGIIGGYHEWLKVRTRGLDWLAKLKIINEENFEAPEEDEEVRALKTELGKARLVKEKFKLVATEVRKECAGLQEENPATARALEQETKRARKEEHGRDKFRGALWGSNSELKLRREERDRS

SEQ ID NO: 141335 - protein, 53 aa, Glycine max
  Coding DNA Sequence Number=SeqID_49650
MVNESEIIDFRRQVLWAVGKRKGFGEEKRENENEGKKMHRQSKTDLTSLFIPR

SEQ ID NO: 141336 - protein, 74 aa, Glycine max
  Coding DNA Sequence Number=SeqID_49651
MRSFNGDFPPWRCSGRQRRRGERRCHPIGKEEIHHQECVLDKKLGEDASMEEKKETEKEKGKSTKLKEEKGERI

SEQ ID NO: 141337 - protein, 230 aa, Glycine max
  Coding DNA Sequence Number=SeqID_49652
  Homolog annotation: Hit_ID=Q6WAY4; Match level="QueryCoverage=88%, HitCoverage=36%, E-value=8e-23, Identity=34%"; Hit description =Putative uncharacterized protein
MGSSQVPSLKKRFYQVKVKSLGITSLKELGQLMGQLQRQAFRKAYGKIWDLAMAEVSTEAVASLAQYYDQPLRCFTFGDFQLSPMVEEFEEILGCPLGGRKPYLFSGFYPSLARISKIVQISAQELDNRKQVENGVVGVPRKCLEAKARILAGRGEWAPFIDILALLIFGGVLFPNVDGLVDLAAIDAFLAFHDRKESPVVAILADLYDTFDRRCEKSSTRIVLLYSGPS

SEQ ID NO: 141338 - protein, 88 aa, Glycine max
  Coding DNA Sequence Number=SeqID_49653
MKSDKASQDIHSISQACSELQNKERETRLKRAIKGINSRTHQQESSQGYCASNQWGKTHQMIIMMDGSNSHKGKIITFKLSFQNYHDM

SEQ ID NO: 141339 - protein, 151 aa, Glycine max
  Coding DNA Sequence Number=SeqID_49654
MVIDQSFLFELTQLSSDGVPFEGTLDDEWKFDFSISDTRRMVCTNQSDMTGRLLAGSLAFECRIMHYLIVRILLPRSSYLAHVSEEDLIIMWVFLTGRTSTSRRRPFSITTSQRDDSSSLMHNILDRLDGLHTFFGERFDSLDTALMPLMH

SEQ ID NO: 141340 - protein, 168 aa, Glycine max
  Coding DNA Sequence Number=SeqID_49655
  Gene Ontology: Biological process=transposition, DNA-mediated
  Homolog annotation: Hit_ID=Q1J7G7; Match level="QueryCoverage=26%, HitCoverage=75%, E-value=1e-11, Identity=66%"; Hit description =Transposase
GIFEVFQWLQFISAVPPVQLLTGWCVTAKAPPVISAGKCSGRVPFAIQAAQLLGRAIGAGLFAITPAGERGMCCKAIKLGNARVFPVTTLKQPAREKDEVQKTQQVCSSIFSCLLYIKLIDTVDLEGGPVGKPVVPAALMNQPTRGERRFAYWALAECILSYYVGLDE

SEQ ID NO: 141341 - protein, 26 aa, Glycine max
  Coding DNA Sequence Number=SeqID_49656
MGPDSVMDGRGPIEQQLNHGPKIWKL

SEQ ID NO: 141342 - protein, 150 aa, Glycine max
  Coding DNA Sequence Number=SeqID_49657
MRGVPSDESIMPFIARGFSDHNARDRELRGSSNGIIDDYHKWLRVRTQGLDWLPNLKTMRDDEVKAAEESDEVQALKAELERAWVVEEKFKSIAIKGSNSELKLRRGETEGNMWAIIDECKEKLNLAATHEQRLEDEYAKISAEREARER

SEQ ID NO: 141343 - protein, 369 aa, Glycine max
  Coding DNA Sequence Number=SeqID_49658
VDSRGSPLRGIRNGIIGGYHEWLKVRTRGLDWLPSLRTAKRGEVEAPEEDEEVQALRTELEQAQTVKERFKSVVLWIRKENAELRDVNVATTKALEQETKRARREEHGRNKFRVALWGSNNELKLRREERDQSWVDSLILKDELKVARETNMLAIISKYQEELSLATAHEHRVADEYAQVYAEKEARGRVINSLHQEATKWMDRFALTLNGSQELPRLLAKAKAMADTKRATRHPYRTRSKSRTMGDQEETQEQMKANMSALKEQMASMMEAMLGMRQLIEKNKATAAAVSSATEADPTLLATAHHLPPNTVGRGRNTLGHNSNPHLGYNRAAYPYGLPPNYTPPVMQDDAGHISSPILEGEPPRQPDE

SEQ ID NO: 141344 - protein, 116 aa, Glycine max
  Coding DNA Sequence Number=SeqID_49659
MTLLLSNILPSDRNANLPLQKYQLVCVVPTWGSHPQDTQWTRKSPTGPWGFQLWLRASISPIGCPYPPRQGYVIIGKVPVTSSKGIRPPTDRAFIKKYCVPRQAQGETPQQHWDGR

SEQ ID NO: 141345 - protein, 153 aa, Glycine max
  Coding DNA Sequence Number=SeqID_49660
  Subcellular localization annotation: CTP_CleavageSite=33; ConfidenceScore=5.04e-01
MAKSSKKQKGSSCTTTAAGHCHQGTSGDPPTPRQRYYSQFCNRVILDPKYLDLEFFDEETFDCYQEFQNSALIDFMTLKLPYFPNLVKVFYNNLKIQDGILYSEVHNIPIAIDQPLFYSLTKLPSQGVPFEGILVDDWKFDYSSHDACRMVSQ

SEQ ID NO: 141346 - protein, 137 aa, Glycine max
  Coding DNA Sequence Number=SeqID_49661
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=37%, HitCoverage=50%, E-value=4e-24, Identity=100%"; Hit description=LacZ protein
MGETGLCCFVVAGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141347 - protein, 140 aa, Glycine max
  Coding DNA Sequence Number=SeqID_49662
  Subcellular localization annotation: CTP_CleavageSite=32; ConfidenceScore=5.03e-01
MVEPSKKHKGSSSQSQWHSKTQETPIPSSIPSASLFSSEEQRIWYINLFSSRSIIDPKFIDMDFFSNESFECIQAFENSNLIPFMSLKLPVYSDLVKAFYSNLEIQEGTLISEVYGIKMVIDQSLFYDLTQLSSEGVPFE

SEQ ID NO: 141348 - protein, 135 aa, Glycine max
  Coding DNA Sequence Number=SeqID_49663
MQRRSNAGDLISIDLEINATCRRRNIERIINFLQDLEAAATPKEEPRSSEASSSFPIPVKSHTDLIEEVIMAEEPRRVTLEDYSSSSVPQFFTSIAQPEVQAQTITYPPSLIQLVQNNLFHGLPMKTHKHTWHLH

SEQ ID NO: 141349 - protein, 225 aa, Glycine max
  Coding DNA Sequence Number=SeqID_49664
  Gene Ontology: Mol. function=transferase activity, transferring glycosyl groups; Cellular component=1-2nm peptidoglycan-based cell wall; Biological process=enterobacterial common antigen biosynthetic process
  Homolog annotation: Hit_ID=A6TGI1; Match level="QueryCoverage=100%, HitCoverage=62%, E-value=1e-118, Identity=90%"; Hit description=TDP -Fuc4NAc:lipidIIFuc4NAc transferase
  Pfam annotation: Domain name=Fuc4NAc_transf; Domain location=1-225; Score=322.9; E_value=5.8e-94; Accession=PF07429.2; Description=4 -alpha-L-fucosyltransferase (Fuc4NAc
MTALIHVLGSDIPHHNQTVLRFFNDELAADARARTFMVVGDATGMREAYPALEITCYPGKKSLAQAVIAKAKADRQQRFFFHGQFNTGLWLALLSGGIRPSQFNWHIWGADLYENSASLKFRLFYPLRLMAQGRVGRVFATRGDLSWFANRHPRVPGELLYFPTRMDPSLNSLADTAPRGDTLTILVGNSGDRSNEHIAALRAIHQQFGDTVNVIVPMGYPANNE

SEQ ID NO: 141350 - protein, 83 aa, Glycine max
  Coding DNA Sequence Number=SeqID_49665
MIIRGQDIYSSQEETTSSPSSSGSEDEVRGEESSEEVYPHEEGDLLMVRRILGGSEGKSSLQSPEWPVHNSIRSHFFLTTHNL

SEQ ID NO: 141351 - protein, 232 aa, Glycine max
  Coding DNA Sequence Number=SeqID_49666
  Gene Ontology: Mol. function=chloramphenicol O-acetyltransferase activity; Biological process=response to antibiotic
  Homolog annotation: Hit_ID=P62577; Match level="QueryCoverage=93%, HitCoverage=99%, E-value=1e-130, Identity=99%"; Hit description =Chloramphenicol acetyltransferase
  Pfam annotation: Domain name=CAT; Domain location=6-209; Score=528.7; E_value=6.6e-156; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQAGRNFFKAVMVPRIFI

SEQ ID NO: 141352 - protein, 85 aa, Glycine max
  Coding DNA Sequence Number=SeqID_49667
EEEEEESDDEEDFSLFVKKFHKFIKNRIMERSHNFNNGKRSQEVSPTLKCYKCNQTDDNDSSDGSEKEINLLSKDYESDENISQE

SEQ ID NO: 141353 - protein, 98 aa, Glycine max
  Coding DNA Sequence Number=SeqID_49668
  Subcellular localization annotation: CTP_CleavageSite=37; ConfidenceScore=5.28e-01
MFAHSIKGCRPLGRTCGVLIPSPSRLFRFFRRFPQINVGGDSARIPFVEHASRESRVALPPKGVQEKSPEFQEPRGFEVKSFSRGEGMMQSYPAKDIG

SEQ ID NO: 141354 - protein, 68 aa, Glycine max
  Coding DNA Sequence Number=SeqID_49669
MSQNFTDCLTMGVKFLEVVKKRLHAIKQWPSCEDGSTPGNGASADAGTDKSAKAGSRAEVEDVGMPTI

SEQ ID NO: 141355 - protein, 147 aa, Glycine max
  Coding DNA Sequence Number=SeqID_49670
  Subcellular localization annotation: CTP_CleavageSite=71; ConfidenceScore=5.25e-01
MNCVFVHVSSTFEFGAMRSDCLVQFSILNLFRSPMNWVFVRVPSIFEFGAMRRDCLVQFSILTFRSPMNCVFVHVSSTFEFGAMRSDCLVQFSILNLFGAHELFFVHVSLHFEFGAMCSDCLAQFSILTLFEAQECAFSFGCLPPPI

SEQ ID NO: 141356 - protein, 307 aa, Glycine max
  Coding DNA Sequence Number=SeqID_49671
  Homolog annotation: Hit_ID=Q2HW90; Match level="QueryCoverage=50%, HitCoverage=28%, E-value=6e-18, Identity=36%"; Hit description =Putative uncharacterized protein
IPVLFPNVDGLVDLAAIDAFLAYHHSKESPVVAILADLFDTFDRRCEKNSAQIVYCLPALCVWLVSHLFQQDIRHPCPLQIYRSCVEKRRVDWDQYLAEIGGNTINWFPRWKEGKEGVLFSCGDYPNVPLIGTRGCINYNPALVIRQLGYPMRGAPTEESLSHFLVRDFGVQSFKIVHRVHKAVHTRGLDWLSKLKIINVENFEAPEEDEEVQALKLELGKARLAKEKFKKMRLPQEPSNEKLRGLARKAEINSEELCGAATMSLSSRERKETSHKYMACTNQSLTHEQKLVEDFAQAYAEKEARGR

SEQ ID NO: 141357 - protein, 106 aa, Glycine max
  Coding DNA Sequence Number=SeqID_49672
MGESLTEQCRVKVEGLRVMNFFSRRRSNDAAAVRQRMQALSGMIGRKASVGGFLSSPSNPRAQPWTGGGKLPSWSTVGAEGISGGAVKCVEIGKNTNGESTLLGRH

SEQ ID NO: 141358 - protein, 96 aa, Glycine max
  Coding DNA Sequence Number=SeqID_49673
GEFDDMRGYLMVIHTFCHPEMASSITCTDDESNDIWGYLMVIRTFCQPEASKPVDTQRPTDDKSDDMRGFYFLHPETFKPDNAQDSSLLGGDDRTR

SEQ ID NO: 141359 - protein, 147 aa, Glycine max
  Coding DNA Sequence Number=SeqID_49674
IAKALEQETKRARKEEHNRNKFRGALWGSNNELKLQREERDQSRVEGMILKDELKTCLRSKRSLSQQLSETEANMLAIISKYKEELDLATVHEHKVVDEYAQVYTKKEARGRAKAIVDVYSAPKEIHGLLSYCQHMIDLMARIIRNR

SEQ ID NO: 141360 - protein, 284 aa, Glycine max
  Coding DNA Sequence Number=SeqID_49675
  Homolog annotation: Hit_ID=Q2HW90; Match level="QueryCoverage=71%, HitCoverage=38%, E-value=2e-17, Identity=31%"; Hit description =Putative uncharacterized protein
MDGLVDLAAIDAFLAFQHNKESPVVAVLDDIYDTFDRRCEKSNAIIVCCKSALYVWLVSHLFHQDVRHTCPLQSHHSCTEKREAIWDQLLASIEGALVNWFPRWKEGRLGILFSCGGFPNVPMMGIRGCINYNHVLAIRQLGYPMRGASLMESLTPFVTWGLSDPNARVLQGVCKAWEVVQRKDKELRGSSNGIVSGYHRWLRAYTQGLDWLLKLRAAKEEEAKAPEESEEVQALKAELEKAQAVKERFKTTVVRIKRENNELRDINTTVRLPTSVPDRTSSIK

SEQ ID NO: 141361 - protein, 92 aa, Glycine max
  Coding DNA Sequence Number=SeqID_49676
MINDGKYGFGDPTVMWLRMPPDSWVTVTKGGVVDKSGAFAPTISFLNDHLEETLGPTKIGENHSKCINLTQCVARKSLAHRIFLAIKGRGPL

SEQ ID NO: 141362 - protein, 142 aa, Glycine max
  Coding DNA Sequence Number=SeqID_49677
MEKSDKMNFKEKKEKKGYITWEDNVINYSSDSEKKIISLGIMMKDYENGEEQSRYIDSNFSKHMACIKVYSYCLPKINEYVIYGDNKRRPHFSPRKVNMRFMETTNKGHLINNPNNWKLEVGVVLEVEVKMDSWKSGSWKLE

SEQ ID NO: 141363 - protein, 74 aa, Glycine max
  Coding DNA Sequence Number=SeqID_49678
MTYPAFIAFVGTASIVINNHGDGVGGVVGEKKEDKEGIVALSRLATPTMLELHQPQQLTKGLAPNRKQPFHNLL

SEQ ID NO: 141364 - protein, 103 aa, Glycine max
  Coding DNA Sequence Number=SeqID_49679
MCNRAFRPRLTKGAEDDVSLCVLSGFSTYRQQRVYTDNHSGISTRFSSYRQQKVYTDNHSGISARQRDSKVSMTDLVSAEDDVNLHVSTGLSAAIDEGRRRRR

SEQ ID NO: 141365 - protein, 104 aa, Glycine max
  Coding DNA Sequence Number=SeqID_49680
RSFLIGASVIASFGYQKEHDGSWAKKGARHVDEEGHGGEDSSLLQKILERFDGLQTFFGERFDTLELQVDMRFNEMESRITKVEEDLSYIRSSFDLPPPSPPSS

SEQ ID NO: 141366 - protein, 83 aa, Glycine max
  Coding DNA Sequence Number=SeqID_49681
MRDDKRSSYVIGIGVNSGISLGGKFLIALEPAPKWALSAGRVVVGARARGASLWMGVGVLGCTGAKLEEFPARAEKLGRCCAY

SEQ ID NO: 141367 - protein, 70 aa, Glycine max
  Coding DNA Sequence Number=SeqID_49682
MSEVEEVQEQLKADMEAMKEQMDTMMEAMMSMKKIMEANAVAVTATYAIAKVNLMPPSSLNQMNHPTQIW

SEQ ID NO: 141368 - protein, 105 aa, Glycine max
  Coding DNA Sequence Number=SeqID_49683
MTRGNPGDLQPFDPEIDRTFHRLVRHSVHPDHSVHFEHFEHFEYVVAGDSEYSDFEHSTTNFHTENMAQPPPRERTLREMAAPYFTYESLCIQHPDEGVQYVLKT

SEQ ID NO: 141369 - protein, 233 aa, Glycine max
  Coding DNA Sequence Number=SeqID_49684
  Homolog annotation: Hit_ID=UPI00006A2939; Match level="QueryCoverage =81%, HitCoverage=98%, E-value=5e-15, Identity=30%"; Hit description =UPI00006A2939 related cluster
  Subcellular localization annotation: CTP_CleavageSite=38; ConfidenceScore=5.04e-01
RTTRPHHHRATHLHLLSTTRPHHQRAAGPHLQRTTCPRHQSVARPHLQRTTRPHLQIAGRLHHQRAARPRLRGLHALTFRGLHALTLEDYTSSASDGQHAITLRTTRLHVLAIRGLHALTFRGLHVLAIRGLHALTFRGLYVLTFRGLYALTFRGLHLLTIRGLHALTIRGLHVLAIRGLHALTIRGLHVLALRELHALTFRGLHDLAIRGSHDVTFRGLHVLTIIGLHTFIF

SEQ ID NO: 141370 - protein, 251 aa, Glycine max
  Coding DNA Sequence Number=SeqID_49685
  Gene Ontology: Mol. function=motor activity; Cellular component=cell projection
  Homolog annotation: Hit_ID=UPI00016621D1; Match level="QueryCoverage =88%, HitCoverage=40%, E-value=2e-19, Identity=34%"; Hit description =UPI00016621D1 related cluster
GLHVLTFKGLHVLIFRGLHVLTFRGLHVLAIRGLHVLAIRGLHALTFRGLHVLTFRGLHVLTFKGLHVLTFKGLHVLAIRGLHALAIRGLHVLTIRRLHTLVFRGLHALTFRGLHILAIKGLHALAIRGVHVLPIKGLHALTFRGLHVLAVKGLHALTFRGLHGLHVLTFIGLRALTFIGLHALTFRGLHALVFRGLHVLTFRGLHVLTFIGLHARTFIGLHALTFRGLHTGPHLQRAARPRLHRATRPRL

SEQ ID NO: 141371 - protein, 207 aa, Glycine max
  Coding DNA Sequence Number=SeqID_49686
  Homolog annotation: Hit_ID=UPI00006DA3B6; Match level="QueryCoverage =45%, HitCoverage=24%, E-value=4e-11, Identity=36%"; Hit description =COG0438: Glycosyltransferase
MRNKKNLWVLGPRDKKLSGIGLYSTNLIKGLSSKGYIDDVLYIPFKSRSVMRTIVFPSEFSRQAYLTTFQSSGKAKGKVRVVIPNSFDFSNVIDSGMPGNNAATKEHIISFLYVGSEEARKNLNVAVSALAELGRDNNIRFTKIGKPIVEENREELLAILSDSALEYKIIDFADNQNLEFYLSSCDFFIMPSLHEGFGRTPIEAQYH

SEQ ID NO: 141372 - protein, 240 aa, Glycine max
  Coding DNA Sequence Number=SeqID_49687
  Gene Ontology: Mol. function=hydrolase activity, hydrolyzing O -glycosyl compounds; Cellular component=cytoplasm; Biological process= carbohydrate metabolic process
  Homolog annotation: Hit_ID=A8G991; Match level="QueryCoverage=99%, HitCoverage=50%, E-value=1e-122, Identity=86%"; Hit description =Glycoside hydrolase family 1
  Pfam annotation: Domain name=Glyco_hydro_1; Domain location=1-236; Score=-63.1; E_value=1.6e-15; Accession=PF00232.9; Description =Glycosyl hydrolase family 1
MLAGGNFYPWSCKPEDVWAALQKDRENLFFIDVQARGAYPAYAARVFREKGVEIVMAEGDSELLRHTVDFISFSYYASRCASAEMNEQNSSAANVVKSLTNPHLARSAWGWGIDPLGLRITMNMMYDRYQKPLFLVENGLGAYDEINASGEIADDYRISYLQQHIHAMGEAIADGVPVMGYTTWGCIDLVAASTGEMSKRYGFVYVDRDDHGNGTLNRLRKKSFWWYQRVIASNGRDLDF

SEQ ID NO: 141373 - protein, 94 aa, Glycine max
  Coding DNA Sequence Number=SeqID_49688
  Gene Ontology: Mol. function=RNA-directed DNA polymerase activity
  Homolog annotation: Hit_ID=Q2HSQ4; Match level="QueryCoverage=57%, HitCoverage=56%, E-value=2e-13, Identity=64%"; Hit description=RNA -directed DNA polymerase ; Zinc finger, CCHC-type; Peptidase aspartic, catalytic, putative
MARYLHGLNREIQDIVELHHYASLKDLIHQAIKVEQQVKRKQTYKKNRGSSLKSHEKGHIVSQCPNKRRMVVVGYGVITSASFSGSSSSSTESE

SEQ ID NO: 141374 - protein, 104 aa, Glycine max
  Coding DNA Sequence Number=SeqID_49689
MGAKPMEYSLVVSAVTTAYNAIGQKDKAYDYLVKSIEPIDKKFNVFIKGLQQMGKEKAMNESENVQRITPFYRSNLFDIMKPFDSTYSKEKEQQITTAIMKATQ

SEQ ID NO: 141375 - protein, 133 aa, Glycine max
  Coding DNA Sequence Number=SeqID_49690
  Subcellular localization annotation: CTP_CleavageSite=28; ConfidenceScore=5.16e-01
MRVENERRGRRKKWQKRTSAETSGRPVRASSGSSRRTFSGTFPDEAVVRVYPNFFGKTTSSGRLPENLFRELSGRSGSSGRIPEDAHFRKNFQSSGRPFRKNPFFRNVSGRTTSSGSDFMKNEVWVFDVIFFL

SEQ ID NO: 141376 - protein, 268 aa, Glycine max
  Coding DNA Sequence Number=SeqID_49691
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141377 - protein, 156 aa, Glycine max
  Coding DNA Sequence Number=SeqID_49692
MAQLIADAIYLFAGMAPTRHPLDPDKSNRALGFPALITGLCQSFGVPVAPSKVIRPPITRAFIEKYCTQRQAQGDAPQAADAPPPHQAGPAGSFDTEQYLRHLFRAEVAWPGDWPEARAGEAPVEAPVEAPDEVDEAREDEEMTNLLDFLGGSGAT

SEQ ID NO: 141378 - protein, 56 aa, Glycine max
  Coding DNA Sequence Number=SeqID_49693
DCHHQKGKDCGSNAFQGYFDDAKESRVNQISKIQESSFNNQDSRFKNQVSRIKIQG

SEQ ID NO: 141379 - protein, 15 aa, Glycine max
  Coding DNA Sequence Number=SeqID_49694
LPSLLTDAWGANTFP

SEQ ID NO: 141380 - protein, 138 aa, Glycine max
  Coding DNA Sequence Number=SeqID_49695
MASVLHLVIINKKRPIICRIKRDLNKTSKETTKATKVAQVSISNQKNTDASIKNLEVQVGQLAKQLFEHGSISFLANTQINIPFSEALKQMPTYDKFINDLLTKNRRIMDDETVELEASYSAIIQKSILEIPIVSQFL

SEQ ID NO: 141381 - protein, 130 aa, Glycine max
  Coding DNA Sequence Number=SeqID_49696
MVKVGTSYVPINVSFSPKVGPGLPVLQWRNHVVYQLFPPVQLLNGVVIRSQFGTQAYEPEASALASVKPGAESANCCAKGDRCGPLALLRQLALKGGCAAYWRLLCWGSERAAAKPFFHRLRPPDKHHEI

SEQ ID NO: 141382 - protein, 16 aa, Glycine max
  Coding DNA Sequence Number=SeqID_49697
MARRNDRVIADALQAL

SEQ ID NO: 141383 - protein, 78 aa, Glycine max
  Coding DNA Sequence Number=SeqID_49698
MRLQLPLPALLLRPKNLGSMGGPHDVQIQNEHAFPAIWLALSTIPPPNVAYTPNKNVNNSTPIPIESQQPQTDHAHVS

SEQ ID NO: 141384 - protein, 408 aa, Glycine max
  Coding DNA Sequence Number=SeqID_49699
  Gene Ontology: Mol. function=transcription factor activity; Cellular component=cytoplasm; Biological process=regulation of transcription, DNA-dependent
  Homolog annotation: Hit_ID=Q47083; Match level="QueryCoverage=78%, HitCoverage=100%, E-value=1e-131, Identity=73%"; Hit description=HTH- type transcriptional regulator cbl
  Pfam annotation: Domain name=HTH_1; Domain location=92-153; Score =65.4; E_value=2e-16; Accession=PF00126.18; Description=Bacterial regulatory helix-turn-helix protein, lysR family
  Pfam annotation: Domain name=LysR_substrate; Domain location=177-385; Score=167.0; E_value=5.1e-47; Accession=PF03466.11; Description=LysR substrate binding domain
  Pfam module annotation: Pfam domain module=HTH_1::LysR_substrate; Domain location=92-153::177-385
SIAESAAVAERLSAPAAVAIGAGEVFPLTLTLSRPREREPSGAAIHPGTPSQSRAIRFLLMGQQSASHLPAPARDPLPLPMGEGRGEKGVNFQQLKIIREAARCEFNLTEVANTLFTSQSGVSRHIRDLEDELGVEIFIRRGKRLLGMTEPGKALLTIAERILDEAGKVRRLADVFTNETSGVLTIATTHTQARYSLPRVIKAFRQLYPNVRLELNQGSPQEIVAMLLAGEADVGIASEQLVNNTSLAAFPWFSWHHSLLVPHDHELLANQPVTLVSLSRHPLITYRQGITGRSRVDRAFQAAGLRPDIVLSAQDSDVVKTYVELGLGVGILADQACDIYDGEDLVKIDAHHLFDANTVWLGLKRGQLQRNYVWQFLELCNANLSLEEIKRQALSYETDDEPAIDFQI

SEQ ID NO: 141385 - protein, 121 aa, Glycine max
  Coding DNA Sequence Number=SeqID_49700
MRLKLRKKVMSETEGNIWAIIDECKEKLNLAATHEQRLEDEYAKISAEREARERVIDSLHQEAAMRMDRFALTLNRSQELPRLLAKAKAMADTYSAPEEIHKLLSYCQHMIDLMDYMIRNR

SEQ ID NO: 141386 - protein, 112 aa, Glycine max
  Coding DNA Sequence Number=SeqID_49701
  Pfam annotation: Domain name=G-patch; Domain location=1-37; Score =11.4; E_value=0.0078; Accession=PF01585.14; Description=G-patch domain
MLRHGYEPRMGLGKDSHGNADVVDIRGNPHKYGLGYEPGKPGRRNASLRLQADRAWPGHVSQCCKCQDNVRGRGGGNRRRGSTRSTEFRATMPSQFPIRELAHDEPVGSLYR

SEQ ID NO: 141387 - protein, 184 aa, Glycine max
  Coding DNA Sequence Number=SeqID_49702
  Gene Ontology: Mol. function=aspartic-type endopeptidase activity; Biological process=RNA-dependent DNA replication
  Homolog annotation: Hit_ID=Q6WAY3; Match level="QueryCoverage=94%, HitCoverage=7%, E-value=5e-09, Identity=27%"; Hit description =Gag/pol polyprotein
  Pfam annotation: Domain name=G-patch; Domain location=55-94; Score =25.4; E_value=0.00016; Accession=PF01585.14; Description=G-patch domain
MGVVPSTLHQKLKFVVRGRRGVIRNHFPSFEVVSISSVDSFSGQACLSDAAVMMARVMLGNGYEPGMGLGKDNGGITSLINAKGNRGKYGLGYKPTQADMKRSIAGRKSSGQSSQLRQESEGSPPCHISRSFISAGLGDEGQVVVIYEDDVPSTLDLVRPCPPDFQLGNWRVEERPDIYAASIM

SEQ ID NO: 141388 - protein, 90 aa, Glycine max
  Coding DNA Sequence Number=SeqID_49703
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKVGTLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 141389 - protein, 142 aa, Glycine max
  Coding DNA Sequence Number=SeqID_49704
MTYTKKTDQMMFEAAKEIANKIGRFHGGTGLTGFHGGTGLTGFLCRPWTLRSNVTIKQYFGPTPRTSHTSSSIAPKDMEQLTQKIRDQLEESITEKVTRQVLALPPEPVDGRSATHVSTKENVVIWFCSLHNRLDFLKGIII

SEQ ID NO: 141390 - protein, 68 aa, Glycine max
  Coding DNA Sequence Number=SeqID_49705
  Subcellular localization annotation: CTP_CleavageSite=24; ConfidenceScore=5.05e-01
MITKVMNKKLKRSKNNSSESKNISSKSRTSQEFKNQGEFKTQEESLESRIKTQDLKNQDQDSRLKIQE

SEQ ID NO: 141391 - protein, 34 aa, Glycine max
  Coding DNA Sequence Number=SeqID_49706
MKILSSGVVFTFEEGRQKRGFCSYVPSFGEGGIL

SEQ ID NO: 141392 - protein, 72 aa, Glycine max
  Coding DNA Sequence Number=SeqID_49707
LTGASSKEGKCAESPPTEGISTPRVRHKGWQRLTEQRIKLNVLMMPKDHMFLKALFKTKKLKIFKMDDQDSL

SEQ ID NO: 141393 - protein, 26 aa, Glycine max
  Coding DNA Sequence Number=SeqID_49708
MWGMSYPNFVRGPLLDDVRPFFGPRE

SEQ ID NO: 141394 - protein, 162 aa, Glycine max
  Coding DNA Sequence Number=SeqID_49709
MGYIQTVPPPLVRDSLIGTDIDDRWVQFSDHVAPTGELCVVPGQVAPDYMEWFFQISHPFVMPTEDTAKPRPAPPPPTHDDDFVEPPVAEVPVASDPPAHSVVDCTTCVRMERIAEHLERVINLRMVTAWTDLYDIMDVCLRIAKDDDPDDSLRPRQRPRID

SEQ ID NO: 141395 - protein, 32 aa, Glycine max
  Coding DNA Sequence Number=SeqID_49710
SRSIEESTFTDEIESDNEGGSLVSNITHYLQD

SEQ ID NO: 141396 - protein, 269 aa, Glycine max
  Coding DNA Sequence Number=SeqID_49711
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141397 - protein, 117 aa, Glycine max
  Coding DNA Sequence Number=SeqID_49712
  Subcellular localization annotation: CTP_CleavageSite=45; ConfidenceScore=5.12e-01
MNLLPSAVHVSSTIEYGAPRIHCLAMFANSPFSTFIRSPLISLPSAVHVSSTIESGAPRIDCLALFGNSPFSNLIRRPMNSLASAVQVSSTFESGAPRSYCVALFANSPFSTFFGAP

SEQ ID NO: 141398 - protein, 128 aa, Glycine max
  Coding DNA Sequence Number=SeqID_49713
MKADGEITSESEISEEEVEEEEYEEEAMHGDMLMVRRLLGNQMQPLDDNQRENIFHTRCVINDIDEDMTKSKGKDPLEGLGGPMTRARARKAKEALQQVLSILFEYKPKFQGEKSKVVSCIMAQMEED

SEQ ID NO: 141399 - protein, 290 aa, Glycine max
  Coding DNA Sequence Number=SeqID_49714
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRSFLASFPSSEPYSSKISGAAAENWIRCGFLCIEGDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141400 - protein, 175 aa, Glycine max
  Coding DNA Sequence Number=SeqID_49715
MSHDYHAPNGLLDEVVGDFSSDEDEILADNNNINDNDDNDIQFLFQPKSTENIYLPYPNSADVGDNQVADNPEYRHYLDQQQQSDSHDVELYVGKNILAMVEENEQLIIPTFITFVRQEFGYTITYRKAWLAKQWALEHAYGNWEESYNILHKYLQTIPALDESNQPIPNKVIFY

SEQ ID NO: 141401 - protein, 283 aa, Glycine max
  Coding DNA Sequence Number=SeqID_49716
  Gene Ontology: Mol. function=3-methyl-2-oxobutanoate hydroxymethyltran sferase activity; Cellular component=cytoplasm; Biological process =pantothenate biosynthetic process
  Homolog annotation: Hit_ID=A5FAQ5; Match level="QueryCoverage=84%, HitCoverage=87%, E-value=1e-92, Identity=71%"; Hit description=3 -methyl-2-oxobutanoate hydroxymethyltransferase
  Pfam annotation: Domain name=Pantoate_transf; Domain location=1-244; Score=431.7; E_value=1e-126; Accession=PF02548.6; Description =Ketopantoate hydroxymethyltransferase
FDKEKITMLTAYDFTTAKMVDAGGVDAVLIGDSAANVMAGFETTLPITLDQMIYHAQSVVRGVDRALVIADLPFGTYQSNPEKALESAVRMMKEGGAHAVKIEGGKEISKSIKKIVNAGIPVMGHLGLTPQSIYKFGTYKVRAKDEAEAEKLISDAQLLEELGCFSVVLEKIPADLAKKVSESISIPTIGIGAGPDCDGQVLVYHDMVGMNQGFSPKFLRRYLDLYSEITGAVAQYVKDVKEDGSISFHRKLMISSRKGPLYCWRFSSIGIKAGCNENTWASC

SEQ ID NO: 141402 - protein, 279 aa, Glycine max
  Coding DNA Sequence Number=SeqID_49717
MEESMSPFLVRDFGAQNFKAIQRIHKAWETPLRKDQELRGIRNGIIGGYHEWLKVHIREDEEVQALKSDLGKAKLAKEKFKLAATHIRKECAGLREENATTARALEQETKRARKEEYGCNKFRGALWGSNSELKLRREERDQLRAHSMVLKEELITCSRSKRSLSQRLCETETNMLAIIAKYQEELGLATAHEHRVADEYAQVYAEKEARGRVIDSLHQEATMWMDRFALTLNGSQELPRLLAKAKAMADTYSAPEEIHGLLGYCQHMIDLMTHIIRNR

SEQ ID NO: 141403 - protein, 166 aa, Glycine max
  Coding DNA Sequence Number=SeqID_49718
MTPVNRKAGTGERTREPPGGNAGIFIVLSGFATTDLSVRFRDACQGGGAYGKTALPRPSHFPVKYLPGIFQEISAPFPFFSCHMKHFTDTLISANIETAMTMITPSSKLTLTKGNKSWYRAPPRGRRCAAGADLGRNLFRLIEFLQPGGSTSSRAAATAVELQFAL

SEQ ID NO: 141404 - protein, 35 aa, Glycine max
  Coding DNA Sequence Number=SeqID_49719
MVLRDKKKASWGGNARVEKGLEGDLIEKRRFIRER

SEQ ID NO: 141405 - protein, 94 aa, Glycine max
  Coding DNA Sequence Number=SeqID_49720
MVVVIEATRRNGRGGRLKNLKDFGKLQGMKVQEVQKWDPDIASGNKVVWVRCYSIPLQAWEEFFLSLLANKVGSLEGVDEDTLTLKYVEYARIW

SEQ ID NO: 141406 - protein, 273 aa, Glycine max
  Coding DNA Sequence Number=SeqID_49721
  Gene Ontology: Mol. function=hydrolase activity; Biological process =pyrroloquinoline quinone biosynthetic process
  Homolog annotation: Hit_ID=Q50437; Match level="QueryCoverage=84%, HitCoverage=74%, E-value=1e-100, Identity=74%"; Hit description =Coenzyme PQQ synthesis protein B
MSAVFYARNPLAMPAHENHEQGIIVSSRLIMQRMRMMPVLLSRHRKMTCCRSNGVDWVLFNASPDVLQQIQEFAPLQPGRGVRDTGIQGIVLIDAQIDHTTGLFMLREGQVKREIYCTKMVYEDLTTGNQILNILGHYCGINHHEIAIDANDVSNAHSFEIPGVPNLRFTAVALKSAAPPYSPHRNDPHPGDTIGVLIEEISTGKKCWYSPGLAEIEPHLPPLMNQADCIMVDGTFWTNTEMLDMGLMTKTARSIGHNPQSGPGGMIEELDKF

SEQ ID NO: 141407 - protein, 77 aa, Glycine max
  Coding DNA Sequence Number=SeqID_49722
  Subcellular localization annotation: CTP_CleavageSite=53; ConfidenceScore=5.26e-01
MGVQIATRPTWAFQDVPPEGGCFWRKQPSSPGRAGKSKPRRFRNAFVTFPWVICKYFQPFFDVLRSLFVVLRSSTDF

SEQ ID NO: 141408 - protein, 120 aa, Glycine max
  Coding DNA Sequence Number=SeqID_49723
MPISPYKWTAPTRHPVDPKKSDRALGFTALVTGLCQSYRVPVPPAKSCHRDIGMAPTKTPNGPGEVQQGPGISNSGIAPARHPVDPKKSNRVLELPSSHYGPRSVQRSACRPQQGHQAPY

SEQ ID NO: 141409 - protein, 183 aa, Glycine max
  Coding DNA Sequence Number=SeqID_49724
  Homolog annotation: Hit_ID=Q6VG41; Match level="QueryCoverage=52%, HitCoverage=20%, E-value=8e-07, Identity=32%"; Hit description=Gag polyprotein
  Pfam annotation: Domain name=zf-CCHC; Domain location=62-79; Score =20.6; E_value=0.0012; Accession=PF00098.14; Description=Zinc knuckle
  Pfam annotation: Domain name=zf-CCHC; Domain location=82-99; Score =25.3; E_value=0.00023; Accession=PF00098.14; Description=Zinc knuckle
  Pfam module annotation: Pfam domain module=zf-CCHC::zf-CCHC; Domain location=62-79::82-99
  Subcellular localization annotation: CTP_CleavageSite=45; ConfidenceScore=5.42e-01
MALVTNPFLGRISSKKNGPQHRGKSYSTPSKQYGNRPNNKRIIALGFAGGSGRKPATFSTQISCYKCGKLGHISSNFADKVMTCFNCRQKGHIQRDCSYPKKGQSGGGLNDQTRHPKTMERFFTLNGVKALKSKDLIQDTQVYMILSNLEVETKVSMCDLPVVREFPEVFPEDISSLPLERER

SEQ ID NO: 141410 - protein, 248 aa, Glycine max
  Coding DNA Sequence Number=SeqID_49725
  Gene Ontology: Mol. function=kinase activity; Cellular component =mitochondrion; Biological process=carbohydrate metabolic process
  Homolog annotation: Hit_ID=A8GL00; Match level="QueryCoverage=100%, HitCoverage=45%, E-value=1e-127, Identity=85%"; Hit description=FGGY- family pentulose kinase
  Pfam annotation: Domain name=FGGY_N; Domain location=4-242; Score =71.9; E_value=2.2e-18; Accession=PF00370.12; Description=FGGY family of carbohydrate kinases,
MASYFIGVDVGTGSARAGVFDMTGRMLGQASREITLYRPKADFVEQSSDEIWQSVCNAIKDVISQADINPIQVKGIGFDATCSLVVLDKEGKPLTVSPTGRSEQNIIVWMDHRAITQAERINATGHRVLEFVGGIISPEMQTPKLLWLKQHMPTTWSNVGHLFDLPDFLTWRATQDTTRSLCSTVCKWTYIGHEDRWDPSYFRQIGLEDLLENNAAKIGSEVKTMGEPLGHGLTQRAAAEMGLMAGTA

SEQ ID NO: 141411 - protein, 344 aa, Glycine max
  Coding DNA Sequence Number=SeqID_49726
  Homolog annotation: Hit_ID=A5C0K9; Match level="QueryCoverage=71%, HitCoverage=55%, E-value=4e-11, Identity=24%"; Hit description =Putative uncharacterized protein
MAQPPPRERTLREMAAPDFTYESLCIQYPDEDVSYVLKTGLIHLLPKFHGLAEGVAKDWLYYLAPRSITSWDDLKRVFLEKIFPASRTTTIKKDISDAASGGALGDMTPAEARNLIEKMASNSQQFSARNDAIVIRGVHEVATNSTALSETKKLEGKLDALVNLVTQLALNQKSVPVARVCGLCSSADHHTDLCPSMQQPGAIEQSEAYAANIYNKPPQPQQQNQPQQNNYDLSNNRYNPGWRNHPNLRWSSPQQQQQEPSPSFQNVVGPSRPYIPPPIQQQQQPQKQPTVEAPPQPSLEELVRQMTMQNMQFQQETRASIQSLTNQMGQLATQLNQQQSQGIL

SEQ ID NO: 141412 - protein, 78 aa, Glycine max
  Coding DNA Sequence Number=SeqID_49727
MTQESGSRQRHLLVIRTSSFGDPEFDWQAEANVVICALSGDVSISRSEFLIINGGYVGAKAPLLLTTLPFVIMTREVK

SEQ ID NO: 141413 - protein, 76 aa, Glycine max
  Coding DNA Sequence Number=SeqID_49728
MASRKLASKRSRKDKAAEGTSSAPEYDKHRFRSAEHQQRFEAIKGWSFLRERRIQLRDDEYIDFQEEIVRRRWASL

SEQ ID NO: 141414 - protein, 134 aa, Glycine max
  Coding DNA Sequence Number=SeqID_49729
  Subcellular localization annotation: CTP_CleavageSite=43; ConfidenceScore=5.12e-01
MNCVFVHVSSTFEFGAMRSDCLVQFSILNLFRSPMNCVFVHVSSTHEFGAMRRDCLVQFSILNLFRSPMNCVFVHVSSTHEFGAMRSDCLVQFSILNLFRSPMNLVFVHVSPTHEFGALRSDCLMCPPPLSLEP

SEQ ID NO: 141415 - protein, 122 aa, Glycine max
  Coding DNA Sequence Number=SeqID_49730
VIFVDSGNEKEHETFLATWLAEIDFSPNGLDGGSSQYCIIIVIFQRILLGERAVYAMMLVFPPEFSPLKTILFGNPSQDTVEPLMEALEEDYKDGNEINESRQFIGGVLDLEKRINRLDTLT

SEQ ID NO: 141416 - protein, 77 aa, Glycine max
  Coding DNA Sequence Number=SeqID_49731
ATDYKVKSIGGMCILIQMWAWERCTTLAPKRTPPVIENKPLRHSLVRGGPTPPVSMLLSGTNPIEFYDNLDCNNLFP

SEQ ID NO: 141417 - protein, 140 aa, Glycine max
  Coding DNA Sequence Number=SeqID_49732
  Gene Ontology: Cellular component=ribosome
  Homolog annotation: Hit_ID=A2Q6B4; Match level="QueryCoverage=91%, HitCoverage=52%, E-value=5e-13, Identity=32%"; Hit description =Ribosomal protein L33; Nucleic acid-binding, OB-fold
MAHIADKIKNIDGSKETLKLTVRIIELWFVGTPGRSEQAEMIIVDSDGDQIHVVCKQDQLKAWKMDLKEGCTYVMHNFRVTKNDRQYIVCDHPYKLIFIGVTVVRQCELDGLPLKKYRFVDFSDVIAGQLQPDLLVGEGS

SEQ ID NO: 141418 - protein, 130 aa, Glycine max
  Coding DNA Sequence Number=SeqID_49733
  Subcellular localization annotation: CTP_CleavageSite=45; ConfidenceScore=5.18e-01
MPLGYINGASLAPENLDNSKNTPGSDLISLVKVGASRLRSSSSVRETLAVACPLVINALIRIPSTRYFSAQSARTDGNWYPRNRQKHTAGSIAGKCSLGCDAALTHHPAALNAPLQGASFQFDHVRLRNC

SEQ ID NO: 141419 - protein, 135 aa, Glycine max
  Coding DNA Sequence Number=SeqID_49734
  Homolog annotation: Hit_ID=Q6UUU1; Match level="QueryCoverage=77%, HitCoverage=93%, E-value=6e-19, Identity=45%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSVPAFGLPVSFRCMA

SEQ ID NO: 141420 - protein, 144 aa, Glycine max
  Coding DNA Sequence Number=SeqID_49735
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-24, Identity=100%"; Hit description=LacZ protein
  Subcellular localization annotation: CTP_CleavageSite=38; ConfidenceScore=5.07e-01
MKHFTDTLISANIRKISAKPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141421 - protein, 85 aa, Glycine max
  Coding DNA Sequence Number=SeqID_49736
MEVDDNSDSEGEDVVAKKLGCKIEVIPSLNVVVADGNKNFDKLTMEFVTQGRRHVLRGASNAKLKIVKKQQLHKALSSCMHISML

SEQ ID NO: 141422 - protein, 131 aa, Glycine max
  Coding DNA Sequence Number=SeqID_49737
MHKCLRFRVSQYKVKDDNECSSDENSKKGPQQRCCGIFRSFQGLGDYLLIETMQKTLHGMQMGETAMECSVIQLIPPSGRRLIVCIQISFKHSTQFVASLASNLQSASLVVHEAKIHDVVYDDIGPKRARK

SEQ ID NO: 141423 - protein, 159 aa, Glycine max
  Coding DNA Sequence Number=SeqID_49738
  Gene Ontology: Mol. function=binding; Biological process=protein amino acid phosphorylation
  Homolog annotation: Hit_ID=Q1SMZ4; Match level="QueryCoverage=73%, HitCoverage=20%, E-value=6e-17, Identity=37%"; Hit description =Tetratricopeptide-like helical
MMQCPTAASLSHRLELKGSVPSLVTLNILINCFYHMGQITFGFSLLRPTILKRSYQPNTITLNTLIKGFCLKGRVKKTLTRILVMLKEATNFLNEIVLKTINPSVYTYNDALCKKGKVKEAKTHEDDVTIMEGTIDNDWGEDDGERLTGDTTEARLRRA

SEQ ID NO: 141424 - protein, 136 aa, Glycine max
  Coding DNA Sequence Number=SeqID_49739
  Subcellular localization annotation: CTP_CleavageSite=68; ConfidenceScore=5.39e-01
MVNRQNSLVKDGSRPIVSLAFFIHGLPRPLFTRNHNNSKKRRLANSKSYISNRAILMDSGSLFYTAARAFKFHSLSLGFISIYIVESGTTSDLRIIDAPFHDQLYFAVANQPCLLDVGIDAMYTKPSNQSNFICRH

SEQ ID NO: 141425 - protein, 446 aa, Glycine max
  Coding DNA Sequence Number=SeqID_49740
  Gene Ontology: Mol. function=RNA binding; Cellular component =nucleolus; Biological process=ribosome biogenesis and assembly
  Homolog annotation: Hit_ID=Q9ZRW0; Match level="QueryCoverage=89%, HitCoverage=94%, E-value=1e-114, Identity=58%"; Hit description =Nucleolar protein
  Pfam annotation: Domain name=NOSIC; Domain location=95-139; Score =20.9; E_value=0.00061; Accession=PF08060.4; Description=NOSIC (NUC001) domain
  Pfam annotation: Domain name=Nop; Domain location=182-309; Score =119.6; E_value=9.5e-33; Accession=PF01798.9; Description=Putative snoRNA binding domain
  Pfam module annotation: Pfam domain module=NOSIC::Nop; Domain location=95-139::182-309
MVNRQNSLVKDGSRPIVSLAFFIHGLPRPLFTHPKIGCQISELPKIPCQSNEFDSELLRGVRLHFDRDLEKAQLGLGHSYSRAKVKFNVNRADNIVIQAIFLLDTLDKDINSFSMRVRIIKLEELNSLLFINCVPRMDKSKLSEDKIAAVTDIVRDEDKAKEIVEAAKASMGQYLSPVDLINVQQFAQRVMDLSKYRRKLYDYLVAKMNDIALNLASLIGEVVGARLISHAGSLTNLAKCPSSTLQILGTEKALFRFLLHTYKAIVAHHSNPPSFAAKLPCHGSQRGTTTFGEKLREQVEERLDFYDKGVAPRKNIDVMKLAIESVENKDTAMEIEAPVEVSGKKAKKKHTAVVTDDMAVDKPTETTNGDALEDHKSEKKKRKKEKRKLDTENDQAMDDGANGVESEQDGAVKKKKKKDKKGDNGEVLVAAIETKKKKNKSKNRDT

SEQ ID NO: 141426 - protein, 349 aa, Glycine max
  Coding DNA Sequence Number=SeqID_49741
  Gene Ontology: Mol. function=carbohydrate binding; Cellular component= cytoplasm; Biological process=carbohydrate metabolic process
  Homolog annotation: Hit_ID=A7PH86; Match level="QueryCoverage=100%, HitCoverage=100%, E-value=1e-146, Identity=71%"; Hit description =Chromosome chr17 scaffold_16, whole genome shotgun sequence
  Pfam annotation: Domain name=Aldose_epim; Domain location=9-345; Score=395.8; E_value=6.4e-116; Accession=PF01263.11; Description =Aldose 1-epimerase
MADESPKPETFELNNGSMQVLLTNLGCTIISLSVPGKDGLFPFQFFIFIFIHCYLRFTLSLSVFKKGLAPYFGCIVGRVANRIKDGKFTLDGIHYSLPINNPPNSLHGGNVGFDKKVWEVVEHKKGETPSITFKCHSHDGEEGYPGDITVTATYTLTSSTTLRLDMEGVPKGKPTIVNLAQHTYWNLAGHNSGNILDHSIQLWANHITPVNENTVPTGEIMPVKGTPFDFTSFNRIGSTISQVGLGYDHNYVLDCGEEKEGLRHAAKVRDPSSSRVLNLWTNAPGVQFYTANYVNGVQGKGGAIYGKHAGLCLETQGFPNAINQPNFPSVVVRPGEKYQHTMLFEFSLE

SEQ ID NO: 141427 - protein, 129 aa, Glycine max
  Coding DNA Sequence Number=SeqID_49742
MERETENLNLRENDMVENGLCLLGRNQSSVFSDFSFGVKPMQELMEWKAGHIQNFFSLDQNCMGVGSGGEGVEGAALDNLAEPVEVGNGVANGLRVVSNIVEAVRLQESVTRRRLVEEEQRHCNPKTEQ

SEQ ID NO: 141428 - protein, 207 aa, Glycine max
  Coding DNA Sequence Number=SeqID_49743
  Gene Ontology: Mol. function=binding; Cellular component =mitochondrion; Biological process=protein amino acid phosphorylation
  Homolog annotation: Hit_ID=A5AWF6; Match level="QueryCoverage=80%, HitCoverage=79%, E-value=2e-48, Identity=30%"; Hit description =Putative uncharacterized protein
  Pfam annotation: Domain name=PPR; Domain location=129-163; Score =38.9; E_value=1.8e-08; Accession=PF01535.11; Description=PPR repeat
  Pfam annotation: Domain name=PPR; Domain location=24-58; Score=23.8; E_value=0.00065; Accession=PF01535.11; Description=PPR repeat
  Pfam annotation: Domain name=PPR; Domain location=59-93; Score=32.4; E_value=1.7e-06; Accession=PF01535.11; Description=PPR repeat
  Pfam annotation: Domain name=PPR; Domain location=94-128; Score=26.5; E_value=9.8e-05; Accession=PF01535.11; Description=PPR repeat
  Pfam module annotation: Pfam domain module=PPR::PPR::PPR::PPR; Domain location=129-163::24-58::59-93::94-128
MKHYSTAVSLSHRLELKGIQPDFFTLNILMNCFCHMGQINFGFSVLAKILKRGYQPHTITFTTLIKGLCLKGQVNKALHFHDKLLAQGIKFDQVSYGTLINGVCKIGDTRGAIKLVRKIDGRLTKPNVEMYNTIIDALCKYQLVSEAYGLFSEMTAKGISANVVIATKAAGHRTQDKGHLRKAGPKGLLGDQPNIKITFSFSITSSC

SEQ ID NO: 141429 - protein, 155 aa, Glycine max
  Coding DNA Sequence Number=SeqID_49744
  Gene Ontology: Mol. function=binding; Biological process=protein amino acid phosphorylation
  Homolog annotation: Hit_ID=Q1SMZ4; Match level="QueryCoverage=80%, HitCoverage=68%, E-value=1e-18, Identity=38%"; Hit description =Tetratricopeptide-like helical
  Pfam annotation: Domain name=PPR; Domain location=93-127; Score=22.1; E_value=0.0021; Accession=PF01535.11; Description=PPR repeat
MMQCPTAASLSHRLELKGSVPSLVTLNILINCFYHMGQITFGFSLLRPTILKRSYQPNTITLNTLIKGFCLKGRVKKTLTRILVMKNMVPNMVTRNSLIDGLCKLGRISYVWDLIDEMHDIATHEDGVTIMEGMIDNDWGQDDGERLTGDTTEAR

SEQ ID NO: 141430 - protein, 16 aa, Glycine max
  Coding DNA Sequence Number=SeqID_49745
MENKFLYFSTSGTHYI

SEQ ID NO: 141431 - protein, 278 aa, Glycine max
  Coding DNA Sequence Number=SeqID_49746
  Gene Ontology: Mol. function=zinc ion binding; Cellular component =intracellular
  Homolog annotation: Hit_ID=A7PH81; Match level="QueryCoverage=76%, HitCoverage=50%, E-value=4e-65, Identity=60%"; Hit description =Chromosome chr17 scaffold_16, whole genome shotgun sequence
  Subcellular localization annotation: CTP_CleavageSite=53; ConfidenceScore=5.59e-01
MSSASKLTLYGIGTALFRTRRTAPVSVTPFLFFKPIPLPRPPRFLLLRDSSSSSAAAAEILPSVDHPWPEWVSFVDRLSTKGYLPKPSSSSDDTVSLYTNMNSLKDACLSFSRDRYDLFKLLPTHDIQAVVEGGCPNLLRKAVNSAKRLRAHLQLDEGDVCGACNLRSSCDRAYVILKDFETDARTIDIVRILLFYALDPLVLSGGDKPPGREVIESSARKLLSQLIELSESPAPAPASARSKPTAQDAVGEGQSLSVTTNQLFKDAEMKKGDWMCPK

SEQ ID NO: 141432 - protein, 42 aa, Glycine max
  Coding DNA Sequence Number=SeqID_49747
MSKLDGPYPCICKEAVFGFEPMTNKSPRHNFTAAPGLALMRI

SEQ ID NO: 141433 - protein, 855 aa, Glycine max
  Coding DNA Sequence Number=SeqID_49748
  Gene Ontology: Mol. function=protein serine/threonine kinase activity; Cellular component=intracellular; Biological process =protein amino acid phosphorylation
  Homolog annotation: Hit_ID=Q1SMZ9; Match level="QueryCoverage=98%, HitCoverage=76%, E-value=0.0, Identity=55%"; Hit description=Protein kinase
  Subcellular localization annotation: CTP_CleavageSite=46; ConfidenceScore=5.73e-01
MKNLLKKLHIMSNQSENEQGSSSSSSKGGNKSNLGSSSSSKKKVVRSTSPQSSEQKPFSGLSSWLNSLRGERMEPSDAVSSGGGLDAVFSDSARLDSGSSGSRDPEVEEEYQIQLALELSAKEDPEAVQIEAVKQISLGSCDPGYTPAEVVAYRYWMCRLVLLHWHCLEHGVLCKSIDLSLQMTRKEKWKEGFIRASQNYNALGYDDKTLDGFYDLYGSLTESTPARMPSLVDLQLQGTPIAGSGTWEAVLVNRAADSNLLKLVQKVQELTGKSSPDFVVIDSNLVRKLAIFVADYMGGPVGDPESMTRAWRSLSYSLKATLGSMILPLGSLTIGLARHRALLFKRVLKVLLEKDILCIFLSERNFGRFAMVLADSLGIPCRLVKGLQYTGSNDVAINFVKIDDGREYIVDLMADPGTLIPSDATGSQIDYDESLYVASPSSRDLDSSHVASSSSGVGSSYEETSDLGMLDKGNRSKHFSHTGKEYDVSRSSTGKEESMRPLNEFKSPYNVEKITGQEAPGRPNHPHVHARSPSWTEGISSPAVRRMKVKDVSLYMIDAAKENPHLAQKLHDVLLESGVVAPPNLFSEIYDEELSSSTEANLLTEEKDEHEQGSGRQEAEIDGNVSPAQFFPPRALPKASSSSQLEHLKPVEGLGINLPLHTGEAAGQQIPTQVKYGQNVPVAAAAAAAAAVVASSMVVAVAKSSIDSNIELPVAEAATATAAAVVTAAVSRQYEQGSRSDGDTDSAGYDLKGSGDGEHIALGANSEGDRRSDRSVVSNDSTKSDSALDDHEVAEVDIPWEEITLGSYGEVYRGEWHGTEIAVKRFLDQDISGESLEEFKTEDSMHCYLRPAPLK

SEQ ID NO: 141434 - protein, 242 aa, Glycine max
  Coding DNA Sequence Number=SeqID_49749
  Homolog annotation: Hit_ID=A5BX53; Match level="QueryCoverage=57%, HitCoverage=34%, E-value=1e-41, Identity=55%"; Hit description =Putative uncharacterized protein
  Pfam annotation: Domain name=WD40; Domain location=164-201; Score =26.8; E_value=8.3e-05; Accession=PF00400.23; Description=WD domain, G-beta repeat
MTTTPNVGSCSSSCTLPLLLFLGLLFVPEGVALVLEFRFGVQFDGFWRVFVAALMGCLSGILFIPASRSARCFWLGNDQIRCNLSMITCGWFTRAILYANQMLGNGVAKSGFGNAEKLVENVGFLPSDFGSFRKWCLLGSGLLQIVALRPNLQMYLNEALLSWYQRLHASKGHVEVVAVAVVPDATLIASGGKDGLVLVWGMDNGKKLCEFETCYVTKEIVKDLKVSLNTDDDWNGSTTDNK

SEQ ID NO: 141435 - protein, 213 aa, Glycine max
  Coding DNA Sequence Number=SeqID_49750
  Gene Ontology: Mol. function=binding; Cellular component =intracellular; Biological process=embryonic development ending in seed dormancy
  Homolog annotation: Hit_ID=Q1SMZ4; Match level="QueryCoverage=62%, HitCoverage=80%, E-value=8e-21, Identity=32%"; Hit description =Tetratricopeptide-like helical
  Pfam annotation: Domain name=PPR; Domain location=2-36; Score=36.8; E_ value=7.5e-08; Accession=PF01535.11; Description=PPR repeat
  Pfam annotation: Domain name=PPR; Domain location=37-71; Score=48.5; E_value=2.4e-11; Accession=PF01535.11; Description=PPR repeat
  Pfam annotation: Domain name=PPR; Domain location=72-106; Score=21.7; E_value=0.0027; Accession=PF01535.11; Description=PPR repeat
  Pfam module annotation: Pfam domain module=PPR::PPR::PPR; Domain location=2-36::37-71::72-106
MFTFNILFDGLCKGGRLKDAQEVLQELLDKGYHVDIYTYNVMINGLCKQDLLDEALAMLSKMEDNGCKANAVTFEIIISALFEKDENDKAEKLLHEMIARGLFLQMLNLHKGGEHMVNRKNSLVKDGSRPIVSNAFFIHGLPRPLFTCPNEGILISPGLYPHLVLLNSILYLLGLSLAIYIVESGTTSLLRILNAPFHHELYFAVANQPCLMF

SEQ ID NO: 141436 - protein, 219 aa, Glycine max
  Coding DNA Sequence Number=SeqID_49751
MTHTQHAIELGNGIVNILNGWGLRVKVRIMDCVCWGEIKAPISDARTYGMGGLKKSFGSKGGGGVANIIDNNMLKVSNTSFKHEEVKEDIIQMHPTKAPVFGDIMSEMEEDSRAMVFTVARNIWYGRNQYVLQNRRLDFRQILAKANQNLPLCLMRDVPNAHSQRVPVGWKPPPEGTFKVKLNAAIRNNQGTCMGFIDRDHEGNVLAASSRSISSTGFC

SEQ ID NO: 141437 - protein, 130 aa, Glycine max
  Coding DNA Sequence Number=SeqID_49752
  Gene Ontology: Mol. function=binding; Biological process=embryonic development ending in seed dormancy
  Homolog annotation: Hit_ID=A7QVN0; Match level="QueryCoverage=100%, HitCoverage=26%, E-value=3e-13, Identity=31%"; Hit description =Chromosome chr14 scaffold_190, whole genome shotgun sequence
  Pfam annotation: Domain name=PPR; Domain location=43-77; Score=31.7; E_value=2.7e-06; Accession=PF01535.11; Description=PPR repeat
MAVKGISVNVVTCNTLLCGFIVGKLKEVTNFLNEMKNMVPNMVTCNSLIDCLCKLGRISYVWDLIHEMHDSGKPANGLLDEALAMLSKMEGNGCIPNAFTFEILICALFEKDGNDKAEKLLREMIARGLL

SEQ ID NO: 141438 - protein, 36 aa, Glycine max
  Coding DNA Sequence Number=SeqID_49753
MASSRAQNRSGLLVRRAVKPSSIKPACRGLFRGATA

SEQ ID NO: 141439 - protein, 311 aa, Glycine max
  Coding DNA Sequence Number=SeqID_49754
  Gene Ontology: Mol. function=protein-tyrosine kinase activity; Cellular component=MHC class I protein complex; Biological process =protein amino acid phosphorylation
  Homolog annotation: Hit_ID=A7NTX9; Match level="QueryCoverage=50%, HitCoverage=98%, E-value=7e-54, Identity=66%"; Hit description =Chromosome chr18 scaffold_1, whole genome shotgun sequence
  Pfam annotation: Domain name=Hin1; Domain location=128-289; Score =11.6; E_value=0.00017; Accession=PF07320.4; Description=Harpin -induced protein 1 (Hin1)
  Subcellular localization annotation: CTP_CleavageSite=69; ConfidenceScore=5.37e-01
MHAKTDSEVTSLAASSPTRSPPRRPLYYVQSPSRDSHDGEKTATTSFHSTPVLSPSASPPHSRHSSSTRFSKKDHSHSLKPWKQIDVIEEEGLLQGDDRRNGLPRRCYFLAFVVGFLVLFSFFSLILWGASRPMKPKITIRLHDPWFEFFRMGSESITFDHVRVQAGSDATGVATDMITLNSTLKFTYRNTGTFFGVHVTSTPVELSYSDIVIAAGNLKKFYQSRRSQRLLSVSVMGNKIPLYGSGASLSSTTGVPTLPVPLNLSFVLRSRAYVLGKLVKPKYYKTIKCSITLDPKKLNAAISLKKSCTYD

SEQ ID NO: 141440 - protein, 161 aa, Glycine max
  Coding DNA Sequence Number=SeqID_49755
  Subcellular localization annotation: CTP_CleavageSite=86; ConfidenceScore=5.21e-01
MTTKSQELAVKLDSIFDQLSTLTTTPSSPKSPPFHSYVNHIDLQTVETMKSPPTTKSQRSPMVFAMPTTTMEQQSTTTMLTTPPMAASHLPSWWPPQSPLHPLSYPPHPCIYTTLHRPFSLCYHAHTHHHHLHSTLTVTLQLSNIYLMVRLGNRCDICAHL

SEQ ID NO: 141441 - protein, 109 aa, Glycine max
  Coding DNA Sequence Number=SeqID_49756
  Gene Ontology: Mol. function=membrane alanyl aminopeptidase activity; Cellular component=cytoplasm; Biological process=proteolysis
  Homolog annotation: Hit_ID=A7P4P1; Match level="QueryCoverage=66%, HitCoverage=8%, E-value=4e-28, Identity=81%"; Hit description =Chromosome chr4 scaffold_6, whole genome shotgun sequence
MGGLVSHCHEKLTNTKWDEDGEREWRKWKGNESKAPNGTSVIRMLHRYLGAECFQRSLASYIKRHACSNAKTEDPWVALEEGSGEPVNKSMALWTKQKGYPAVSVKVND

SEQ ID NO: 141442 - protein, 429 aa, Glycine max
  Coding DNA Sequence Number=SeqID_49757
  Gene Ontology: Mol. function=drug transporter activity; Cellular component=integral to membrane; Biological process=response to nematode
  Homolog annotation: Hit_ID=A7PH11; Match level="QueryCoverage=98%, HitCoverage=98%, E-value=1e-156, Identity=60%"; Hit description =Chromosome chr17 scaffold_16, whole genome shotgun sequence
  Pfam annotation: Domain name=MatE; Domain location=211-371; Score =74.2; E_value=4.4e-19; Accession=PF01554.9; Description=MatE
  Pfam annotation: Domain name=MatE; Domain location=47-206; Score =92.1; E_value=1.7e-24; Accession=PF01554.9; Description=MatE
  Pfam module annotation: Pfam domain module=MatE::MatE; Domain location=211-371::47-206
MERGDQNQSASLQSPLIKHSHSSSSGRGIERREVIEEVKKQLWLAGPLISVTLLNFCLSIISVMFVGHLGELSLSGASMATSFASVTGFSLLVGMASSLDTFCGQSYGAKQYHMLGIHLQRAMFTLMIVSIPLAIIWANTRSILTFLGQDPEIAAEAGSYASSAITTLLHVLICWILVFKSGLGNRGAAVANSISYWLNVTILSLYVMFSPSCAKSWTGFSKEALHNIPSFVRLAIPSAVMVCLNTTAAAWMIPFGLSGAGSIRVSNELGAGRPWNARLAVRVVLVLAIIEGIIVGTVMILVRNIWGYAYSNEVEVVEYVATMFPILAASNFLDGLQCVLSGTARGCGWQKIGAFVNLGSYYIVGIPSSIVFAFVLHIGGKGLWLGIICALIVQMCSLMIITIRTDWDQEAKKATDRVYNSVTLESLVS

SEQ ID NO: 141443 - protein, 478 aa, Glycine max
  Coding DNA Sequence Number=SeqID_49758
  Gene Ontology: Mol. function=hydrolase activity
  Homolog annotation: Hit_ID=A5BVW5; Match level="QueryCoverage=97%, HitCoverage=89%, E-value=1e-137, Identity=53%"; Hit description =Putative uncharacterized protein
  Pfam annotation: Domain name=Abhydrolase_1; Domain location=207-461; Score=-13.1; E_value=0.06; Accession=PF00561.11; Description =alphabeta hydrolase fold
MEKKGGKRRSICTADELHRVAVSNSNWKLALWRYRPSPEALSRNHPLLLLSGVATNAIGYDLSPESSFARYMSAQGFDTWILEVRGAGLSTLGDSLEEDEECLKNFSKIDSVINDDIGESSASFVSEVPHMKTRGSEVVTKYEEMQLMTRFMEILTRISERLAGFLNGDLLEGQNSAIAGQIKDFNRRLRAIIEGQLLFPAKILELQDRFAANLEEFQKQLELMVKYDWDFDHYLEEDVPAAMEYIRAQCQPRDGKLLAIGHSMGGILLYAMLSSCCFDGKDPGLASVVTLASSLDYTPSRSSLKLLLPLAKPTRVLNIPVIPVGPLMATVHPLASYPPYVLSWLNSQISAQDMMDQKLFEKLVLNNFGTVPSKLLLQLSSVFQKGGLRDRSGTFFYKDHLHKSNVPVLAIAGDRDLICPPEAVYETVKLIPDELVTYKVFGEPGGPHYAHYDLVGGRLAADQLYPCITEFLIHHDTV

SEQ ID NO: 141444 - protein, 45 aa, Glycine max
  Coding DNA Sequence Number=SeqID_49759
MDSTYTNYSRCVSCQQWYSNPCPFGPVPETGALDQIGHLNFGVLK

SEQ ID NO: 141445 - protein, 117 aa, Glycine max
  Coding DNA Sequence Number=SeqID_49760
MEIADFVPVCGSMKRYRRKRSTYHKLKRGKEVSDCSSVENGCMLRPKVKMVEEEIPKAHHQPPTNKIRLSINLWKRLRNAYVQRMLGLAEHVAHLNNGEICFLKKIHDDEVQLLLAS

SEQ ID NO: 141446 - protein, 31 aa, Glycine max
  Coding DNA Sequence Number=SeqID_49761
MKEKEENKRKRRKHVEKEKYGQTEQREHVIV

SEQ ID NO: 141447 - protein, 130 aa, Glycine max
  Coding DNA Sequence Number=SeqID_49762
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=40%, HitCoverage=50%, E-value=4e-23, Identity=98%"; Hit description=LacZ protein
MSLPKLRMKNGPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSVTATLASADVRRCFCRYAPPRQ

SEQ ID NO: 141448 - protein, 375 aa, Glycine max
  Coding DNA Sequence Number=SeqID_49763
  Gene Ontology: Mol. function=carbohydrate binding; Cellular component= cytoplasm; Biological process=carbohydrate metabolic process
  Homolog annotation: Hit_ID=A7PH86; Match level="QueryCoverage=59%, HitCoverage=65%, E-value=2e-86, Identity=67%"; Hit description =Chromosome chr17 scaffold_16, whole genome shotgun sequence
  Pfam annotation: Domain name=Aldose_epim; Domain location=77-368; Score=154.9; E_value=2.2e-43; Accession=PF01263.11; Description =Aldose 1-epimerase
AFKFHSLSLGFISIYIVESGTTSLLRIIDAPFHDKLYFAVANQPCLLDVRIDAMYTKPSNQSNFICRHQIKKVMLEPRRKNSKHKVGFCMLTLGLVEVVNKIAPNHAREYYNNRKRLNLSPSSTTQQGGNVGFDKKVWEIVEHKKGETPSITFKCHSHDGEECYPGDITVTSTYTLTSSTTLRLDMEEVPKDKPTIVNLAQHTYWNLAGHNSGNILDHSIHLWANHITPVDENTVPTGEIMLVKGTPFDFTSFNRIGSTISQVGLGYDDNYVLDCGEEKEGLRHTAKVRDPSSSRVLNLWTNAPGVQFYTTNYVNGVQGKGGAIYGKHVGLCLEIQEFIQFEDEDMSQVGKEDEDVEMKKTQATLNMESFVVGDV

SEQ ID NO: 141449 - protein, 234 aa, Glycine max
  Coding DNA Sequence Number=SeqID_49764
MEEDQQCEFSQRRSQADGFDEEAIAQHLCISGQDFSRTTAGRWVRIMHTSMTTLTQIWMTLLLSNVLPSDHNFDLPLPKCQLVYAILTRMSVHVAQVIVDAIYLFVGMAPTRHPLDPEKSNRAPGFPALITGLCQFYGVQVAPNKYCTPRQAQGDAHQAAGASLPPRQADLVGPLTVEQYLQHLVCQQAANHHGQVQIHECLDRFSLSQQGHGSAPFVCLTPKQFGAEVVWPGD

SEQ ID NO: 141450 - protein, 85 aa, Glycine max
  Coding DNA Sequence Number=SeqID_49765
MEAITNGMMNLNRQRHQHLVALRIIFAHETAGNRRGIHSRAMKTFQFAHGKRCNKGEHYPISPAHRLSLPYEIPDEHSSGGQECE

SEQ ID NO: 141451 - protein, 59 aa, Glycine max
  Coding DNA Sequence Number=SeqID_49766
MVEGGGGSEVRQGAVVDQAYRYRRPRGGARCINESANARGEAVCVLGASGVYTGLLCWH

SEQ ID NO: 141452 - protein, 51 aa, Glycine max
  Coding DNA Sequence Number=SeqID_49767
MSVKNHPGALRSLKEHSNPVTPKAYTPKSPLGPLPPDSGPTPKIILAHRHY

SEQ ID NO: 141453 - protein, 25 aa, Glycine max
  Coding DNA Sequence Number=SeqID_49768
MELSSSFFRNLLKQASLGGELSYER

SEQ ID NO: 141454 - protein, 59 aa, Glycine max
  Coding DNA Sequence Number=SeqID_49769
MPLGGGGVKLHHFLPLEKDLTSNPEVLETLGFFLQHMIRSKNPFLGHLPMRENGSSPTQ

SEQ ID NO: 141455 - protein, 210 aa, Glycine max
  Coding DNA Sequence Number=SeqID_49770
FTFCKPPIRKNHNLGTNISHHSSSVNGEGTSHKDPLSRILDELSSLNLWREKLERKEKGKERVEINQDEREQIREEEKRKILKELRKEKHASYSSHDSCKSLSEELCDYYEGRHRSHLRPHSYRKEKERKPQEANINLPYFHGKDNVEAYLDWEIMIEQQLKRKSTSKSYGFHSYPKKDQGQGILGVASSKPKDDKGKTIEKQPPKASMC

SEQ ID NO: 141456 - protein, 73 aa, Glycine max
  Coding DNA Sequence Number=SeqID_49771
MGSSQKPSLKKRFYQVKIKSLEYYDQPLRCFTFEDFQLVPTVKEFEEILGCPLGGRKPYLFSGFYPSTTRVAK

SEQ ID NO: 141457 - protein, 98 aa, Glycine max
  Coding DNA Sequence Number=SeqID_49772
MAAQLIRDRVEMECLKGAWETLEGNTRCRFRGTIRFTATSLVHPDEPARTLQRTVEWTTPWISFEFDNCIHVAEATTVDTFALDDTIYFVKLPYFGQL

SEQ ID NO: 141458 - protein, 171 aa, Glycine max
  Coding DNA Sequence Number=SeqID_49773
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=72%, E-value=3e-24, Identity=70%"; Hit description=LacZ protein
MKHFTDTLISANIKNTEIATSVIWLTQASDVWNALRNRFSQGDYIRISNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141459 - protein, 173 aa, Glycine max
  Coding DNA Sequence Number=SeqID_49774
  Homolog annotation: Hit_ID=Q6UUU1; Match level="QueryCoverage=34%, HitCoverage=40%, E-value=1e-18, Identity=78%"; Hit description =Putative uncharacterized protein
SGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNSLQAGLYARTPRSVRPLRLIRGVSLEVMRRVKAKLKGQVLVTALLQARLPRFKELVSSENLRKTALAR

SEQ ID NO: 141460 - protein, 191 aa, Glycine max
  Coding DNA Sequence Number=SeqID_49775
MDAHPCQDGVHQLALRHGEVGIMIGGQDVAEQQSHPYLSQGGHLGDGLLIEPIRPVPPLAILAFLALFQYHRISQELADSVGIERDPLTPNPGSHVTHALLCWPSIGIKLKDYFRIKLGHGSNQWCPPPAPYFLLEISILVVPELDASLPEKRPSLDGFEALLVYNAPKAVTVVLRGGTSSFGRLVLPGPL

SEQ ID NO: 141461 - protein, 165 aa, Glycine max
  Coding DNA Sequence Number=SeqID_49776
  Gene Ontology: Mol. function=transporter activity; Cellular component= outer membrane-bounded periplasmic space; Biological process=transport
  Homolog annotation: Hit_ID=Q0K422; Match level="QueryCoverage=98%, HitCoverage=53%, E-value=7e-53, Identity=54%"; Hit description=ABC -type transporter, periplasmic component: POPT family precursor
TLALPDWDPSHIIAVAAKLSGSDAAHWQQGQAKLKALIPNIKSFYTDDANSQQLISTGETPLAIPKEGAILGVDTVGINKGSKHADLAYKFINIALKPEIQQQVAKIYRGSPTVTNAHIDPELAKLPGMLTTPAQWNATINTDPQLRAEKTAEWRQWFSENIMSH

SEQ ID NO: 141462 - protein, 131 aa, Glycine max
  Coding DNA Sequence Number=SeqID_49777
MERIMIDPASGGALGDMTLVDASNLIEKMVSNSQQFSARNDAIVLRGVHEVATDLSSSTENKKLEGKLDALVNLVAKLAMNQKSASAPVARVCGLCSSIDHHTDLCPSLQQSGVNEQPEAYAANIYNRPPQ

SEQ ID NO: 141463 - protein, 110 aa, Glycine max
  Coding DNA Sequence Number=SeqID_49778
NRGRTEEERGSAFLALRIHWKLLRKIVSLEENLSRSASVTFPWVITRRFSTVLRHSSFVLRRSSVFNRFLRFFRSFPQINVGGDSAHLSSFGKRTREPRLALPPKGMLRQ

SEQ ID NO: 141464 - protein, 222 aa, Glycine max
  Coding DNA Sequence Number=SeqID_49779
  Homolog annotation: Hit_ID=Q2HW90; Match level="QueryCoverage=58%, HitCoverage=30%, E-value=3e-17, Identity=36%"; Hit description =Putative uncharacterized protein
MVSIWDLARVEVSMEPIASLAQYYDQPLRCFIFGDFQLSPMVEEFEEILGCPLGGRKPYLFSGFYPSLGVLFPNVDGLVDLAAIDVFLAYHNHRESPVVAMLADLYDTFDRRCEESNARIVCCTPALYVGLVSHLFLQEGRPVYPLEEGRIKILSSCEGCPNVPLMGKRGCINYNPVLAIRQLGYPMRGVPSNESITPFIARGFSDHNARVLQGVRKAWDAA

SEQ ID NO: 141465 - protein, 84 aa, Glycine max
  Coding DNA Sequence Number=SeqID_49780
  Subcellular localization annotation: CTP_CleavageSite=21; ConfidenceScore=5.11e-01
MASSGTPAIFTMLQMSMHVARCAYRSSLASSSMDDLLLSQPTLRREGDARAHGCVFQGRKMHGVANNIYSRKTSDKPECVVYEL

SEQ ID NO: 141466 - protein, 47 aa, Glycine max
  Coding DNA Sequence Number=SeqID_49781
MDSRNQSRYIGTDASGGGVTTDRSLPLLCVKQAENVAARQPIIDAYF

SEQ ID NO: 141467 - protein, 289 aa, Glycine max
  Coding DNA Sequence Number=SeqID_49782
  Gene Ontology: Mol. function=motor activity; Cellular component=cell projection
  Homolog annotation: Hit_ID=P15305; Match level="QueryCoverage=99%, HitCoverage=93%, E-value=1e-14, Identity=25%"; Hit description =Dynein heavy chain
GLHVLAFRELNVLPFRGLHVLVVTGLQVLAFRGLHVLAFRGLHVLLFRGLHVLALRGLHRTTRPRLQRTKCPQLQRTTCPRLQRATRLHVLAFRGLHVLTFRGLHVLAFRELNVLPFRGLHVLVVTGLQVLAFRGLHVLAFRGLDVLACRGLHVLAIRGLHVLLFRGLHVLALRGLHVLAFRGIHILLFRGLHVLAFRGLHVHAFRGLHILPYRGLHVLAVRGLHVLAFRGLHVLNFRGQHVLAFRGLHVHPISGLHILSFRGLHILGIRGLHILAFRGLHVIAFRGLH

SEQ ID NO: 141468 - protein, 155 aa, Glycine max
  Coding DNA Sequence Number=SeqID_49783
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=33%, HitCoverage=50%, E-value=4e-24, Identity=100%"; Hit description=LacZ protein
  Subcellular localization annotation: CTP_CleavageSite=20; ConfidenceScore=5.15e-01
NSYDHDYAKLEINPPLKGTKAGTRAPPRGRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141469 - protein, 126 aa, Glycine max
  Coding DNA Sequence Number=SeqID_49784
  Homolog annotation: Hit_ID=UPI00006A2D9E; Match level="QueryCoverage =99%, HitCoverage=87%, E-value=2e-13, Identity=18%"; Hit description =UPI00006A2D9E related cluster
LHVLAFRGLHALAFRGLHILTFRGLHVLSFRGLHALAFRGLHALAFRGLHALAFKGLHALTFRGLHVLTFRGLHVLTFRGLHALTFIGLHALSFIGLHVLAFRGLHILAFRGLHICAFRELKVFSP

SEQ ID NO: 141470 - protein, 143 aa, Glycine max
  Coding DNA Sequence Number=SeqID_49785
  Gene Ontology: Biological process=transposition, DNA-mediated
  Homolog annotation: Hit_ID=Q1J7G7; Match level="QueryCoverage=23%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDGKEFKTSLAKIVKPRLY

SEQ ID NO: 141471 - protein, 73 aa, Glycine max
  Coding DNA Sequence Number=SeqID_49786
MLLSSNIIYICVRVFMLVRMIHTRLFAAARVKSCPGMHSSCVIASLSGCTCIAGPPPGSEGGPGTDKRKLLAP

SEQ ID NO: 141472 - protein, 144 aa, Glycine max
  Coding DNA Sequence Number=SeqID_49787
  Homolog annotation: Hit_ID=A5BEV8; Match level="QueryCoverage=95%, HitCoverage=24%, E-value=1e-18, Identity=33%"; Hit description =Putative uncharacterized protein
MAKSFVGHSYTGRLTKDEKIVVADMMKFIVKPRNILLTLKEHNDNSYTTIKQIYNVRHAYRSSIRGSNTEMQQLMMLLDRDQYIHWHRLKDDNVWFQGLFMRVDALPGVIVTDRDLSLMNAMKTIFLDATNLLCRFHIDKNVKA

SEQ ID NO: 141473 - protein, 80 aa, Glycine max
  Coding DNA Sequence Number=SeqID_49788
MVSRYALHEIAVEYERVAYAGKNPSRCGCVMRNTHGLPCAYQGLSETQVTITEEMETISKHFQQLDVCGKIHLKSKLQLA

SEQ ID NO: 141474 - protein, 81 aa, Glycine max
  Coding DNA Sequence Number=SeqID_49789
MSFNSRHVTELHRLPNDGRQAQNDHNLSLRAIGHDRARMERHRMTIICLCMPSDTIASGWRKGVRNDHNLSPPSTRLTAPE

SEQ ID NO: 141475 - protein, 137 aa, Glycine max
  Coding DNA Sequence Number=SeqID_49790
DSLEDQASQVSFVPHGRLGSPDYCHWATRTPWSYVCCWSRCDHQAILWIGSTNLLHFFLHGSQRTRAANSTNQGPAGGVDHRKSDLADDVILQLDPVSVSVTDSIIGTCTVSTKRSCVDPSMTDPDTGDSDKCRLYI

SEQ ID NO: 141476 - protein, 273 aa, Glycine max
  Coding DNA Sequence Number=SeqID_49791
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDSSFVVGSRKIHIVFLTAHMGRSASYTKKRKWGMYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141477 - protein, 32 aa, Glycine max
  Coding DNA Sequence Number=SeqID_49792
VVLVWFRTCKVILQDSGTLKRVAWGLDVGTRV

SEQ ID NO: 141478 - protein, 224 aa, Glycine max
  Coding DNA Sequence Number=SeqID_49793
  Homolog annotation: Hit_ID=UPI00006A2D9E; Match level="QueryCoverage =93%, HitCoverage=98%, E-value=7e-10, Identity=18%"; Hit description =UPI00006A2D9E related cluster
HALTYRGPPILTFRGLHALAIRGLHVLTFVGLHALAIRGLHVLTFRGLHALTLRGLHVLTIRGLHALTSRGLHILVLRGLHALTFRGLPALALGTSYPHLQRTTRPHHFRGLHALAIRGLHVLTFVGLHALTFRGPPTSSPSEGYTPSPSEDYIGLHALTSRGLHILVLKGLHALTFRGLPALALGTSYPHLQRTTRPQLQRATRPRHQRTACPHLRRATRPHL

SEQ ID NO: 141479 - protein, 73 aa, Glycine max
  Coding DNA Sequence Number=SeqID_49794
  Subcellular localization annotation: CTP_CleavageSite=60; ConfidenceScore=5.75e-01
MTPSRESTSGSGSSSPSEKSRASTAGSGGNSSGSSSGSSSDDNTSITWTGSTSRYGVGVVIEAVPESNKHENA

SEQ ID NO: 141480 - protein, 159 aa, Glycine max
  Coding DNA Sequence Number=SeqID_49795
MDWQFVWLIQITNPPQQWLHNKSDIEEERLTVRKEKTRTTTVAMIGGMNSGGSAKKKKQTMKEKKAQGGRPKPVNIPNHPKLITNNNIDSTTTKSKKNKIGGGCVHKLMMRGEVVDVEQIDGGDAWNSTKWVCVRSRGCRSKLHDDEPSNFDDAKSPSD

SEQ ID NO: 141481 - protein, 264 aa, Glycine max
  Coding DNA Sequence Number=SeqID_49796
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSINSLDAEPISFSGKLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141482 - protein, 96 aa, Glycine max
  Coding DNA Sequence Number=SeqID_49797
MIWVPKGSVIHTNTQGDASSIGACRPRIFFINGFLYFLEDEWQRNGERERERRRHFKEKMSLEEAHHHRRPWIRAWRKKEMNEGRGREEHEILCSK

SEQ ID NO: 141483 - protein, 260 aa, Glycine max
  Coding DNA Sequence Number=SeqID_49798
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGSTPPAPAVGAQRTNERVDPDLATHEESNGRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141484 - protein, 267 aa, Glycine max
  Coding DNA Sequence Number=SeqID_49799
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNSIVRLGGVDDDPPVAELAADDVGAAAADGDGAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141485 - protein, 67 aa, Glycine max
  Coding DNA Sequence Number=SeqID_49800
MGSFGEAGWEWEFSWRRNLFDNELGRASAFIEQATTLSPNAALKDYWVWGADPKGIFTTRTAYLCIK

SEQ ID NO: 141486 - protein, 308 aa, Glycine max
  Coding DNA Sequence Number=SeqID_49801
  Gene Ontology: Cellular component=integral to membrane; Biological process=protein insertion into membrane
  Homolog annotation: Hit_ID=A8G7P8; Match level="QueryCoverage=100%, HitCoverage=56%, E-value=1e-171, Identity=94%"; Hit description =Inner membrane protein oxaA
GKLITVNTDVLSLTINTRGGDIEQAKLLAYPDTLGSSTPFQLLETTPSFVYQAQSGLTGKNGPDNPANGERPLYQAAQDSYTLPEGQDELRIPLTYTDKDGAVYTKTFVLKRNHYAVGVDYSIDNKGATPLELTLFGQLKQTTELPKHRDTGSSNFALHTFRGAAYSSSEDKYQKYAFDKDENLSVTTKDGWVAMLQQYFATAWVPATKGDNTFYTAKPGDNLSTIGFKSTPVVVQPGAQQQLNATLWVGPELQDQMAQLAPHLDLTVDYGWLWFISQPLFKLLKFIHGFIGNWGFSIIIITFIVRGI

SEQ ID NO: 141487 - protein, 50 aa, Glycine max
  Coding DNA Sequence Number=SeqID_49802
MDLRSNPFQGVGNDAILPPPKALDRRLQEDWARDAKEDPRVLMSLRGSIM

SEQ ID NO: 141488 - protein, 61 aa, Glycine max
  Coding DNA Sequence Number=SeqID_49803
MENKINNNELKPWIFLINGVLCFLKMNGSRMEKEKDDWRRHFKEKMNLEEAHHHRKPWIRA

SEQ ID NO: 141489 - protein, 131 aa, Glycine max
  Coding DNA Sequence Number=SeqID_49804
MSLATLFGKLQEHEMELMRLHQHDENDIKRKGITLRTSSSFIQEESDKEDLTETEEDDDDFRLFVKRKGPATRAMSKRLQEDWARVDKEGLRVLMNLRLLKEVFSKKLLKEVFLRKLLKEVFLRKLLKEAI

SEQ ID NO: 141490 - protein, 234 aa, Glycine max
  Coding DNA Sequence Number=SeqID_49805
  Homolog annotation: Hit_ID=Q6WAY6; Match level="QueryCoverage=75%, HitCoverage=29%, E-value=7e-16, Identity=33%"; Hit description =Putative uncharacterized protein
MAILADLFDTFDRRCEKNSARIVCCLPALCVWLISHLFQQDTRHPCPLRSYRSCTEKGRVDWDQHLAEIGGSAINWFPRWKEGKEGVLFSCGDYPNVPLIGTRGCINYNPALAIRQLGYPMRGAPTEGSLSPFLLKDLGAQGLKVIQRIHKAWRSPLRKDKELRGIRNGVIGGYHGWLRIHTRGLDWLSKLKVIDEENFEAPEEDEEVRALKLELGKARLAKEKFKSAATHIQK

SEQ ID NO: 141491 - protein, 39 aa, Glycine max
  Coding DNA Sequence Number=SeqID_49806
MVKARQKGGKRGRWLPPSSPRRAGLLPAEGTVFCWNTLE

SEQ ID NO: 141492 - protein, 77 aa, Glycine max
  Coding DNA Sequence Number=SeqID_49807
MSLKKCTTAPCVGYHGTKVKDDDECSNDESIKKGPLAKVLWYLPIIPRFKHLLLVQMTQKTLHGMQMGKIMTKCSTI

SEQ ID NO: 141493 - protein, 277 aa, Glycine max
  Coding DNA Sequence Number=SeqID_49808
MAKFDPDIVLEFYANAWPTEEGVRDMRSWVKGQWIPFDADALSQFLGYPLVLEEGQECEYGQRRNQADGFDEEAIAQLLCIPGQDFARTAAGRRVRIMRTNMTTLTQIWMTLLLSNIQPSDHNSDLPLPKCTLDPDKSNRALGFPALITGLCQLFGVPVAPSKVIQPPITQAFIEKYCTQRPAQGDATQAAEAPPPHQAGPAGSFDSEQYLRHVSQGFTSFPCPTPDQFRAKVAWPGDWPEAQAGEAPVEAPGEADEAREDEEMTDVLDFLGGSGAT

SEQ ID NO: 141494 - protein, 56 aa, Glycine max
  Coding DNA Sequence Number=SeqID_49809
  Subcellular localization annotation: CTP_CleavageSite=50; ConfidenceScore=5.66e-01
MSGRSSTRQFPSWKSGGHGRTKSKASFTFLSPTRALTTVLPSRDASFHVRLSGLIA

SEQ ID NO: 141495 - protein, 161 aa, Glycine max
  Coding DNA Sequence Number=SeqID_49810
MGEAEEVQEKMKADMEAMKEQMATTMEARMSMKKIMEAKCGKDLGSTDDPMMCKFKTSTPSRHMACLPNYTPPNVAYIPNEDVNNSTHILIKSQQPQSDHAHVSRPMEETHEIPHHDLADFEPCLGYATEGQAVGGIPLQNTLEGPQCHPQPQPSHSTALV

SEQ ID NO: 141496 - protein, 100 aa, Glycine max
  Coding DNA Sequence Number=SeqID_49811
  Subcellular localization annotation: CTP_CleavageSite=78; ConfidenceScore=5.00e-01
MKAQTYQGNPCGVYPDLSSFTGSGVYPDLSSFIGSGVYPDLSSFTGSGVYPDLSSFTGSGVIQISVACIKRSTPRNVRSPSSGDASFLNLNRSSFLADVG

SEQ ID NO: 141497 - protein, 42 aa, Glycine max
  Coding DNA Sequence Number=SeqID_49812
MTPVNRKAGTGERTREPPGGNAWGAEPTGINALPRLKPPLPN

SEQ ID NO: 141498 - protein, 287 aa, Glycine max
  Coding DNA Sequence Number=SeqID_49813
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDFKKLGKRKTWLLFTQIALVLGVVALALTQFDYGLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141499 - protein, 241 aa, Glycine max
  Coding DNA Sequence Number=SeqID_49814
  Homolog annotation: Hit_ID=A5C169; Match level="QueryCoverage=66%, HitCoverage=13%, E-value=5e-07, Identity=26%"; Hit description =Putative uncharacterized protein
  Subcellular localization annotation: CTP_CleavageSite=41; ConfidenceScore=5.46e-01
MAEPSKKRKGSSSTAAAAAHRRHRPSEASTAPTHPSLSSPRSSTLFSSDDQRLRQGAPFEGTIVDDWKFDYSSHDARRMFCNDQAEMTGRLLAGSLSFDNRIMHYIIVRILLPRSSNLAQASEEDLILMWAFLTGRQIDWAHLVRYRMHKALRANAHLPYPHLITLYLRHFQIPLDDEPFLQVKRSFAIGAGAVTSFGYRKDRNGQWLKKDALPPQDERTPSAPPQREDSALMNEVIASTR

SEQ ID NO: 141500 - protein, 150 aa, Glycine max
  Coding DNA Sequence Number=SeqID_49815
  Gene Ontology: Biological process=transposition, DNA-mediated
  Homolog annotation: Hit_ID=Q1J7G7; Match level="QueryCoverage=27%, HitCoverage=71%, E-value=2e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDIVSQKGIEIDPEKVKAILEMPEPHTEKQ

SEQ ID NO: 141501 - protein, 96 aa, Glycine max
  Coding DNA Sequence Number=SeqID_49816
LITGLCQSFGVPVAPTKVIRPPITRAFIEKYCTQRQAQGNTPQAAGAPPPPHQAGPAGSFDMEQYLRHLVRQQAANHRAHVQTHDCLYQMSLSMQS

SEQ ID NO: 141502 - protein, 296 aa, Glycine max
  Coding DNA Sequence Number=SeqID_49817
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIDGLCVRVGALRCHSQAFTIKLKKDVSIPTDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141503 - protein, 141 aa, Glycine max
  Coding DNA Sequence Number=SeqID_49818
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=60%, HitCoverage=72%, E-value=3e-24, Identity=69%"; Hit description=LacZ protein
MPGCGSAMPRHAHINHLSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141504 - protein, 125 aa, Glycine max
  Coding DNA Sequence Number=SeqID_49819
MDEVEKVQEQMKADMEAMKEQMAHEIPHHNLADFEPCLGYATEGQAVGGIPMPNTLEGPQFRPQPQPLHFAVGRAPPAMAEKGKVDHLKERLRAIEGGEDYAFANLEKLFLIPKHGHSQVQGAGL

SEQ ID NO: 141505 - protein, 186 aa, Glycine max
  Coding DNA Sequence Number=SeqID_49820
MGEVDEVQEQMKADMEAMKEKMATMVEAMMSIKKIMKANTVAIAATSAVAKVNPMPPSDLNQMNHPTSARAGKDLGSTGGPYYAQIKNKHAFPPYGLPPNYTPPNVAYTPNEDTHEIPHHNLADFEPCLGYATEGQAVGGIPLQNTLEGPQFCPQPQPLHFTAGKIPPIMEGKGKVGSSGGKAQGH

SEQ ID NO: 141506 - protein, 295 aa, Glycine max
  Coding DNA Sequence Number=SeqID_49821
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMVICMTYLLMKNRLVSKPYNSSSKLLCSRHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141507 - protein, 76 aa, Glycine max
  Coding DNA Sequence Number=SeqID_49822
MAAEWRRKRERRGHFKEKMSLEEAHYHRRPWIRAWRKKEINEGRGREEHEIFCSKRALKSEPTNPRSSPRFSTKCA

SEQ ID NO: 141508 - protein, 141 aa, Glycine max
  Coding DNA Sequence Number=SeqID_49823
MLITQKIRPVVILFHYGESWNLLRADQRFIFAKSWPRASRYQQGHQDLFILRSDLPSQHRRTSALASVAVTLRVTTTPAAFNAPLQGASHSPFRLRNCWEGRSVRASSLLRQLAKGGCAARRLSWVTPGFSQSRRCKTTAS

SEQ ID NO: 141509 - protein, 85 aa, Glycine max
  Coding DNA Sequence Number=SeqID_49824
MVGYTPSSFTDLVFASERIEVVLKGGKFNHPAWTTEKTRANEEGENEGETHVATAIPTWPNFPPAQQCRYSANNNHSPYPPPSYP

SEQ ID NO: 141510 - protein, 66 aa, Glycine max
  Coding DNA Sequence Number=SeqID_49825
MRDMGHEDEEEDDDDNNNNNDDDGGGGGDDDDNDGDHVPQQQHTITPEDTTKKKAFNIASLTSVIS

SEQ ID NO: 141511 - protein, 69 aa, Glycine max
  Coding DNA Sequence Number=SeqID_49826
  Subcellular localization annotation: CTP_CleavageSite=41; ConfidenceScore=5.23e-01
RVSSSTVSDPSFLGDPRSGSFFRGQGCHQKFSLGQGLSGVSSKDFASSIVERELRHDVCQGLVWPAVQG

SEQ ID NO: 141512 - protein, 171 aa, Glycine max
  Coding DNA Sequence Number=SeqID_49827
MIVTVRPERVVRQFGYIQSIPPLPVSARLSHDQIDDRWMEFADHLLPAGQLCLVPEQVSADYMEWFFRISHPFMTPTQAGDQQRDAPAVDPEDYIQPSSPQVPVAFDPPPHVDDYEGYEAIAQRLERVLNLRIVIAGTELYDIMQDCLTIARGGPSVDGTVRARQRHRTDH

SEQ ID NO: 141513 - protein, 107 aa, Glycine max
  Coding DNA Sequence Number=SeqID_49828
  Homolog annotation: Hit_ID=A2Q1D6; Match level="QueryCoverage=43%, HitCoverage=7%, E-value=3e-09, Identity=61%"; Hit description =Ovarian tumour, otubain, related
IIRSDTNTGSRGRTSFVLIGCERSGEYRCRKKEFVRRDTGTRKCGCPFKLCGKPVVGGQDTTYKTNRYRLPLLDFVGVTPTGTTFSAGFAYLEDKRLNNVVWALERF

SEQ ID NO: 141514 - protein, 136 aa, Glycine max
  Coding DNA Sequence Number=SeqID_49829
MQQGQADILIARFPDPNYGVKTVFSKEAQNIQWWFQSSKRCKDKLKLTRNKHRITVTSRKTTKVRPSFILNQNREASLEDSASVEGFLWVWGFNGEQWRFVVAVSDGERAWDIGNGFGRKKEKKMAFFQGYMKSKG

SEQ ID NO: 141515 - protein, 86 aa, Glycine max
  Coding DNA Sequence Number=SeqID_49830
  Homolog annotation: Hit_ID=A0ST23; Match level="QueryCoverage=29%, HitCoverage=51%, E-value=3e-07, Identity=100%"; Hit description =Putative reverse transcriptase
MARRPSVAHQVLLFPLVRVNFELGVIMVIAVSFGKPVVPAALMNRPTRGERRFAYWALAECILAYYVGTDEGVSEVLHVAGEKRLH

SEQ ID NO: 141516 - protein, 290 aa, Glycine max
  Coding DNA Sequence Number=SeqID_49831
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSITNASSIVISSQKHIDFALTSPYGGGRPGRTKRKRAKSAELLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141517 - protein, 215 aa, Glycine max
  Coding DNA Sequence Number=SeqID_49832
  Gene Ontology: Biological process=transposition, DNA-mediated
  Homolog annotation: Hit_ID=Q1J7G7; Match level="QueryCoverage=21%, HitCoverage=78%, E-value=2e-15, Identity=76%"; Hit description =Transposase
YDGVFEVLQWLLFLSAVPPVQLLTGWCVTAKAPPDISAGKCSGRVPFAIQAAQLLGRAIGAGLFAITPAGERGMCCKAIKLGIRYSKSSRDAEDAGFNDAIAEDRTDQFVNTLQPELEALENKKDDFIGDFSKMGGARYQLLFPLVRVNFELGVIMVIAVSFGKPVVPAALMNRPTRGERRFAYWALAECILAYYVGTDEGVSEVLHVAGEKRLH

SEQ ID NO: 141518 - protein, 295 aa, Glycine max
  Coding DNA Sequence Number=SeqID_49833
DFQLVPTVKEFEEILGCPLGGRKPYLFSGFYPSTTRVAKYQGSVWRKGQRPWQIKANGLSFIDILALLIFGVVLFLNMEGLVGSVWRKGKRPWQIKANGLSFIDILALLIFGVVLFPNMEGLVDLAAIDAFLAFHHGKESPVVAILAMYDTFDRGCEKSDARIEGRIRILSSCEGCPMRGVPSDESITPFIARGFSDHNVRDRELRGSSNGIIGGYHKWLRVRTQGLDWLPNLKTVRDDEVKASEESDEVQALKAELERAWVVEEKFKAAIVSSSSEEVKGIITGQRHDLEGRAK

SEQ ID NO: 141519 - protein, 69 aa, Glycine max
  Coding DNA Sequence Number=SeqID_49834
MAVVGGAGLDDEGMSSVLALFLDAIYKKGIQTTTKNQNKNFTKYGSLANRVVQLRKCRNELRLAYGSSA

SEQ ID NO: 141520 - protein, 161 aa, Glycine max
  Coding DNA Sequence Number=SeqID_49835
MGKAEEVQEKMKADMEAMKEQMATMMAMMSMGKIMEANAVAVAATSTVAKVNPMPPSGLNQMNHPTSAMIWEVRAALLCANSKQARLPAIWLASQLTTPNVAHTPNENVNNSTSILIESQQPQTYHAHASQTMGETHEIPHHNLADFESCLRYTTEGQAVG

SEQ ID NO: 141521 - protein, 60 aa, Glycine max
  Coding DNA Sequence Number=SeqID_49836
MSRKAIREILVRWLDDLRQNNKKEVKQKLRRMKPETSLKIKEEVKKQFDIDFLAVARYPE

SEQ ID NO: 141522 - protein, 69 aa, Glycine max
  Coding DNA Sequence Number=SeqID_49837
  Subcellular localization annotation: CTP_CleavageSite=34; ConfidenceScore=5.12e-01
MYPLLFSVTTTQVDVPSTCTTKDVPSNVLRQSSQADKVWKPENSERFLATEEEEEEVQKDIQRLCRKVV

SEQ ID NO: 141523 - protein, 130 aa, Glycine max
  Coding DNA Sequence Number=SeqID_49838
MTTLTRICMTLLLSNILPSDCNADLPLQKYQLGSHPQDTQWTRRSPIGPWGFQLWDHARKTPCGPGEVQQGLGVASSDYGPLSVLRGACCPQQARQAQGETPQQPRDGRQRATDAPPPPLEFTSAYPQKG

SEQ ID NO: 141524 - protein, 192 aa, Glycine max
  Coding DNA Sequence Number=SeqID_49839
  Homolog annotation: Hit_ID=A0ST23; Match level="QueryCoverage=14%, HitCoverage=55%, E-value=3e-08, Identity=100%"; Hit description =Putative reverse transcriptase
VPPVQLLTGWCVTAKAPPDISAGKCSGHAARRVPFAIQAAQLLGRAIGAGLFAITPAGERGMCCKAIKLGNARVFPVTTFRGVDKEYEYDDDECIKHLWLCRCGCCCVPYIIALAAEQIFLRFISVVSIRFLTAFRFYQFIKLIDTVDLEGGPVGKPVVPAALMNRPTRGERRFAYWALAECILAYYVGTDE

SEQ ID NO: 141525 - protein, 93 aa, Glycine max
  Coding DNA Sequence Number=SeqID_49840
MGSPKGSLIFANDSVDLRLQWRIMVSISCSSCSVLTGNWLSASQFGTQAYQPEASGASVKPGVPKSELTHHHPRSRSNCAAFQSGNLSCHSLH

SEQ ID NO: 141526 - protein, 119 aa, Glycine max
  Coding DNA Sequence Number=SeqID_49841
MNLLPSAVHVSPPPSSLEPAEVIGLALFANSPFSTFFGAPCIYLPSTCSCVLHLNESGAPRSYCVALFANSPISTFFRSHMTSFPSTVHASSTNASRLPAKLLRSAVRQSPFSTFFGAP

SEQ ID NO: 141527 - protein, 129 aa, Glycine max
  Coding DNA Sequence Number=SeqID_49842
  Gene Ontology: Mol. function=triose-phosphate isomerase activity; Cellular component=cytoplasm; Biological process=metabolic process
  Homolog annotation: Hit_ID=Q6D8V5; Match level="QueryCoverage=100%, HitCoverage=50%, E-value=1e-32, Identity=55%"; Hit description =Putative triosephosphate isomerase
  Pfam annotation: Domain name=TIM; Domain location=6-129; Score=-12.7; E_value=5.7e-10; Accession=PF00121.9; Description=Triosephosphate isomerase
MAQPKIWLGVSLKMYFGYQQTLAWCREVATLAQHPAVQRGDVGLFVLPAYPAIPAVTEIFAGTPVRVGAQDVCQAENGAWTGEVSASMLQELGCSLAEIGHAERRRHFHEDKTQIAAKVAMALRYRLTP

SEQ ID NO: 141528 - protein, 95 aa, Glycine max
  Coding DNA Sequence Number=SeqID_49843
KAGVAAHDVQRYVKESDWAPQCTRQDKSHLDVTLTSSVGPECVELISIVQRAISGCTGSVKYNLLDLKRDVVTSGTTSVIGIRISIGIRAGTLNH

SEQ ID NO: 141529 - protein, 178 aa, Glycine max
  Coding DNA Sequence Number=SeqID_49844
  Gene Ontology: Mol. function=RNA-directed DNA polymerase activity; Biological process=regulation of transcription, DNA-dependent
  Homolog annotation: Hit_ID=A7PQF5; Match level="QueryCoverage=97%, HitCoverage=25%, E-value=7e-45, Identity=42%"; Hit description =Chromosome chr6 scaffold_25, whole genome shotgun sequence
MVATTYQTSHECSEETIIDILVAGYSGQLKGWWDNYLTNDENSNFIGDPSLWKDRSAELLSNLKCRTLADFRWYRDTFLTRVYIREDSQQPFWKEKFLAGLPRSLGDKVRDKIRSQSLNGDIPYESLSYGQLISYVQKVALKICQDDKIQRQLAKEKAQTKKDLGSFCEQFGLSACPK

SEQ ID NO: 141530 - protein, 75 aa, Glycine max
  Coding DNA Sequence Number=SeqID_49845
  Homolog annotation: Hit_ID=Q8FL14; Match level="QueryCoverage=62%, HitCoverage=54%, E-value=2e-11, Identity=61%"; Hit description =Putative uncharacterized protein
MAARTAASPASDAERGAAAAGGFGVGIGHDKAGTFQTFGVVNRSTHQILQAHRVNHQRHTLLLDGHVAVIHLIVK

SEQ ID NO: 141531 - protein, 152 aa, Glycine max
  Coding DNA Sequence Number=SeqID_49846
  Gene Ontology: Biological process=transposition, DNA-mediated
  Homolog annotation: Hit_ID=Q1J7G7; Match level="QueryCoverage=21%, HitCoverage=47%, E-value=7e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIGLELLTSSDLLPQPAKVLGLQA

SEQ ID NO: 141532 - protein, 153 aa, Glycine max
  Coding DNA Sequence Number=SeqID_49847
  Homolog annotation: Hit_ID=Q6WAY4; Match level="QueryCoverage=79%, HitCoverage=22%, E-value=5e-10, Identity=31%"; Hit description =Putative uncharacterized protein
MGSNQAPYFKKRFYHMKVKSLELASLQKLGKQMDQVQHQAFCKAYGKIWDLAMIEVSVEAIASLAQYYDQSLRCFTFGDFRLVPTIEEFEGILGCPLGRRKPYLFSGFYTSMARVANVVKILAQELDRVKQKRNGVVGIPWQHLEERVEALAD

SEQ ID NO: 141533 - protein, 115 aa, Glycine max
  Coding DNA Sequence Number=SeqID_49848
MATKMKQCLFKALGSMAPHREWPRCSHDVQRIFPLRKKSVANLHNILLSLSEASRGHSLSSMYRLILKYQGLPSFSSSIKQQCASSSRHLNSMYDKSPCGLSRNMDASVTRASAI

SEQ ID NO: 141534 - protein, 77 aa, Glycine max
  Coding DNA Sequence Number=SeqID_49849
  Homolog annotation: Hit_ID=A7QL08; Match level="QueryCoverage=50%, HitCoverage=53%, E-value=1e-11, Identity=92%"; Hit description =Chromosome undetermined scaffold_116, whole genome shotgun sequence
MPLKDSTETKTGCQERRGGLKKDLRVSRVVPGGSLNAFLFLLIGVISQRLAMVKKKGEQAHLESAVQRIVVCCVREG

SEQ ID NO: 141535 - protein, 190 aa, Glycine max
  Coding DNA Sequence Number=SeqID_49850
MSALKDQMASITEAMLKIQKSIEDNATAAASNTAREAKLVLQPAMNLGRDRNVTGFNRRYSPQAYPYGLPPDFTPRTAPDDLSQAPTFEGQLPPHADYPLQEDDEGDAHLGPLLPPKEPAPHELPKPNIIRHAPSQSPPVKELVPISKDKGKIDLLEERLRAVEGLGNHPFSDLADLYLVPDIIIPPKFK

SEQ ID NO: 141536 - protein, 169 aa, Glycine max
  Coding DNA Sequence Number=SeqID_49851
MNVHVAQLIADVIYLFAGMPPTRHPLDPDKSNKALGVPVTPSKVIRPPITRAFIEKYCTPRQAQGDAPQATDAPSPPHQADPAGSFGMERYLQHLVRQQAANHRGQVQIHECLYQLSLNQFRAEVAWPGDCLEAQAGVAPAEAPGDAEEALMDEEMTDLLGFLGGSGAT

SEQ ID NO: 141537 - protein, 108 aa, Glycine max
  Coding DNA Sequence Number=SeqID_49852
  Subcellular localization annotation: CTP_CleavageSite=32; ConfidenceScore=5.44e-01
MASFSHLQSQMQSQGVAVPPEPVVGPSPSGPRVSTKGSCVDPSGNDPETGDFDRHFTPFLAWPTHLVKSLSQQVAVSPPKPPPKPDPEVDDPLYLMTLTIPELFLRPY

SEQ ID NO: 141538 - protein, 402 aa, Glycine max
  Coding DNA Sequence Number=SeqID_49853
RPSRALPTGASTETFLHRRGFAGEDQGQNVLLARHFIFALHARMHHDDAFGNLVRCQHGGTVEFFSKRERGRRLAQRRGFEHGVQAVHVEGGNGDRRRQAAGGTHGEAPWLKAMQKAAPAGAACLYCGDKCGRNRLLPIPGRYCGGSAVQRGAGQGGSVAGGVDRLQGEQRLRQALELVGQLHKEVVHGRAAAPDHGDAAAGTAFAGEIEQADVVRARDRRLHRQARQQSDADVGGNHLPQRLQAGGAELGLLVGTEQAADFQCLVAQAMPVFQQQQLLRGQSCTSSQQERLLEQEFGVQLVVDHRQGQQRSIEFAFAQAVEQHIALFLDQQQFQLREAIADARDHMRQQVRAQGREDPQAHRTGFRVAAASRRFLQLFHFGHDHPRPRGSLLAGRGQHHLA

SEQ ID NO: 141539 - protein, 156 aa, Glycine max
  Coding DNA Sequence Number=SeqID_49854
  Homolog annotation: Hit_ID=Q1J7G7; Match level="QueryCoverage=33%, HitCoverage=75%, E-value=2e-08, Identity=60%"; Hit description =Transposase
MVESWNLLRADQRLIFAKKLAQGFPGINRDTRIYLFCESDLPSQVLQWLLFLSAVPPVQLLTGWCVTAKSTARTSALASVAVPAARNHHTPPRLNAPLQGASHSPFRLRNCWEGRSVRASSLLRQLAKGGCAARRLSWVTPGFSQSRRCKTTASEL

SEQ ID NO: 141540 - protein, 108 aa, Glycine max
  Coding DNA Sequence Number=SeqID_49855
MAKGCEMTKFCLRVSSGPPPLDDKGCRMTKFCLHHMLRARRLSMTDLVGRDKSKALALLLPMRNQTYVVLNKLGDLKNLSPPEDADISGKGADDHIGLCSSITLGVTE

SEQ ID NO: 141541 - protein, 121 aa, Glycine max
  Coding DNA Sequence Number=SeqID_49856
MSSWHRDRARKTPSGPEDGQQGLGVASSKYGSLSVQGSACCPQQGHQAPYQSSFHQEVLRPQADAGRNTTTALGWPVAGNRRTAATSRVHLCSSTKRFEYCLHHMADQQATKSKAKDKQKC

SEQ ID NO: 141542 - protein, 103 aa, Glycine max
  Coding DNA Sequence Number=SeqID_49857
MSHAVKDHRGKWAPNYEGPFVVKRAFSGGALGQDHLGLPSEVETKRERQKPIKVGYLRTDASGDGVTTDRSLPLLCAEQAENVAARQPRILCILQLSFTICLF

SEQ ID NO: 141543 - protein, 247 aa, Glycine max
  Coding DNA Sequence Number=SeqID_49858
  Homolog annotation: Hit_ID=Q6Z8F0; Match level="QueryCoverage=25%, HitCoverage=58%, E-value=3e-21, Identity=79%"; Hit description =Putative uncharacterized protein P0459B01.18
LGRNLPPDWGCIPKQPDSPTAPRGATGSGHDGALTLSGAPFQGTWARSATEDASPDYNSDAEGDRFSWWAFPGSLAVTKGILRVAPPDLRSRWERACTQRVVDGSRTDRLARDWSRAWLIHHFITAKSAMNPDFNQPRGGRALGLMASGATCVQRLDGSRDSAIHTKYRISLRFFIDARAEISVAKSHCIAGVCVCREDEEAGRTGRRGHPLPPDGSVDFSQRRGQRTAHVAASEHFTGPFNRRSDG

SEQ ID NO: 141544 - protein, 114 aa, Glycine max
  Coding DNA Sequence Number=SeqID_49859
MGVQIAIRPTWAFQDLATEGGAFLVEQPSSPGRAGWQPPPSFPPINRGRMARRKMFNPPGIRESLKISEKNCFREENPCRGASITLPRRFCGRYRKGFPPFFVFVLRRSSVFNR

SEQ ID NO: 141545 - protein, 70 aa, Glycine max
  Coding DNA Sequence Number=SeqID_49860
MASPFHLDLAAFSRYLLREPRDGRPLRGYSFEPRLLTFGPSAVGLSLLCCKHKALCRCQAKAPNRVAVDT

SEQ ID NO: 141546 - protein, 157 aa, Glycine max
  Coding DNA Sequence Number=SeqID_49861
MWAFLTDHQIDWAHLVRYRMHKALRVNAPLPYPQLVTLFLRHFQIPLDDEPFVQVKRSFAIGAGAVTSFSYRKDRDGQWLKKDALPPQDERTPSPPPQRDDSALMTEVLSKLRGLHTYVGERFDSLDGRFEGMDTRITQLEEDITYLRRCFDLPPLS

SEQ ID NO: 141547 - protein, 131 aa, Glycine max
  Coding DNA Sequence Number=SeqID_49862
MLGFTSDSPQISASPHQLDFAPYASGPYNAQWNAPGLLHDKHTLHSSRILGEMEVEEPWLELWLPLNYRVDIGASQHRTPEWGWCLALVVWKVGFVVDLGMAFVDNWVVGKEKGCYWLSNDIVGLVGNLTI

SEQ ID NO: 141548 - protein, 296 aa, Glycine max
  Coding DNA Sequence Number=SeqID_49863
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLYVSCGIDWQDFKRVKKAIQGDCINAKLSLLCEHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141549 - protein, 232 aa, Glycine max
  Coding DNA Sequence Number=SeqID_49864
MEIIISVPLITCDFCRREHYQDNCYMYSTNNSGWRQLTPYNQYEEQRVPDLDIVFAEFMAYHASSKANHNAIQKQEIQCAKVFFEDYQGEPESQFYYQNELERSFNLDILLMQFKDTIGSIQRAFKSAEIQVGKLVEEVTQAMSRREEEIVKVDTQEESPVNEHDLEEEDKEKAQQWKQCLQTHTQQEDNFQVNTCSHQLTIKEERHEDHEASIILGQPCLTFASCVFDMGK

SEQ ID NO: 141550 - protein, 163 aa, Glycine max
  Coding DNA Sequence Number=SeqID_49865
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=75%, HitCoverage=96%, E-value=3e-26, Identity=56%"; Hit description =Putative uncharacterized protein
  Subcellular localization annotation: CTP_CleavageSite=27; ConfidenceScore=5.40e-01
MTMITPSSKLTLTKGNKSWYRAPPRVRINNLAKFVFEYTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141551 - protein, 41 aa, Glycine max
  Coding DNA Sequence Number=SeqID_49866
MYNYHEKGRAPDLETGSKGDGYSMQQQETQFEKDYSFADYQ

SEQ ID NO: 141552 - protein, 163 aa, Glycine max
  Coding DNA Sequence Number=SeqID_49867
  Homolog annotation: Hit_ID=Q6UUU1; Match level="QueryCoverage=36%, HitCoverage=40%, E-value=1e-18, Identity=78%"; Hit description =Putative uncharacterized protein
MESHSVTQAKVEWCDLGSLQPPHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141553 - protein, 342 aa, Glycine max
  Coding DNA Sequence Number=SeqID_49868
  Homolog annotation: Hit_ID=Q6Z8F0; Match level="QueryCoverage=15%, HitCoverage=47%, E-value=4e-16, Identity=80%"; Hit description =Putative uncharacterized protein P0459B01.18
MCKCRSHGTFPLFGLQSSHLNICYYHQDLHRRPLRPGSRPGFCSDRRALLLIGAWSLPRRPVSLRASTRVSSGFAPLRHSSPSFGSRQVCSHSNPSQKIRVGRRCNPQGDPTNQLPCALRVYSPVDSHTCQTPWSVFSRRAEWGAHKPDAQERAGAEARQGRALPSTIAMMTSPRAYQTAPGLGHPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 141554 - protein, 88 aa, Glycine max
  Coding DNA Sequence Number=SeqID_49869
MATIELSSGYGIKFSIGHWNWDFVVDLGMAFVDNWAVGKEKVCYWLSKDIVGLVGNLAVQEWQSQHGFFPHPHPLYLPQFSHSSKQDD

SEQ ID NO: 141555 - protein, 105 aa, Glycine max
  Coding DNA Sequence Number=SeqID_49870
RSFLIGAAVVASFGYRKEHDGSWVKKGTQPNDDEGQLLVEGDSFLLQSILDRFDGLQTYIGERFDALEQQVDTRFDEMDSRITKVEEDVTFIRTCFDLPPPPPSS

SEQ ID NO: 141556 - protein, 84 aa, Glycine max
  Coding DNA Sequence Number=SeqID_49871
MIRGDTLRLSAPPLPFRHSRVRWQAETKFGHSAPMIRGDTLWPTWALQKIPPEGGCFWRKQPCSPGRAELAWASWAATTSPILL

SEQ ID NO: 141557 - protein, 326 aa, Glycine max
  Coding DNA Sequence Number=SeqID_49872
LSQRLCETETNMLAIIAKYQEDLGLAAAHEHRIADEYAQVYAEKEARGRVIDSLHQEATMWMDRFALTLNGSQELPRLLAKAKAMADTYSAPEEIHGLLGYWKNTITKRAAGIPIAPDPNLERWRRNAATAAAASSAAEADPTLLATTHHPPSNIVGRGRDTLGHDGSPHLGYNRAAYPYGLPPNYSPPVLQEDAGHIASPVHEREPPQQPDEVHKDPQDYARRDVEFYPPIPEGPAPGTLPQPNIAVPPIVLSTEGPPPVTEERRKLDLLEERLRAVEGFGDYPFADMTDLCLVPDVVIPSKFMVDGIDKHKGTTCPKNHLKNTA

SEQ ID NO: 141558 - protein, 141 aa, Glycine max
  Coding DNA Sequence Number=SeqID_49873
DVPDTLKELVWNEILAKFDIPEALHAKKKDQHKEDPSVKYGFDAQIWEEFVATRKTPNWQEIQKNNDCPHLLSRGGYDLLEKKLLDEKIKKRQHDALMTENPALIEDLPSPIQRHVKWKMARTNRYGMMTSKAARQIADKI

SEQ ID NO: 141559 - protein, 156 aa, Glycine max
  Coding DNA Sequence Number=SeqID_49874
MGDQEETQEQMKADMSALKEQMASMMEAMLVRLPKQTRLSLATAHHPPSNIVGRGRDTLGHDGSPHLGYNRAAYPYGLPPNYSPPVLQDDAGHIASPVLEREPPQQPEEVHKDPQDYARRDVEFYPPIPEGPAPSTLPQPNIATQPIVLSTEGPSP

SEQ ID NO: 141560 - protein, 143 aa, Glycine max
  Coding DNA Sequence Number=SeqID_49875
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=36%, HitCoverage=50%, E-value=4e-22, Identity=92%"; Hit description=LacZ protein
MTFKGLRIKVENGELANNASNSCSPGDPLVLERPPPRWSSNSPYSESYYNSLAVVLQRRDWENPGVTQLNRLAPHPPFASWRNSQQARTDSPSQQLRSLNGEWDAPCSGALSAAGVVVTRSVTATLASADVRRCFCRYAPPRQ

SEQ ID NO: 141561 - protein, 181 aa, Glycine max
  Coding DNA Sequence Number=SeqID_49876
WTTRRLERLHASPWVLVPITLRGLRVLALRGLHVLTIQRATRPYLQRTTCPRLERATRPHLGGLHVLTIRGLHALTSRGLHVLALRGLHALTLGLHVLAIRGLHALTSRGLHVLALRGLHALTLGTSYPHQGYTPSPWVLVTLTVERTTRPRLERTTRPHHQRVARPHLQRTTCPRLERTT

SEQ ID NO: 141562 - protein, 77 aa, Glycine max
  Coding DNA Sequence Number=SeqID_49877
GLGYKNLVVYVCLNAVLVAFSLTRRICGRGLIRTRLGYCRNLPFGGRARRGSQVDKSGALAPTYPPSKRKSVLRSSF

SEQ ID NO: 141563 - protein, 79 aa, Glycine max
  Coding DNA Sequence Number=SeqID_49878
LGRIDGDSALRGTRVRATWEYVSSVGGGQQGMETLGTLGGVLLPKTKLDQSRPNPGIVVEASGNRLPGCVIDYTEKHAT

SEQ ID NO: 141564 - protein, 21 aa, Glycine max
  Coding DNA Sequence Number=SeqID_49879
NWNEDRCHSLKNLSQEAKGQP

SEQ ID NO: 141565 - protein, 65 aa, Glycine max
  Coding DNA Sequence Number=SeqID_49880
MDDFQVSNEHEMELLRLHQHEENDKKKKGIALKASSSIQEESDQDNDPDDDDDLSLFVRRFNKFL

SEQ ID NO: 141566 - protein, 330 aa, Glycine max
  Coding DNA Sequence Number=SeqID_49881
  Homolog annotation: Hit_ID=Q6WAY4; Match level="QueryCoverage=93%, HitCoverage=53%, E-value=1e-41, Identity=36%"; Hit description =Putative uncharacterized protein
MGTNQSGKRFYQVKVKSLDVTSLKELGRLMGPLQRQAFRKVYGKILDLTAAEVFTEVVVSLAQYYDQPLRCFTFGDFQMVPTIEEFEEILGCPLEGRKPYLFSGFFPLSKIAAVVGDSAKELDRMKQTRNGVVGLPRKYLEGKARDMASQEKWGPFADILALLIFGVVLFPNVDGLVDLAAIDAFLAYHHSKESPVVAILADLFDTFDRRCEKNSARIVCCLPALCVWLISHLLRQDTRHPCPLQSYRSCAEKGRLNWDQHLAGIGGSAINWFPRWKEGKEGVLFSCGDYPNVPLIGTRGCINYNPALAIRKLGYPMRGAPTEESLSPFL

SEQ ID NO: 141567 - protein, 44 aa, Glycine max
  Coding DNA Sequence Number=SeqID_49882
MWTTTGGEKLAAQLAQASKVASSRNNSLLEGPSGPGCYLHPPVY

SEQ ID NO: 141568 - protein, 61 aa, Glycine max
  Coding DNA Sequence Number=SeqID_49883
  Homolog annotation: Hit_ID=A8NQF8; Match level="QueryCoverage=93%, HitCoverage=76%, E-value=2e-13, Identity=66%"; Hit description =Putative uncharacterized protein
MSGPGSTPGGALPSIPSSFSLATILPPEPKNFDFSQGAERDYHILVRSLVGIVYGQDYDGI

SEQ ID NO: 141569 - protein, 66 aa, Glycine max
  Coding DNA Sequence Number=SeqID_49884
MATLGQGELIQGYILIMGLDSILPVLSTLIAMYEDAKYNPGKGREKINGNISKFCINCNLKAIKVS

SEQ ID NO: 141570 - protein, 384 aa, Glycine max
  Coding DNA Sequence Number=SeqID_49885
  Homolog annotation: Hit_ID=UPI00006A2D9E; Match level="QueryCoverage =52%, HitCoverage=100%, E-value=5e-10, Identity=19%"; Hit description= UPI00006A2D9E related cluster
LSFRGPHVLALRGLHALAFRGLHVLTIRGLHVLTFEGLHVLAYKGLHALTFRGLHVLAFRGLHALAFRGLHVLAFRGLHALTFRGLHVLALRTTHPHLQRATRLHLQRTTRPCLEDYTSSPSEDYTPLPSEGYTPLPSEEYMSSPSEDYTSSPSEGYTPSPLEDYIGLHILTFRGLHVLALRTTRLRLEDYTPSPSEDYTSLPSEDCTSLPCSYYAYRGKISPSDHNADLPLRKYQLDRAHKTPSGPGEVQQGPGVSSSGYGPLSVLPSACPPSKVMPSWCRIAPIRHSVGPEKSNRVLGFPALITSLCQFYGVLVAPNKVIRPPTNRAFIRKYCAPRQVQPSPKPKVSKVLVRDRQVIKRPAQDVKEALLGGNLVPFNSLLVI

SEQ ID NO: 141571 - protein, 174 aa, Glycine max
  Coding DNA Sequence Number=SeqID_49886
RGLPVLAIRGLHALTFRGLHVLALRGLHALTLGTSYLHRQRTTRPRLERTTRPHHQRAARPHLQRTISPRLAEGYTPSPWLPSPLRGLHVLALRGLHILTIRGLHALTFRGLHVLALRGLHALILGTSYLHRQRTTRPRLERTTRPHHQRAARPHLQRTISPRLERATRPHLGY

SEQ ID NO: 141572 - protein, 93 aa, Glycine max
  Coding DNA Sequence Number=SeqID_49887
  Homolog annotation: Hit_ID=Q6WAY3; Match level="QueryCoverage=72%, HitCoverage=2%, E-value=6e-07, Identity=43%"; Hit description =Gag/pol polyprotein
MTNTTFSTNQNTNQEMKFAAKKPVEFTPISVSYADLLPYLLDTAMVAITHARFPQPPFFRGYGSNTMCAYHGGAPGHSIEHCMTLKRKVQSLN

SEQ ID NO: 141573 - protein, 238 aa, Glycine max
  Coding DNA Sequence Number=SeqID_49888
  Subcellular localization annotation: CTP_CleavageSite=10; ConfidenceScore=5.15e-01
QQQQQQPAPSFQNAAGPSRPYIPPPIQQQQQPQKQPTVEAPPQPSLEELVRQMTMQNMQFQQETRASIQSLTNQMGQVATQLNQQQSQNSDKLPSQAVQNPKNVSAISLRSGKQCQGPQPVAPSLSANEPAKLHSIPEKGDDKNLPNNFCAGESSSTGVATYPSTGGRRVTRGMRVPRKEYARSRHQRLFEENVGKTGKDAIYELFSERFGSCIYARGRVFPFAPTYSSIWDEKIRPT

SEQ ID NO: 141574 - protein, 124 aa, Glycine max
  Coding DNA Sequence Number=SeqID_49889
LCQSFGVPVAPSKVIRPPITRAFIEKYCTQRQAQGDAPQTADAPPPHQAGPAGSFDTEQYLRHLVRQQAANHRAHFRAEVAWPGDWPEARAGEAPAEAPDEADEAHEDEEMTDFLDFLRGSGAT

SEQ ID NO: 141575 - protein, 48 aa, Glycine max
  Coding DNA Sequence Number=SeqID_49890
MWYLKALHWGNERHHPYTGAMRDIVHEPQVNIGADQKRGQTNPGISID

SEQ ID NO: 141576 - protein, 78 aa, Glycine max
  Coding DNA Sequence Number=SeqID_49891
MAKFDPDVVLEFYANAWPTEESVRDMRSWVRGQWIPFDADALSQFLGDPLVLEEGHECEYSQRRNRADDAILPRKGIG

SEQ ID NO: 141577 - protein, 52 aa, Glycine max
  Coding DNA Sequence Number=SeqID_49892
MAAEWRRRRVERRRHFKEKMSQEEAHHHRKPWIRAWSPTNPRSSPRFSTKCA

SEQ ID NO: 141578 - protein, 143 aa, Glycine max
  Coding DNA Sequence Number=SeqID_49893
MLVRGAERYGKTALPRNPFTYPFSWHFLENRIPAARCRATFSVPHATERRSSTIRPIVICIYIFSWPCSFFCHNAFVTGNTLALQANIVTPYAHIRFSAAGVIRKGPPDRPSRNSCAADSLMQRMARQRFPTVKAAQLERNGG

SEQ ID NO: 141579 - protein, 162 aa, Glycine max
  Coding DNA Sequence Number=SeqID_49894
  Homolog annotation: Hit_ID=Q6UUU1; Match level="QueryCoverage=37%, HitCoverage=40%, E-value=1e-18, Identity=78%"; Hit description =Putative uncharacterized protein
MPVVPAPQEDHVSPRGHSYSEHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141580 - protein, 77 aa, Glycine max
  Coding DNA Sequence Number=SeqID_49895
  Subcellular localization annotation: CTP_CleavageSite=47; ConfidenceScore=5.05e-01
MLQPYGISVGLKEHSNPMTPKAYTPKSPSGPLPPDSAPLELVGLGSSSSMDSFASWKIKWQRNGEGRERGDATSRRR

SEQ ID NO: 141581 - protein, 53 aa, Glycine max
  Coding DNA Sequence Number=SeqID_49896
MSTEPPPCERTLREMVALDFTYESLCIQYPDEDVPYVLKTGLIHLLPKFHGLQ

SEQ ID NO: 141582 - protein, 126 aa, Glycine max
  Coding DNA Sequence Number=SeqID_49897
MTHFDGLYLFSSFIGGFTRRFNTNLCLFFLYQLNIFRFTFAFVNYTVIYKTKVGRKDIELVDEEEAQLGADRSSAISNKSEIYKEEARNAAQKHKPKRVESVNADAEAFGDHWKIQIALCILKLKH

SEQ ID NO: 141583 - protein, 294 aa, Glycine max
  Coding DNA Sequence Number=SeqID_49898
  Homolog annotation: Hit_ID=Q6WAY6; Match level="QueryCoverage=42%, HitCoverage=21%, E-value=6e-14, Identity=33%"; Hit description =Putative uncharacterized protein
RRIDWDQLLAGIGGRTISWFPRWKEGKEGVLFSCGGYPNIPLVGTRGCINYNPTLAIRQLGYPMRGAPTEESMSPFLVRDFGAQNSKTIQKIHKAWETPLRKDQELRGIRNGIIGGYHEWLKVHIRGLDWLAKLKVVSKESFEAPEEDEVQNAITARALEQETKRARKEEYGRNKFRGALWGSNSELKLRREERDQSRAHSMTNMLAIIAKYQEELGLAAAHEHRIADEYAQVYAEKEARGKVIDSLHQEATMWMDQFALTLNGSQELPRLLAKAKAMADTYSAPEEIHGLLGY

SEQ ID NO: 141584 - protein, 108 aa, Glycine max
  Coding DNA Sequence Number=SeqID_49899
MAPKKLSTKRSRRDATREGSSAALEFDSHRFRSAEHQQRFEAIRGWSFHRERRVQLREDEYMDFQEEIARRRWTLLVIPMAKFDPEIVLEFYANAWPTKEGVRDMRSW

SEQ ID NO: 141585 - protein, 115 aa, Glycine max
  Coding DNA Sequence Number=SeqID_49900
  Homolog annotation: Hit_ID=Q8RV60; Match level="QueryCoverage=76%, HitCoverage=7%, E-value=2e-15, Identity=44%"; Hit description =Putative uncharacterized protein At2g05640
MGFLQDDKEFIEAIKEAKDWGSTHYIRKLFVLLLLTATMSKPEQLDDRTLQNLVLLEIEQLLQANQRSLRDYPSMPYPEDANCPAYLDNSLILVELNYNNEELRLEFEHLFSHMA

SEQ ID NO: 141586 - protein, 68 aa, Glycine max
  Coding DNA Sequence Number=SeqID_49901
MNDRGLLKEEEFGLAPLELVGFFISRVFCFLNFDSSGMEKEKDDWRCHFKEKMSLKEAHHHRKSWIRA

SEQ ID NO: 141587 - protein, 241 aa, Glycine max
  Coding DNA Sequence Number=SeqID_49902
  Gene Ontology: Biological process=transposition, DNA-mediated
  Homolog annotation: Hit_ID=Q6UUU1; Match level="QueryCoverage=24%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARDDVPIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141588 - protein, 95 aa, Glycine max
  Coding DNA Sequence Number=SeqID_49903
  Subcellular localization annotation: CTP_CleavageSite=38; ConfidenceScore=5.49e-01
MVKVGTSYVPINVSFSPKVGPGLSRFATGTPGFIVFCECFRREQLTTTPAALNCACATGLPAFPFGNHVRLRNCINESANARAIECGPLAYYPGR

SEQ ID NO: 141589 - protein, 87 aa, Glycine max
  Coding DNA Sequence Number=SeqID_49904
  Homolog annotation: Hit_ID=A2Q1D6; Match level="QueryCoverage=97%, HitCoverage=13%, E-value=3e-08, Identity=40%"; Hit description =Ovarian tumour, otubain, related
MKTKLVFVTYDDVLNWARVIVYEIGFMTVIMRLDTNTGIKGRTSFVLIGCKMSGQYSVGKKILVRTNTGSRKCGCPFKLCGKPVVGG

SEQ ID NO: 141590 - protein, 127 aa, Glycine max
  Coding DNA Sequence Number=SeqID_49905
MGVQIAPRPTWGPPEDSSRRLLLLEESNLARLGRAGASPGRVGRPPPSPIFAYKLGGGKWKKEKGVQPLEGTFLSFEICLGKNLFFCEEKSKPRRFRNVFRNVFREEFRKGFNRSSTFFIRSSIFNG

SEQ ID NO: 141591 - protein, 259 aa, Glycine max
  Coding DNA Sequence Number=SeqID_49906
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=48; ConfidenceScore=5.04e-01
GTSYVPINVSFRQKLAQGFPWLLFLSAVPPVQLLTGWCVTAKAPPDISAGKCSGRVPFAIQAAQLLGRAIGAGLFAITPAGERGMCCKAIKLGNARVFPEFDSNAFNLVTCYATRSVPSKSVSHFQIANRAIDISLFFFLSVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141592 - protein, 275 aa, Glycine max
  Coding DNA Sequence Number=SeqID_49907
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
DLPSQWLLFLSAVPPVQLLTGWCVTAKAPPDISAGKCSGRVPFAIQAAQLLGRAIGAGLFAITPAGERGMCCKAIKLGNARVFPVTTLNSIAQQQAQRLHQAQELEGQPVEMDTVSIIATFPSELREEASSINIHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141593 - protein, 155 aa, Glycine max
  Coding DNA Sequence Number=SeqID_49908
  Homolog annotation: Hit_ID=Q6UUU1; Match level="QueryCoverage=58%, HitCoverage=79%, E-value=1e-22, Identity=54%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPPGGSLVRSPVPAFRFTGVIPLLWPRLSHSTPDTQFR

SEQ ID NO: 141594 - protein, 191 aa, Glycine max
  Coding DNA Sequence Number=SeqID_49909
MGTNQTGKRFYQVKVKSLDTTSIKELGRLMEPLQMQAFRKTYGKILELTIAEGKKTISFLRVSPLFEQNCNCGQGFSKKYLEDKARGMANQGDWVPFMDVLALLIFGVVLFPNVDGLVDLAAIDAFLAYHHSKESPVVAVLADLFDTFDRRIDWDQLLAGIGGRTISWFPRWKEGKEGVLFSCGRYPNIPL

SEQ ID NO: 141595 - protein, 294 aa, Glycine max
  Coding DNA Sequence Number=SeqID_49910
MSPFLVRDFGAQNSKTIQRIHKAWETPLRKDQELRGIRNGIIGGYHEWLKVHIRGLDWLAKLKVVSEESFEAPEEDEEVQALKSELGKAKFAKEKFKLAATHIRKECAGLREENAITARALEQETKRARKEEYGRNKFRGALWGSNSELKLRREERDQSRAHSMVLKEELIACSRSKRSLSQRLCETETNMLAIIAKYQEELGLATAHEHRIADEYAQVYAEKEARGRVIDSLLQEAPCGWIGLLYLERESRTPRLLAKTKAMSDTFSAPEEIHELLAYSQHMIDLMAHIIRNR

SEQ ID NO: 141596 - protein, 239 aa, Glycine max
  Coding DNA Sequence Number=SeqID_49911
  Gene Ontology: Mol. function=protein binding; Cellular component =periplasmic space; Biological process=cell wall catabolic process
  Homolog annotation: Hit_ID=A4W9R5; Match level="QueryCoverage=86%, HitCoverage=66%, E-value=1e-100, Identity=83%"; Hit description =ErfK/YbiS/YcfS/YnhG family protein precursor
  Pfam annotation: Domain name=ErfK_YbiS_YhnG; Domain location=94-216; Score=156.6; E_value=6.6e-44; Accession=PF03734.5; Description =ErfKYbiSYcfSYnhG
  Pfam annotation: Domain name=LysM; Domain location=42-86; Score=29.4; E_value=1.3e-05; Accession=PF01476.11; Description=LysM domain
  Pfam module annotation: Pfam domain module=ErfK_YbiS_YhnG::LysM; Domain location=94-216::42-86
MKRASLITLLLISSLGALHSARAMDYPLPPAGSRLIGQNQTYTIQEGDNKLQTIARRFNTAAQVLLETNNTMRPVNPAPGTVITIPSQMLLPDTPREGIVVNLAELRLYYFPPGENSVQVFPLGIGQLGLETPVTTTRSPLAGAGIKLPPVVPAGPNNPLGRYALRLGVGNGEYLIHGTSAPDSVGLRVSSGCMRMNAPDIKALFEQVRVGTRVQIINEPVKFSVEPDGGGGKPAGLAN

SEQ ID NO: 141597 - protein, 73 aa, Glycine max
  Coding DNA Sequence Number=SeqID_49912
MTKSKGKDPLEGLGGPMTRARARKSKKALQQVLSILFEYKPKFQGEKSKVAKGPSGEGRKPKWRRIKPSSGEG

SEQ ID NO: 141598 - protein, 212 aa, Glycine max
  Coding DNA Sequence Number=SeqID_49913
MERSMIDAASGGALGDMTPAEARNLIEKMASNSQQFSARNDAIVIRGVREVATNPSTSYETKKLEGKLDALVNLVTQLALNQKSVPVARQPGAIEQPEAYAANIYNRPPQPQQQNQPQQSNYDLSSNRYNPGWRNHPNLRWSSPQQQQQQPAPSFQNAFGPSRPYIPPPIQQQQQPQKQPTVEAPPQPSLEELVRQMTMQNMQFQQETRASI

SEQ ID NO: 141599 - protein, 143 aa, Glycine max
  Coding DNA Sequence Number=SeqID_49914
  Subcellular localization annotation: CTP_CleavageSite=60; ConfidenceScore=5.31e-01
MPSDRNANLPLQKYQLVCVVPTWGSHPQRHPVDLKKSNRVLSSSSVYGSLSVPRECLSPPASLSSGRPPPIELSSRSSASPWQAQARETPQQPGDGRQRATDAPPSPLEFTSTHPQKGLSIAYTTWPTNRRPSPKPKDAPSCS

SEQ ID NO: 141600 - protein, 141 aa, Glycine max
  Coding DNA Sequence Number=SeqID_49915
  Homolog annotation: Hit_ID=Q6UUU1; Match level="QueryCoverage=42%, HitCoverage=40%, E-value=9e-19, Identity=78%"; Hit description =Putative uncharacterized protein
MGRPIRFLLYMRDIRSNLHHFHLRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141601 - protein, 76 aa, Glycine max
  Coding DNA Sequence Number=SeqID_49916
MLINVGNALACACCVCSWGTLCTDPPGSLALAFGHVHTLDVVGAVTWKGTPLGSQTDHLWEVGCYVHNRVVSTNSA

SEQ ID NO: 141602 - protein, 107 aa, Glycine max
  Coding DNA Sequence Number=SeqID_49917
  Subcellular localization annotation: CTP_CleavageSite=34; ConfidenceScore=5.55e-01
MKAPQNIQSSYQPNPPNFLIRAGNSLPTQVKGPPAAERAPTQRTASAAPRPVNNTAPDATYKYAQHPPPKDNFSPIPMAYSELWPSLLENHLVVAIPEKVFQPPYPK

SEQ ID NO: 141603 - protein, 71 aa, Glycine max
  Coding DNA Sequence Number=SeqID_49918
MEVGWPIGGSQLTYEKLFVTKFESNEILLSPIALKVVFPCFLTQILQGMAPILLSNSLYGNSQARKQRDKQ

SEQ ID NO: 141604 - protein, 89 aa, Glycine max
  Coding DNA Sequence Number=SeqID_49919
MVFDGSGVSKDMMFISANQVVTSLKEDAQVYMIMSNLETKISMCDLPVVREFPEVFPEDMIAMSKRLQEDWARAAEEGPRVLMNLKVDF

SEQ ID NO: 141605 - protein, 89 aa, Glycine max
  Coding DNA Sequence Number=SeqID_49920
MEDLLQQMIDRGRLEVGDEGSKEQHICMQSTDEGSFGRPKPLVPRNSVEVCASKRKEGRGHRHQLVVGQGNQYHGAERRDPQRSRVRTP

SEQ ID NO: 141606 - protein, 279 aa, Glycine max
  Coding DNA Sequence Number=SeqID_49921
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSIATRAARTSTCRSTPGTRGTPRSALAKSRRRATIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141607 - protein, 177 aa, Glycine max
  Coding DNA Sequence Number=SeqID_49922
  Homolog annotation: Hit_ID=A6T9B6; Match level="QueryCoverage=96%, HitCoverage=31%, E-value=5e-72, Identity=74%"; Hit description =Putative oxidoreductase
MITPHLNERDRERFKTGLARVFIDNYAAIPSESIRRLLALREAGVISILPLGADYQLEVQPQRTVIHHHNQRSEFDVFIDARGQKALKSKDIPFPTLRQQLLACGDEIPDIGDDYTLQAPACARGRIAFGALPWLMHDRPFVQGLVASAEIGAAMARSVSQQASGRRRMLWFSHEEW

SEQ ID NO: 141608 - protein, 75 aa, Glycine max
  Coding DNA Sequence Number=SeqID_49923
MDTRLRVIGDPMNGVQRQRGGCLVKMGVQIAPRPIWALQKIPPEGGCFWRKQPCSPGRAELAWASWAATTSPILL

SEQ ID NO: 141609 - protein, 82 aa, Glycine max
  Coding DNA Sequence Number=SeqID_49924
MAIVATYPSVGGQRGGSRVRLPWEENAWSRHQCLFEENVEKIGKMWSTNFKRERFGSCFYAWGRVFPSLLYILNCHEEIRPT

SEQ ID NO: 141610 - protein, 283 aa, Glycine max
  Coding DNA Sequence Number=SeqID_49925
  Gene Ontology: Mol. function=nucleoside-triphosphatase activity; Cellular component=protein complex; Biological process=proteolysis
  Homolog annotation: Hit_ID=A7QEY6; Match level="QueryCoverage=37%, HitCoverage=31%, E-value=2e-20, Identity=49%"; Hit description =Chromosome chr16 scaffold_86, whole genome shotgun sequence
MVKGGNLLRADQRLIFAKKLAQGFPLSLPVQLLTGWCVTAKAPPDISAGKCSGRVPFAIQAAQLLGRAIGAGLFAITPAGERGMCCKAIKLGNARVFPVTTLNSILAYKLQPAIIFIDEVDSFLGQRRTTDHEALLNMKTEFMALWDGFTTDRGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141611 - protein, 207 aa, Glycine max
  Coding DNA Sequence Number=SeqID_49926
  Homolog annotation: Hit_ID=UPI00006A2D9E; Match level="QueryCoverage =62%, HitCoverage=85%, E-value=4e-13, Identity=18%"; Hit description =UPI00006A2D9E related cluster
MSSPLEDYTSSPLEGCTPSPSEGSTPSSSEGFSPSHSEGYVSSPSKVYTPSPLEDYTSSPSRGLHVLAFRGLHVLAFRGLHALTFRELHAFTFKGLHVLTFKGLHVLTFRGLLTHAFRGLHVLTFRGVHALTFRGLHALTVRGLHVLAFRGLHVLSFKGLHNLAFRGLHALAFRGLHAFTFRGLRVLTFSGLHICTLRELKSSALNA

SEQ ID NO: 141612 - protein, 70 aa, Glycine max
  Coding DNA Sequence Number=SeqID_49927
MTVDTRPVFYYGKKVGYTPSSFTDLVFSSKKIEVDPKKGKFDHPTRTTEKTGANKEGEDEGETHAVTAIP

SEQ ID NO: 141613 - protein, 152 aa, Glycine max
  Coding DNA Sequence Number=SeqID_49928
  Subcellular localization annotation: CTP_CleavageSite=42; ConfidenceScore=5.51e-01
MDDLTVAFPGARRARVRPVDIPSTFATPSPTPTSTFAAPSVPAHMVSSPESILSVDQFLEKVAWLGAHPSLDREGGGPTAQVAQQVQDASFETTIPEPFTLHHEVGEEQLVADPSTPLLDIPENQTTPVLALNTSPPATPVLHLTDEEDAQT

SEQ ID NO: 141614 - protein, 127 aa, Glycine max
  Coding DNA Sequence Number=SeqID_49929
MTRGNPSDLQPFDPEIDRTFHRLVRHHFIPFDHSEHSITGESVHSVIGDFEHPDLEHYNFEHSDSEHSDFAHSENMTQPPPRERTLREMAAPDFTYESLCIQYPDEDVPYVLKTGLIHLLPKFHGLA

SEQ ID NO: 141615 - protein, 273 aa, Glycine max
  Coding DNA Sequence Number=SeqID_49930
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVIFRHSVPPVQLLTGWCVTAKAPPDISAGKCSGHAARRVPFAIQAAQLLGRAIGAGLFAITPAGERGMCCKAIKLGIRSHGLQALGVTRPEALQQHVHQSRSKLTFAQTFPTGTHAMWLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141616 - protein, 303 aa, Glycine max
  Coding DNA Sequence Number=SeqID_49931
  Homolog annotation: Hit_ID=Q6WAY6; Match level="QueryCoverage=86%, HitCoverage=47%, E-value=8e-14, Identity=25%"; Hit description =Putative uncharacterized protein
GVLFSCGGYPNIPLIGTRGCINYNPALAIRQLGYPMRGAPTEESLSPFLVRDFGAQNFKVIQRVHKAWESPLRKDKELRGIRNGIIGGYHEWLKVRTQGLDWLSKLKIINEENFEASEEDEEVRVLKTELGKARLAKEKFKLVATDVRKECAGLREENAATTKALEQETKRARKEEHGRDKFRGALWGSDSELKLRREERDQSRAHSMTNMLAIDSKYQEELNLATTHEHKVADEYAQVYAEKKARGRVIDALHQEATMLMDQFALTLNGSQELPRLLAKAKAMADTYSAPRRSTDFSAIVSI

SEQ ID NO: 141617 - protein, 73 aa, Glycine max
  Coding DNA Sequence Number=SeqID_49932
MSHPIRALCPDALQHIGSLKSLSLSKIIGRPVKVTIFCENAPTIWDQHRLKVVVDGDDNQGLHSEEFSRASPS

SEQ ID NO: 141618 - protein, 39 aa, Glycine max
  Coding DNA Sequence Number=SeqID_49933
HGSAGDFDIRRKKKNDMVQAQGERRRMIGFKRKEKEEER

SEQ ID NO: 141619 - protein, 317 aa, Glycine max
  Coding DNA Sequence Number=SeqID_49934
MAPQSAIHQLYYTALPLLAVGYAGRAASYQRSLESRINRQITYEELWENIYKGLKIMAHLACSKKSYALTRNANELYDENVYPTMPRHTNSLGVAIIIVPNLTPKEQKLDRWKLCSVIEVQEAEIFFLKIPLRLNFAMCGVVTSMEGTYFAMLNKSNYDNWSIKMKTLLSVQGVWEIVEKGLDDYAFERVYQKQSRRKKCERSFKPCIRELIQSRKYILRVTNQLKRNGEKFDDVKIMEEILSNFWAHYKVMKKRKEEGRDHEATNQDTTNEDEVMVDIAQEDEVMDKDKVGGLMMTTTTSKEEEAQQETVGKATQD

SEQ ID NO: 141620 - protein, 135 aa, Glycine max
  Coding DNA Sequence Number=SeqID_49935
  Homolog annotation: Hit_ID=Q2HT51; Match level="QueryCoverage=60%, HitCoverage=42%, E-value=1e-17, Identity=52%"; Hit description=Gag -pol polyprotein-related
MVQPTNPRSSPRFSTKIASGSLVYLLQQATPHKGEMLEITWKTPKLRIGAERSKEVVRLNYEEIERVRSFLSKLEKPTSTCSLTYSDTPFTHYWILDSGAIDHMTPLPKYFSIYSPCLSNKKISIVDGTLITAAR

SEQ ID NO: 141621 - protein, 63 aa, Glycine max
  Coding DNA Sequence Number=SeqID_49936
MVMSIAPTTTMVITVSLFYDSDNDGFGNTIGGGCNANANGNGYCSGSSDNDGYYCNVNLNITQ

SEQ ID NO: 141622 - protein, 194 aa, Glycine max
  Coding DNA Sequence Number=SeqID_49937
  Homolog annotation: Hit_ID=A7UQU7; Match level="QueryCoverage=45%, HitCoverage=15%, E-value=8e-11, Identity=40%"; Hit description=IMP dehydrogenase/GMP reductase, putative
  Pfam annotation: Domain name=DUF1723; Domain location=95-133; Score =20.8; E_value=0.0018; Accession=PF08330.1; Description=Protein of unknown function (DUF1723)
MAQTKHALYVDGCDPFHEGLDLSHERDDAGERHQRLIASTHDRQHPPTERRSNDLLLVQYYKDHCVGHVWIWQLRLEMKLVSHGGQVLPFPIEPTRWHKEISSFHLPIEEMTITLNDVLCLLHLPMTGRLIDHVPSTFNRNTVKILLMTHLGINSKEEAIAATIASVGVRLLPVQKLRIVNIVSCTHYDCMQVQ

SEQ ID NO: 141623 - protein, 204 aa, Glycine max
  Coding DNA Sequence Number=SeqID_49938
MNVDCELAHYVPTCITMEQYQNLLALISLLGTRANGGVEGHDTLPMQGPSLFGFWDRLTAVLKANDGSEGDSVLPCKGLLCLIFFALVLILLWTGKRLTAVLKANSSAEGDDALPWKDFLCSIFFALVLILLWTGKSDFWDRLTAVLKANRGAEGDDTLLDLFFISKNICDFFPRKLLFSGRLKEGEAASEKVTNNYHVLRQIE

SEQ ID NO: 141624 - protein, 74 aa, Glycine max
  Coding DNA Sequence Number=SeqID_49939
  Homolog annotation: Hit_ID=A7PP06; Match level="QueryCoverage=100%, HitCoverage=100%, E-value=2e-29, Identity=59%"; Hit description =Chromosome chr8 scaffold_23, whole genome shotgun sequence
MNFRSLEEFWAFYVNQHSKPSTRSHFFVEGNVPATFGHPFWSLLCDLKMFGLMLTGKMDREIKRLGKRPVLQVF

SEQ ID NO: 141625 - protein, 333 aa, Glycine max
  Coding DNA Sequence Number=SeqID_49940
  Gene Ontology: Mol. function=protein tyrosine/serine/threonine phosphatase activity; Cellular component=nucleus; Biological process= protein amino acid dephosphorylation
  Homolog annotation: Hit_ID=A7PP04; Match level="QueryCoverage=78%, HitCoverage=73%, E-value=1e-121, Identity=79%"; Hit description =Chromosome chr8 scaffold_23, whole genome shotgun sequence
  Pfam annotation: Domain name=mRNA_cap_C; Domain location=137-234; Score=122.2; E_value=1.6e-33; Accession=PF03919.6; Description=mRNA capping enzyme, C-terminal domain
  Pfam annotation: Domain name=mRNA_cap_enzyme; Domain location=1-134; Score=151.6; E_value=2.1e-42; Accession=PF01331.10; Description=mRNA capping enzyme, catalytic domain
  Pfam module annotation: Pfam domain module=mRNA_cap_C::mRNA_cap _enzyme; Domain location=137-234::1-134
MAEKTHHFTLLDGEMIIDTLPDSKKQERRYLIYDLMAVNGVSVIERPFYERWKMLEKEVIEPRNQERFQSRNPYYRYDMEPFRVRRKDFWLLSTVTKLLSEFIPKLSHDADGLIFQGWDDPYIPRTHEGLLKWKYADLNSVDFLFEVIDNDCQLLFLYERGKKKLMEGYRVAFEEGSNPLHYSGKIIECSWDSDRQEWIFKRIRTDKSTPNDFNTYRKVMRSIRDNITEDILLNEISEIIRLPMYADRIRIDSKANHHTNMSRRSPSPTTNLPRPHPPDRPDWINELTVLWVAGFEICGNDADFGCWFWENCVGGKIMAVYATQRERVHGAKA

SEQ ID NO: 141626 - protein, 310 aa, Glycine max
  Coding DNA Sequence Number=SeqID_49941
  Gene Ontology: Mol. function=protein tyrosine/serine/threonine phosphatase activity; Cellular component=nucleus; Biological process= protein amino acid dephosphorylation
  Homolog annotation: Hit_ID=A7PP02; Match level="QueryCoverage=97%, HitCoverage=98%, E-value=1e-114, Identity=66%"; Hit description =Chromosome chr8 scaffold_23, whole genome shotgun sequence
  Pfam annotation: Domain name=DSPc; Domain location=146-261; Score =19.3; E_value=5.2e-06; Accession=PF00782.11; Description=Dual specificity phosphatase, catalytic domain
MIVAVDLNASPVPEDDQDDFGDQVEEYHAPEERVESAVDIARREREERKRKLKRERSDDKPVQVSQSPGHDQLFHTKILKSYDRSKLPPGWLDCPSFGQEIYCMIPSKVPLGESFNDYIIPGKRYSFKQVIHQQRVLGRKLGLVIDLTNTSRYYPVADLKKEGIKHVKIQCKGRNSVPDNLSVNHFVYEVTQFLFRQKHSRKYILVHCTHGHNRTGYMIIHYLMRTMSMSVTQAIKIFSDVRPPGIYKPEYIDALYAFYHEKKPEMIVCPPTPKWKRTPELVDLNGEAMPDDDDDDGVPGSPLHVWIILK

SEQ ID NO: 141627 - protein, 1075 aa, Glycine max
  Coding DNA Sequence Number=SeqID_49942
  Gene Ontology: Mol. function=acetyl-CoA carboxylase activity; Cellular component=acetyl-CoA carboxylase complex; Biological process=fatty acid biosynthetic process
  Homolog annotation: Hit_ID=Q42779; Match level="QueryCoverage=76%, HitCoverage=90%, E-value=1e-170, Identity=90%"; Hit description =Alpha-carboxyltransferase aCT-1 precursor
  Pfam annotation: Domain name=ACCA; Domain location=89-231; Score =334.3; E_value=2.1e-97; Accession=PF03255.5; Description=Acetyl co -enzyme A carboxylase carboxyltransferase alpha subunit
  Subcellular localization annotation: CTP_CleavageSite=46; ConfidenceScore=5.48e-01
MAASSASLSGASASDLLRSSTSGFNGVPLRTLGKGKLVLKRRDFTVAAKLRKVKKHEYPWPANPDPNVKGGVLSHLSLFKPLKEKPKPVTLDFEKPLVDLQKKIIDVQKMANETGLDFSDQILSLENKYQQALKDLYTHLTPIQRVNIARHPNRPTFLDHVFNITEKFVELHGDRAGYDDPAIVTGLGTIDGRSYMFIGHQKGRNTKENIQRNFGMPTPHGKALRLMEYADHHGFPIVTFIDTPGAYADLKSEELGQGEAIAHNLRSMFGLKVPVISIVIGEGGSGGALAIGCANKLLMLENAVFYVASDGSYGVEIQTKGKLLGKIGRQFVFQMRKVLDSKHESWRSLDESRSNTSDSIWGWDLRHVCNASGEGRFFRGVIEWKIGCGAMVKLWEDGWLTGGKSLADKYPRLYSISQQQQNSIQQMGIASAGGWEWHLEWRRLFREVEVDRVAKFMEDIQIVTVQVDQRDRRGWRLDPCGDYTVGSAYKVPEACAAILWKTAKASPKAAEKLKITATELCKLQIADGVIPEPLGGAHADPEWTSQQIKKAIKETMDELTKMNTEELLKHRMLKFRKIGGFQEGIPIDPKRKANMKKRDLSIAKIPDAELEVEVEKLKQQVLEAKESSPVPPKLDLDEMLKQLAREVGLEYSEAVKATGLTDSLLKLREEVSKANADSQIVDPLLKDKIEKLRVEFEQQLRAAPNYGRLQNKFKYLSELCKVKLLSDANKDNQAVTFKQELEKKVDNALSDPKIRETFEALKAEIKGAGASSASDLDDELKKKIVGFMIELKEVKEVKEVIENQIESLVNSSDDIKSKILQLKLELPKAGETPDSESNNRIGRLFVIENFQCLVKMDEDQWMYDNIMSEKVYMNKQNEDEVGVNEEHVDCFDAFNTFQVFATRDDVLHWARSVAYEIGFVAVIMRSGQYRSTKKDFVKIDADNRKCGCSFKLREKPVVGGQGLSEFEVSITEEMETISKRFEELDANSKCAQKKPMTKHQRSTKRDPSYWEYVDALNFVQNSNSLVKRNTSSSDQAIPRRTMPILDFIRAFMIPLKTLSMSKLTVTVDIVQLLSY

SEQ ID NO: 141628 - protein, 245 aa, Glycine max
  Coding DNA Sequence Number=SeqID_49943
  Homolog annotation: Hit_ID=Q2HSV3; Match level="QueryCoverage=60%, HitCoverage=22%, E-value=6e-14, Identity=34%"; Hit description=IMP dehydrogenase/GMP reductase, putative
CWIYEHFPSVAESTADQDYDEASPRACRERLDRLRILDVCWIPYGEHREVRDFHVRSCYSGLLRWGPVAVYYRPERVVRQFGYTQTIPTPPVDSWVSYDDIHDRWMHYKDHIVPAGEVCVVPGACSSDYIDWFFRISHPFMTPGHAVDPLPHGHAPQPRVVPQAPQTDIPHVSEPGASSTSTEEPRHEVCDDIAERLEHHLSLGVLTPGSSTHEVIEECLRLARSVTQDHLVYVRCRRRRRTDQA

SEQ ID NO: 141629 - protein, 119 aa, Glycine max
  Coding DNA Sequence Number=SeqID_49944
MKVTKNGIIIRDLRWGSAFNIVWLDLVIGGDGRGIVHGGAEGRLSCTGRWVLARSEGLEGVVVRREMAVVGGYGGGCWWLWCLGQRRRLREKIMCCVVKGNSNNAFVVNNQKIINDVKK

SEQ ID NO: 141630 - protein, 172 aa, Glycine max
  Coding DNA Sequence Number=SeqID_49945
MVQGQLHSAVDERLKAKGGYIIEEDPSIRPTMRQVVKILEVEIDSIESDEDNMEMSLLGKIRSATTWSRAECALPYSGYPSFDEVKMFSFNSRTTRSGSNTTKHEDSKSEAQIKHHGFHQVQCTNLDQTLNETDNVAQDDTPLMKDGSRLFPKVIHSLPASQLHQRAPHKPH

SEQ ID NO: 141631 - protein, 202 aa, Glycine max
  Coding DNA Sequence Number=SeqID_49946
  Gene Ontology: Mol. function=nucleotide binding; Biological process =defense response
  Homolog annotation: Hit_ID=A5BU47; Match level="QueryCoverage=51%, HitCoverage=5%, E-value=5e-11, Identity=35%"; Hit description =Putative uncharacterized protein
  Subcellular localization annotation: CTP_CleavageSite=40; ConfidenceScore=5.46e-01
MTTPPPSPTQSEIPSDGTSRKTRQATRLRRLTARTLEQARATVSVNPATGRGSGPHKDQFHSYLGVVARDKIPIVHASWNDVPETLKNMIWDDILAKFDIPEGDNAKKKVMSTVATRWRQFKSALTTKYVYGNTDGQAKDDPLVKYGINEKDWPEFAKMRQTPTWQLTNAYFLISRGYGKRHKKFKSTMTLRTCCLGEAMSC

SEQ ID NO: 141632 - protein, 46 aa, Glycine max
  Coding DNA Sequence Number=SeqID_49947
SHVKTGNYECGYYVMQWIWCIVSGGLKDDWIHGGADKDYKECYECG

SEQ ID NO: 141633 - protein, 153 aa, Glycine max
  Coding DNA Sequence Number=SeqID_49948
MKKGALGAVVPPMLFEAYRSSCVDEEDVPPNAIVEVGDATPNDIVEAEDVAANGIAEAVDAPLNIVVDVVVAIEEATTNNVIGVEGAAPNNVVMVEGVPPKGDTAEDTTTQNDVVIVEEEETLNDATVTLKIEEPVRERKKRPMRRKVRRKKK

SEQ ID NO: 141634 - protein, 216 aa, Glycine max
  Coding DNA Sequence Number=SeqID_49949
MNKPGLSEFVLLSPRRAKRVCLAKHPMASRKRKSTASRPQEPYDTTRFISEVTWEHYEQNVHSRNILPERNVNLFVTEYDEFHRELERRWWYKALTRQPDGCIDVALVMVTWGGQVVLEPGEHYTAYTRFCHTHPDPQELASKLCIPGQGFVLNVEGAPWKLLRKDLTMLAPTWSVLSYFNLAPTSHMSDLIMDRARLVYRLVTKMDMDVGSFISG

SEQ ID NO: 141635 - protein, 152 aa, Glycine max
  Coding DNA Sequence Number=SeqID_49950
MCPGCRTRSIGGLGRFRRFHLPGSAQMGPMVVTVRPERVVSADYMEWFFRISHPFMTPTQAGDQHRDAPAVDPEDYIQPPSPHVPVAFDPPPYDDYEGYEAIAQKLECVLNLRIVTAGTELYDIMQDCLTIARGGPSADGTVRARQRRRTDH

SEQ ID NO: 141636 - protein, 99 aa, Glycine max
  Coding DNA Sequence Number=SeqID_49951
MVDSTRSKSHLDRLEEAIAKLTMNHLSLTATPNSMTLKLVELLQKMVTLESHPSSLTSSMDPPSLHPPQLKLEVPLFEDTDTLGWIFNITQFFDYHSTS

SEQ ID NO: 141637 - protein, 215 aa, Glycine max
  Coding DNA Sequence Number=SeqID_49952
  Gene Ontology: Mol. function=nucleoside-triphosphatase activity; Cellular component=chloroplast; Biological process=nucleotide -excision repair
  Homolog annotation: Hit_ID=A7PA20; Match level="QueryCoverage=99%, HitCoverage=64%, E-value=2e-25, Identity=46%"; Hit description =Chromosome chr14 scaffold_9, whole genome shotgun sequence
  Pfam annotation: Domain name=AAA_2; Domain location=109-215; Score =4.2; E_value=5.1e-06; Accession=PF07724.5; Description=ATPase family associated with various c
MRENNACLLDDPSVWKTVIAEGLTRSIVIDEVKQNDGAIILFIDELHTLIGTCASSRGALDVANILKSALTRGELKAIEILKGLIMKYEEFHGVRYEYDVLVATTSLSKQYISDVFLLNKAIDVIDEASSRVQLTQMQNSPKKEYYGSKEAMARFDMSEYMENHTVSKLIGALPIGYIGYENGGQLTEVVLCRPPSLFLFDEVEKAHEDVFKVFL

SEQ ID NO: 141638 - protein, 412 aa, Glycine max
  Coding DNA Sequence Number=SeqID_49953
  Homolog annotation: Hit_ID=Q9LFC1; Match level="QueryCoverage=98%, HitCoverage=96%, E-value=2e-40, Identity=29%"; Hit description =Putative uncharacterized protein F7J8_130
  Pfam annotation: Domain name=DUF674; Domain location=1-380; Score =74.5; E_value=3.7e-24; Accession=PF05056.3; Description=Protein of unknown function (DUF674)
MATDEQVHKVSLKVLVDKEKNKVIFAEAGKDFVDALLSILTLPLGTIARLVAKESNIPPVKFGSLSSLYESVSHLEDKYLRTQTCKEMLLQPRNSMESYCKHVKLNIDDTEPTKYFLCANLNCSIVSGRQLSIFRYQRCRCGNLMNREVFPIEVIPGNGFVNEIATFIICDDLSVLPNVVGTSVSLLRKLGIKDMATIDERNVDISKREVVDILKLSLLSKTPLTDFILEKKDDNFNPINQPQIGIGEKSSYESRKMDVKVLELKDKLANPQCAPQFNLHDQILPIGAVCLPLYYYVTVESCVCLTTSPNSWQFAIVDPKSCIGGSSSNGGFAKAQSMFLVTDDLVMTPMSSISCISFLNRSKVSPLDLEERVVKIGVKEALAILKASLTSTSALTNGLKQFIKKASIKREI

SEQ ID NO: 141639 - protein, 273 aa, Glycine max
  Coding DNA Sequence Number=SeqID_49954
  Gene Ontology: Mol. function=methyltransferase activity; Cellular component=chloroplast; Biological process=metabolic process
  Homolog annotation: Hit_ID=A5AQ51; Match level="QueryCoverage=35%, HitCoverage=29%, E-value=1e-33, Identity=66%"; Hit description =Putative uncharacterized protein
MDNNQGHQTTPSNVPFLDTAQLINVAVKDQATKHSTILMKMKEIIEAYPETTIRNVVVLVPIYFNDPQRQTTKDFSVNSGLNVMQTIHLSTTAAIVYGLEKKGISYAEKNIFIFYIGGGIHGLTSLFALCSRNLDVGVAAGFVSLLCGIGHNPTLSTFTCCKPSSCCYFPSTSMTLDDDEEAMLKLCCKRSNLKDGYTILDLGCGWGSLVLYIAKKYTNCKVTGSSYSTTQKTYIEEKCQDLQLQNLNIIVADIGIFEMEASLLENTLSTSVI

SEQ ID NO: 141640 - protein, 99 aa, Glycine max
  Coding DNA Sequence Number=SeqID_49955
  Pfam annotation: Domain name=HR_lesion; Domain location=9-81; Score= -40.7; E_value=0.002; Accession=PF05514.2; Description=HR-like lesion- inducing
MWRLVKECFMFPKTTKVVLKAHPQEKNFSDITNVFEQLKFLIAGAIALKGLGGVLLIFGSSFGALLLNMALFGALLFFIGMKNSIPRRVPKKAPKTKTY

SEQ ID NO: 141641 - protein, 611 aa, Glycine max
  Coding DNA Sequence Number=SeqID_49956
  Homolog annotation: Hit_ID=A2WTF9; Match level="QueryCoverage=19%, HitCoverage=47%, E-value=2e-08, Identity=36%"; Hit description =Putative uncharacterized protein
MEDLEDEAMMVHAELEGDEELGIDLGGGGSDEGLDGDLVESIVATIIPPAPCDPLWLLNRHAQHVAGQRRQPGLAHVRLLGVGADPDTEEGDVRVSQEGNESGWDGGRVDDLEDEAAVTGAELEGGDGVGLRVGLIIGPPLDIQAHHEVVAAADAVVVGEPRGDSGGVGGEEGVDYCVVVAALEGDFVEVVVVGVEGEVVVHHAHRDHWIKHSDAKKEITKLRNQNASSNLTGDKGINSRVLNLFMSEEAIVPEARGDVVGLVNVDAQEEAAQCGEPGRAQPKHLELLLGEGAKVDGIGHVEIVVSQKLLGVVSDADPNEFDVAVGEEGGEGAWDKGRVEDLKDEAVVVDAELEGGDGVGLLTVGLGVGPPLNVQAHDLEVVVGVAGVGGEPDTDLAGRSGYEGLDGVGAHFHFVAFVVVVADAVFSYQSWRNRISTEPVEFGILIECGATNPTGDKGINSSILNLLLSEGAIIPTTRGDIAGRANLKAQGAQTQRVEPGPIQLRHVELLRGKGAKVANIGHAEIVVLKKLVHVTMDADPDECDVGAGEEGDEGAWDGGRVEDLEDEAAVVHAEVEGGHGVVHVGQGVGPPLRDEAHDEARMVAGGVGGEP

SEQ ID NO: 141642 - protein, 149 aa, Glycine max
  Coding DNA Sequence Number=SeqID_49957
  Homolog annotation: Hit_ID=A5BQ55; Match level="QueryCoverage=26%, HitCoverage=8%, E-value=1e-12, Identity=80%"; Hit description =Putative uncharacterized protein
MFPLTKIQRSNRLRILCLNILEDTSFVVQVEGTSTWVVVTENKKGYISCGSVQVEGTSTWLFKENKGGYIPYGSLLVKDFTRLKEISRTGGCLRTGCRHGLLSNQSFTFRKILDEVEIRELLIDHVGHRCCWGFHPAQTWRIHQVEAYN

SEQ ID NO: 141643 - protein, 90 aa, Glycine max
  Coding DNA Sequence Number=SeqID_49958
  Subcellular localization annotation: CTP_CleavageSite=57; ConfidenceScore=5.66e-01
MAAPPSRHTPSSFLHRDTTMAAPPSRHAPPSRFDFTTQTRSSGQFLYETVSSTEGTRCGSIVGLEVKGISELGFMIGKDKDKTAKRKKRC

SEQ ID NO: 141644 - protein, 90 aa, Glycine max
  Coding DNA Sequence Number=SeqID_49959
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=62%, HitCoverage=29%, E-value=3e-19, Identity=80%"; Hit description =Chromosome chr4 scaffold_32, whole genome shotgun sequence
  Pfam annotation: Domain name=APC10; Domain location=1-90; Score= -86.9; E_value=0.066; Accession=PF03256.7; Description=Anaphase -promoting complex, subunit 10 (APC10)
MTGEIHDNNDGGDPITTVTVVGAQSSKFSTLPVNKLIVLYVVFKLDESYMPSKVSILADDGFHNLKEIKTVELVKPTGWVYLSLYGADPR

SEQ ID NO: 141645 - protein, 214 aa, Glycine max
  Coding DNA Sequence Number=SeqID_49960
  Homolog annotation: Hit_ID=A5C3B5; Match level="QueryCoverage=33%, HitCoverage=8%, E-value=4e-07, Identity=33%"; Hit description =Putative uncharacterized protein
  Pfam annotation: Domain name=zf-CCHC; Domain location=136-153; Score =28.1; E_value=3.2e-05; Accession=PF00098.14; Description=Zinc knuckle
MAGAGDGGGDYHQLDGSQRLLLDVMIIEMQRLLNRNNEELYGKIEEMKIEHVFSCNDYTEGQKQNHATKTPEAVPRKFNCGGVLQGDGDGTKYVELDDLLHKAVRVEQHPHGKSVVSSAETKHNSASSSNTDTRNIKCFKCLRRGHIAFECPTRRTMIIKANGEITSESEISEEEKVEEKLKEEAMKKDDWRRHFKEKMSQEQVHHHRKPWIRA

SEQ ID NO: 141646 - protein, 87 aa, Glycine max
  Coding DNA Sequence Number=SeqID_49961
MRLNLEVLKVVVALSSPFGLSAHPSLSVASARQKNLAEHQYQGRALSPGSAHDWSQGQIHLLALSARVVLSETSQIQSLFKACLVQN

SEQ ID NO: 141647 - protein, 78 aa, Glycine max
  Coding DNA Sequence Number=SeqID_49962
MNSITECLAQIPRLLFKKSHSKSLGPMMQAPLELVGLGSSSSMDSFAPWKMNGSGMEKEEKEETPLQGEDESRRSSPP

SEQ ID NO: 141648 - protein, 82 aa, Glycine max
  Coding DNA Sequence Number=SeqID_49963
MVITFHSEVRFRRIIYRAHGIQTEKLSRNSNGHNFSLGGPIQAHNISRRSELNNGTSQENPMVITFHTEVRFGRIIYPEARN

SEQ ID NO: 141649 - protein, 73 aa, Glycine max
  Coding DNA Sequence Number=SeqID_49964
MSNEELKLQDPRCRIQCPGHPARKYWSCCTMHKARQKLQDPRCRIQCPGHLARKYWTHKSVISLTDYCAVSNR

SEQ ID NO: 141650 - protein, 94 aa, Glycine max
  Coding DNA Sequence Number=SeqID_49965
  Subcellular localization annotation: CTP_CleavageSite=56; ConfidenceScore=5.15e-01
MGIAPTKTPSEPGKVQQGPGVSSSGYGPLSVLQGARIAPARHPVDPKKSNRVLELSSSNYGKGIRPPTDRALIKKYCVPRQAQGETPQQHWDGR

SEQ ID NO: 141651 - protein, 93 aa, Glycine max
  Coding DNA Sequence Number=SeqID_49966
QNRGGACHPARPGEQGYFLQKQQPSGGRIWKAQLSKKLRKLTDCAKTHLFDGISRIAQAYFLLISDTSRDFIYCATKDAKYLKAANQRLHVIK

SEQ ID NO: 141652 - protein, 127 aa, Glycine max
  Coding DNA Sequence Number=SeqID_49967
MGTNQTGKRFYQVKVKGLDTTSIKELGRLMEPLQMQAFRKTYGKILELTIAEVSIEAIASLTQYYDQPLRCFTFGDFQLGKKTISFLRLSPLFEQNCNGGQGFSKRFGPCKTDSKRHSGPTTEVPRR

SEQ ID NO: 141653 - protein, 209 aa, Glycine max
  Coding DNA Sequence Number=SeqID_49968
  Gene Ontology: Mol. function=peptidyl-prolyl cis-trans isomerase activity; Cellular component=periplasmic space; Biological process =protein folding
  Homolog annotation: Hit_ID=P0A9L3; Match level="QueryCoverage=48%, HitCoverage=49%, E-value=7e-49, Identity=95%"; Hit description=FKBP -type 22 kDa peptidyl-prolyl cis-trans isomerase
  Pfam annotation: Domain name=FKBP_C; Domain location=16-104; Score =129.6; E_value=8.8e-36; Accession=PF00254.19; Description=FKBP-type peptidyl-prolyl cis-trans is
VNSTESGLQFRVINQGDGAIPARTDHVRVHYTGKLIDGTVFDSSVARGEPAEFPVNGVIAGWIEALTLMPVGSKWELTIPHNLAYGERGAGASIPPFSTLVKVVADEEASSEQSLRRNLTNRHIQLIAIGGAIGTGLFMGSGKTISLAGPSIIFVYMIIGFMLFFVMRAMGELLLSNLEYKSFSDFASDLLGPWQAISRLDLLVLLGCD

SEQ ID NO: 141654 - protein, 27 aa, Glycine max
  Coding DNA Sequence Number=SeqID_49969
MGQDDRKCGRRYDNVSLCMLPYSESDG

SEQ ID NO: 141655 - protein, 98 aa, Glycine max
  Coding DNA Sequence Number=SeqID_49970
MEWFFRISHPFMIPTPAGDQPRDAPAADPEDYIQPPSPQDDYDGYEAIAQRLERVLNLRIVTAGTELDDIMQDCLTIARGEPSVDGTVRARQRRRTDH

SEQ ID NO: 141656 - protein, 97 aa, Glycine max
  Coding DNA Sequence Number=SeqID_49971
MREKEKKPQEANINLPYFHGKDNVEANLDWEIRVEQQLKKKYTSKSYGSHSYPKKDQGQGILGVTPSKGVEERIPEFQEPLYLRSNPFQGGKGNDAF

SEQ ID NO: 141657 - protein, 102 aa, Glycine max
  Coding DNA Sequence Number=SeqID_49972
MECPRAPPRYAHVAFESYPQENGGMAFVDKWAVGKEKGWVMTLLGWWETWPYRNGSHCMGFSLILTLFICPSFLIRPSRMIKFASFQTHFDLFAGENQIYKT

SEQ ID NO: 141658 - protein, 210 aa, Glycine max
  Coding DNA Sequence Number=SeqID_49973
TRGCIIYNPVLAIRQFGYPMRGASSEETIMPFITRGFNKANMKILQKIRKAWNKVGKKDKELRRRSNSVIGDYHKWLKSRTQGIAWHKKLKGLNGEEAGVPEESEEVQDLKAELGKTKVEKEKLKVVVTRVRKECDKLKDVNMSTTEALEQKMKKARKEEWSRNKFRGALLGSSNELKVSKAEKDKSRMENMMLKDKLRNFQRSKGSLKE

SEQ ID NO: 141659 - protein, 273 aa, Glycine max
  Coding DNA Sequence Number=SeqID_49974
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSMEQSSIQQSGRVWAMLGFPFMRQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141660 - protein, 88 aa, Glycine max
  Coding DNA Sequence Number=SeqID_49975
  Homolog annotation: Hit_ID=A7R3T6; Match level="QueryCoverage=94%, HitCoverage=18%, E-value=4e-25, Identity=71%"; Hit description =Chromosome undetermined scaffold_567, whole genome shotgun sequence
MAGVAATGMLLATNKIQPSQLAEEQRNAARLFKQLQTQIQTEIAIGNPSEGDVRDAIEKVLALDKAYPLPLLGGAMLEKFPAKFEAAR

SEQ ID NO: 141661 - protein, 109 aa, Glycine max
  Coding DNA Sequence Number=SeqID_49976
MILRLSWKGVISITLTNLADGSIDVALVQDFYANLYNSESPSPKQARVKGHLVKIDADSLNTFLETPMVLAEGETLPIYSKYCRLPLDLREIEAALCIPGRGFILQLLS

SEQ ID NO: 141662 - protein, 148 aa, Glycine max
  Coding DNA Sequence Number=SeqID_49977
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
  Subcellular localization annotation: CTP_CleavageSite=13; ConfidenceScore=5.03e-01
MEERAQIHPPSTTAQQLKTMNCRPSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141663 - protein, 169 aa, Glycine max
  Coding DNA Sequence Number=SeqID_49978
  Homolog annotation: Hit_ID=Q28658; Match level="QueryCoverage=59%, HitCoverage=57%, E-value=4e-08, Identity=34%"; Hit description=Small proline-rich protein 3
MTGPLNESISCFLIRVDPWVLVPSPSEDYTSSPSEDYTSSPSEDYTSSPSEDNTSSPSEDNTSSPSEDYTYSPSKGYMPSPSEDYMSSPLKDYTSLPSEDYTSSPSEGYTSSPLEDYTSSPLEGCTSLPSEGCKPSPLVGWMPSPSKGDMSPTLEGYVSSLSVGSIATP

SEQ ID NO: 141664 - protein, 98 aa, Glycine max
  Coding DNA Sequence Number=SeqID_49979
  Subcellular localization annotation: CTP_CleavageSite=87; ConfidenceScore=5.27e-01
MLSSSYAPSSSPGIPAGCTGKSSHSTAPDPYDWPPAGRSHAAYMHASGAPSSASSTSPGNAILPPRTLDRRLQEDWAKDAREGPRVLMSLRVDFRLMG

SEQ ID NO: 141665 - protein, 66 aa, Glycine max
  Coding DNA Sequence Number=SeqID_49980
  Gene Ontology: Biological process=transposition, DNA-mediated
  Homolog annotation: Hit_ID=Q1J7G7; Match level="QueryCoverage=45%, HitCoverage=42%, E-value=2e-10, Identity=100%"; Hit description =Transposase
GFPVSTGTPGFIYLRSDLPSQWLLFLSAVPPVQLLTGWCVTAKAPPDISAGKCSGHAARNHHTRRA

SEQ ID NO: 141666 - protein, 171 aa, Glycine max
  Coding DNA Sequence Number=SeqID_49981
MIESFQQQQMSVLELYVKKDVVGGSMFHAANSVTSCGHNVSHHDLELPRNISNLHDDEDDDDDYLTSNSYVEESFDEDDSVDGISDTDDEVTDIVEPASIVHPTEGVPEIQNPLWNDALHYNNINWSHPDEEDICGLDMPTTFNVGQELYVGMDFDNKDAIKNPLKQYVMK

SEQ ID NO: 141667 - protein, 211 aa, Glycine max
  Coding DNA Sequence Number=SeqID_49982
  Subcellular localization annotation: CTP_CleavageSite=41; ConfidenceScore=5.34e-01
MVEPSKKRKGSSSTTAATAHRRHRPSEAPTAPIHPSLSSPRSSMLFSSDDQRLRYHSQFSSRIILDPKYLDVDFFNDETFDCYQVFQNSGLVDFMSLKLPHYPELVKVFYCNLKIQDNIISSEVHGIPMFIDQSLFFSLTHLPSQGAPFEGTIVDDWKFDYSSHDARRMVCNDQAEMTVTSYGYCKDQNGQWLKKDALPLQDERTPSPPPQ

SEQ ID NO: 141668 - protein, 131 aa, Glycine max
  Coding DNA Sequence Number=SeqID_49983
  Gene Ontology: Mol. function=structural constituent of ribosome; Cellular component=ribonucleoprotein complex; Biological process =translation
  Homolog annotation: Hit_ID=A1W322; Match level="QueryCoverage=100%, HitCoverage=100%, E-value=2e-61, Identity=91%"; Hit description=30S ribosomal protein S8
  Pfam annotation: Domain name=Ribosomal_S8; Domain location=5-131; Score=216.0; E_value=9.1e-62; Accession=PF00410.10; Description =Ribosomal protein S8
MSMSDPIADLLTRIRNAQMVSKTTVTAPSSKVKVAIAQVLKDEGYIDGFQVKTDAGKSELEITLKYYAGRPVIERIERVSRPGLRVYKGRDAIPQVMNGLGVAIVTTPKGVMTDRKARATGVGGEVLCYVA

SEQ ID NO: 141669 - protein, 279 aa, Glycine max
  Coding DNA Sequence Number=SeqID_49984
  Gene Ontology: Mol. function=sequence-specific DNA binding; Cellular component=intracellular; Biological process=regulation of transcription, DNA-dependent
  Homolog annotation: Hit_ID=A4W5U0; Match level="QueryCoverage=98%, HitCoverage=100%, E-value=1e-145, Identity=87%"; Hit description =Transcriptional regulator, AraC family
  Pfam annotation: Domain name=AraC_binding; Domain location=28-163; Score=92.6; E_value=1.2e-24; Accession=PF02311.10; Description=AraC -like ligand binding domain
  Pfam annotation: Domain name=HTH_AraC; Domain location=179-225; Score= 47.0; E_value=6.6e-11; Accession=PF00165.14; Description=Bacterial regulatory helix-turn-helix proteins, araC family
  Pfam annotation: Domain name=HTH_AraC; Domain location=231-274; Score= 28.4; E_value=2.7e-05; Accession=PF00165.14; Description=Bacterial regulatory helix-turn-helix proteins, araC family
  Pfam module annotation: Pfam domain module=AraC_binding::HTH _AraC::HTH_AraC; Domain location=28-163::179-225::231-274
MRRLPVQGVPEQFIDERDHARFRHLAQVPGIELYHAHISRYAFEPHTHEAFGIGTIETGAERFRYRGTQHLAPEKSVVTMNPNEIHTGESATEDGWRYRMVYIEPDLLEEVTGLRHWWFSDVTRYDPLRSQQIGRLIYGLWHTDDPLAQKGLLLDLIETFQPLAHHAPVIHEGAHRFERVREYLHDNYMHALTLDELASVVSLSPYHFQRQFKAHFHVTPHQMLMAIRLWRAKAFLTHGMPAAEVAAATGLTDQSHLTRAFTRRYGITPVRYQKQVARR

SEQ ID NO: 141670 - protein, 181 aa, Glycine max
  Coding DNA Sequence Number=SeqID_49985
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=75%, E-value=7e-24, Identity=65%"; Hit description=LacZ protein
MKHFTDTLISANILVPGPPSRSTVSISLIRASENKADAKENLKEEEAAFREKIAMLASNSCSPGDPLVLERPPPRWSSNSPYSESYYNSLAVVLQRRDWENTGVTQLNRLAAHPPFASWRNSEEARTDRPSQQLRSLNGEWDAPCSGALSAAGVVVTRSGTATLASADVRRCFCRYAPPRQ

SEQ ID NO: 141671 - protein, 94 aa, Glycine max
  Coding DNA Sequence Number=SeqID_49986
MVKGVVTVVFRKIFGRTVLPEVTKGHPEEHFFRKSSGTPSSGNFPEEVVLPENFRKKGTFGCPLNIPEELSGRATSSGKFPEELLLPKVCLFFF

SEQ ID NO: 141672 - protein, 135 aa, Glycine max
  Coding DNA Sequence Number=SeqID_49987
MTQKLVARGDTLRICRSKSLAFVGRPIIFVILTLRSCDVHPLYHPEAAGPMIRGDTLRLFAPICHPEAAGPMTSRDQVWSFCTLVSSRGGGPDDTRRYLTVIRTLLSSRGGGPDDKQRPSLVILHPCIIQRRRAR

SEQ ID NO: 141673 - protein, 108 aa, Glycine max
  Coding DNA Sequence Number=SeqID_49988
LPGINRDTRIKFIDFFAKVNFEAPVAYHGFYQLFLLFSTDGELVIRSNSHTSIPTGTSARQVRNCSGNADRCRAFAIKNRQRGERGMCCKFAIKLGQEKEKLHRGGGR

SEQ ID NO: 141674 - protein, 147 aa, Glycine max
  Coding DNA Sequence Number=SeqID_49989
  Homolog annotation: Hit_ID=Q6UUU1; Match level="QueryCoverage=40%, HitCoverage=40%, E-value=1e-18, Identity=78%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKQFAPSWTVCTNPPFSPTAAPYPGTIVLSPTRKDMQKHHWQQPT

SEQ ID NO: 141675 - protein, 52 aa, Glycine max
  Coding DNA Sequence Number=SeqID_49990
MEEKVKQQINGASMRSFNGDFPPWRCSGRQRIRGERRHHPQGNKPWKKELHH

SEQ ID NO: 141676 - protein, 68 aa, Glycine max
  Coding DNA Sequence Number=SeqID_49991
MENWRTALGSKFAGLHTRWWKTHDSALGNNSWVSEKKWRMETWRTTARQEIRGASILDGAGQLNSASN

SEQ ID NO: 141677 - protein, 82 aa, Glycine max
  Coding DNA Sequence Number=SeqID_49992
KTPIHGFTEPIQLNIFIDGLRPQSKQLLDASLGGKIKLKIPEEAMELIDNMAASDHVILHDRTRIPTKRSLLELSSQDALLA

SEQ ID NO: 141678 - protein, 146 aa, Glycine max
  Coding DNA Sequence Number=SeqID_49993
  Homolog annotation: Hit_ID=Q84VH5; Match level="QueryCoverage=63%, HitCoverage=13%, E-value=4e-33, Identity=79%"; Hit description =Envelope-like protein
MLSQHPNMLNYTDSVMKRESPLSLHYKLFEGTHVPDIVSTSGKAAASGAVSKDALIAELKDTCKVLEATIKATTEKKMELERMITRLSESGIDDEEAAEEEEEAAEEDKEAAEEEEEAAEEEEEAAEEEEDAAEETESDDDSEATP

SEQ ID NO: 141679 - protein, 153 aa, Glycine max
  Coding DNA Sequence Number=SeqID_49994
MERSMIDAASGGALGDMTTAEARNLIEKMASTPSNLVPEVMLLSLEECMNLCCKHQQQTSSTQQQNQPQQNNYDLSSNRYNPGWRNHPNVRWSNPSKQQQQQQPYFQNVASLSRPYVPPPIEQQPQKQQTVEAPPQPSLEELVRQMTMQNMQF

SEQ ID NO: 141680 - protein, 115 aa, Glycine max
  Coding DNA Sequence Number=SeqID_49995
MTRGNPGDLQPFDPEIDRTFHILVTYSMHPDHSVHFEHSEYYVAGDSEYSDFEHSTTNFHTKNMAQPPPHERTLREMAAPDFTYESLCIQYPDEGVPYVLKTGLIHLLPKFHGLA

SEQ ID NO: 141681 - protein, 203 aa, Glycine max
  Coding DNA Sequence Number=SeqID_49996
MTTLTQIWMTLLLSNIQPSDHNSNLPLPKCQLVYAILTRMSIHVAQLIIDAIYIFAVLVAPSKVIRPPITRAFIEKYCTQRQVQGDAPQAADAPPPNQAGPAELFDTKQYLRHLVRQQVANHRAHVQTHDCLYQMSLSLQSKGFTSFPCPTPDQFRAEVAWPGDWPEARAGEASTEAPDEADEAREDEEMTDLLDFLGGSGAT

SEQ ID NO: 141682 - protein, 131 aa, Glycine max
  Coding DNA Sequence Number=SeqID_49997
  Homolog annotation: Hit_ID=A2Q1D6; Match level="QueryCoverage=69%, HitCoverage=14%, E-value=5e-14, Identity=46%"; Hit description =Ovarian tumour, otubain, related
MDEDQWRYDFAMSQEVDMDYDYDNQEECGVNERHVDCSNAFNTSQVFATRDDVLQWARTVAHENGFVAVIMRSDTETGSRGRSSFVLIGCERSGTYKCRNKEFVRKDTGSRKCGCPFRLRGKPVRGGEGGW

SEQ ID NO: 141683 - protein, 88 aa, Glycine max
  Coding DNA Sequence Number=SeqID_49998
MAFESFKSKNMIQYHSYVHSAAPDVWNYNTSSSDSVLIKKIIQIRDFIISKELSTEEANKRIQSWSTNEQLLVGKAYEYIRDIKPTVS

SEQ ID NO: 141684 - protein, 95 aa, Glycine max
  Coding DNA Sequence Number=SeqID_49999
MANQEEWVPFMDVLVLLNFGVVLFPNMDGLVDLATIDAFLAYHHSKESPMVAILADLFVTFDRRCKKSSARIICCLPALCVWLVSHLFQQDKRHP

SEQ ID NO: 141685 - protein, 48 aa, Glycine max; identical to SEQ ID NO: 114043
  Coding DNA Sequence Number=SeqID_50000

SEQ ID NO: 141686 - protein, 91 aa, Glycine max
  Coding DNA Sequence Number=SeqID_50001
MEAIKEQMAIMMEAMMSMKKIMEANAVIVAATSAVAKDVNNSTPILIKSQQPQSDHAHVSRPMEETHEIPHHDLANFEPCLGYAAEGQAVG

SEQ ID NO: 141687 - protein, 34 aa, Glycine max
  Coding DNA Sequence Number=SeqID_50002
AGEAPAKAPGDTDEARMDEEMTNLLDFLGGSEAT

SEQ ID NO: 141688 - protein, 76 aa, Glycine max
  Coding DNA Sequence Number=SeqID_50003
MSLHSSSSVNGEGSTPKDPFLSEELRDYYEGRHRSHLRPHSHRREKERKPQEANIKLSYFHGKDNVEANLDWEIRV

SEQ ID NO: 141689 - protein, 75 aa, Glycine max
  Coding DNA Sequence Number=SeqID_50004
MGSSGFDPIPFRSVLLIEFCKRFRSFFGESRGLSDGCAQPNVIYVDPSQTSLQLRGRFSKQEASGKTACYSEFEK

SEQ ID NO: 141690 - protein, 121 aa, Glycine max
  Coding DNA Sequence Number=SeqID_50005
  Homolog annotation: Hit_ID=Q2QS50; Match level="QueryCoverage=94%, HitCoverage=27%, E-value=4e-08, Identity=31%"; Hit description =Transposon protein, putative, CACTA, En/Spm sub-class
MSKNWVLKKHNKTFCDWFKDTILADENASETLRKLADGPKRNVITWQGYDINSNTSVRTDDIGFMLGKTVGVNVEDDDSYMDTYVSPLTTQITRNVVGEEEADDVHANRNDHDEGELINIV

SEQ ID NO: 141691 - protein, 139 aa, Glycine max
  Coding DNA Sequence Number=SeqID_50006
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=61%, HitCoverage=71%, E-value=3e-24, Identity=68%"; Hit description=LacZ protein
MAEDRPQGITLEDYSSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141692 - protein, 143 aa, Glycine max
  Coding DNA Sequence Number=SeqID_50007
  Homolog annotation: Hit_ID=A5BSR3; Match level="QueryCoverage=51%, HitCoverage=24%, E-value=4e-07, Identity=42%"; Hit description =Putative uncharacterized protein
MMEEKKKKKLEEVAQSRSTYTMIDHPSSIRQHVKWKMARTKKTSQMMSEATKEIADMIGKDSLEEQTLQGSFVAHGRQDLLTAAIGRPEHLGHVRAAGVGVRIKQYFGPTLRTSRMSSSMAPEDLEQLTQKIRDQLEESITEK

SEQ ID NO: 141693 - protein, 59 aa, Glycine max
  Coding DNA Sequence Number=SeqID_50008
MWRKSKGGVFAQSVSFRDFFERPTWAFQKIPLEGCCFWRKQPGSPGRAGRQASPLFCYK

SEQ ID NO: 141694 - protein, 153 aa, Glycine max
  Coding DNA Sequence Number=SeqID_50009
MPPTRHPLHPDKSNKALGFPAFITGFYQSFGVPVTPNKAADAPPPPHQADPAGSFGMERYLQHLVRHQMANHRGQVQIHECLYQLNLSQQSQGFTPFACPTPDQFRAEVAWPGDWPEAQVGEAPAEAPGDPEEARMDEEMTYLLGLLGGSGAT

SEQ ID NO: 141695 - protein, 175 aa, Glycine max
  Coding DNA Sequence Number=SeqID_50010
  Homolog annotation: Hit_ID=A2Q4S5; Match level="QueryCoverage=72%, HitCoverage=24%, E-value=3e-14, Identity=33%"; Hit description=IMP dehydrogenase/GMP reductase, putative
GCYAWGTAAFVHMYDNLNDASKSMARKLAGYITLLQHFPSVGFVVPAEDYDERRPCACRWTSGKALLVSMYRRCLDRLTPDVVCWIPYGDHRSFKEFEFGYIQTIPPHPAVSSLSVEEIDDRWMQFDMYQQPMAAATPNKANVDVHHVQHAVDGFVAIGDKLERLLNLRILTEGT

SEQ ID NO: 141696 - protein, 190 aa, Glycine max
  Coding DNA Sequence Number=SeqID_50011
MTMIVDTLPVFYYGKRWATHLQSFEDLVFASERIDVGLKKGKFDHPTRTTEKTGANKEGEDEGETHAVTAIPVRPSFPPTQPYLYSANNKLSPYPPPSYPQRPSLNLPQSLSTALPMTNTTFSTNQKHQPRTITLAKVHQPPFLREYDSNATCACHGEAPGRSIEHGRALKRKVQGLIDAGWLKFEENCV

SEQ ID NO: 141697 - protein, 149 aa, Glycine max
  Coding DNA Sequence Number=SeqID_50012
  Gene Ontology: Mol. function=aspartic-type endopeptidase activity; Cellular component=small subunit processome; Biological process=DNA integration
  Homolog annotation: Hit_ID=A5CAN5; Match level="QueryCoverage=95%, HitCoverage=28%, E-value=5e-15, Identity=31%"; Hit description =Putative uncharacterized protein
MGHTQDNCYSLHGFPDKVAQVSRSEKTESRFSDEEYQEYLKLKSEKPSNQAQSSSVPCFSTACISQSIEVTFTANSFVIQEHGTGRLIGEGHESRGLSYLESSPPGACFAISKPKLLHDRLGHPSLPKLKMMVHSLKNLRVLDYVLGFI

SEQ ID NO: 141698 - protein, 58 aa, Glycine max
  Coding DNA Sequence Number=SeqID_50013
  Homolog annotation: Hit_ID=A0PAV3; Match level="QueryCoverage=65%, HitCoverage=17%, E-value=5e-07, Identity=76%"; Hit description =Restriction endonuclease
MVKVGTSYVPINVSFSPKVGPGLPGINRDTRIYLFCEVIFRHRCSSGFCFYQLSLLFS

SEQ ID NO: 141699 - protein, 78 aa, Glycine max
  Coding DNA Sequence Number=SeqID_50014
  Gene Ontology: Biological process=transposition, DNA-mediated
  Homolog annotation: Hit_ID=Q1J7G7; Match level="QueryCoverage=50%, HitCoverage=55%, E-value=2e-15, Identity=97%"; Hit description =Transposase
DLPSQGIYSAQSASGDAAQLTDLVYDGVFEVLQWLLFLSAVPPVQLLTGWCVTAKAPPDISAGKCSGHAARNHHTRRA

SEQ ID NO: 141700 - protein, 96 aa, Glycine max
  Coding DNA Sequence Number=SeqID_50015
MSNEELKLQDPRCRIQCPGHPARKYWTHKSVISLTDCAGSTMSDTISLSADCQEDDRSHPAQVVAAQIRTLLYKHEGCTSSLPSPRLKSYFVSFGT

SEQ ID NO: 141701 - protein, 126 aa, Glycine max
  Coding DNA Sequence Number=SeqID_50016
MSGFTHDSPQISASMHQLDLAPYASEPYNAQWNALGLLHDKHTLRSSRILGEMEVDEPWLGLWLPLNYQADMGTMRKTDFVVVLGMAFVDNWAVGNEKEWQSQHGLLLHPHPPHLPQFSHSSKQDD

SEQ ID NO: 141702 - protein, 299 aa, Glycine max
  Coding DNA Sequence Number=SeqID_50017
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSISHTFTKIIVTAHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141703 - protein, 42 aa, Glycine max
  Coding DNA Sequence Number=SeqID_50018
MDKSLKVGEDELREKERRSTEFYASNEPTNPRSSPRFSTKWA

SEQ ID NO: 141704 - protein, 362 aa, Glycine max
  Coding DNA Sequence Number=SeqID_50019
EMALKKLSMKRSRRDATGEESSADPEFDSHRFRSAEHQQRFEAIRGWSFHRERRVQLREDEYTDFQEEIARKRWTPLVTPMAKFDPEIVLEFYASAWPTEEGVRDMRSWVRGQWIPFDVDSLSQFQGDPLVLEEGHKCEFSQKRNRANDFDKEAIAQLEAGADHAHQHDHLDPDMDDSAAQQCMAPTRHPLDPDKSNRALGFPALITGLCQSFGVPVAPSKVIRPPITRAFIEKYCTQTQAQGDAPQAAGAPPPPHQADPAGSFDTERYLRHSMRQHVANHKGLGQVHECLYQLSLSMQSQGFAHFPCLTPDQFRAEVAWPGDWPEAQAGEAPAEAPDDGEEAGMDEEMSDLLGFLGGSGAT

SEQ ID NO: 141705 - protein, 232 aa, Glycine max
  Coding DNA Sequence Number=SeqID_50020
  Pfam annotation: Domain name=zf-CCHC; Domain location=1-16; Score =22.8; E_value=0.00053; Accession=PF00098.14; Description=Zinc knuckle
CYKCNQPGHIKTNCPANEQWTEKTEKKNYGERKAKKAYIAWDNNDSSEGSKKEEINLLTNNYENPKFLDLKFNDDEMFDCFQAFQNFGLTQFMSMKLPFYPELVRAFYSNLEIQEGTLVFEGTIDEEWKFDFSSHDACRLVCTNQANITSRLLAGSLAFECRIMHYLIMHILLPRSSNLAQALRSNAPIPYPHLITLILRHFDVPLDSETFVQVKKDIPAQVAEDRSPSPPP

SEQ ID NO: 141706 - protein, 45 aa, Glycine max
  Coding DNA Sequence Number=SeqID_50021
MAPRKLSTKRSRKDVAAEGTSATPEFDNHRFRSVEHQQRFEAIKG

SEQ ID NO: 141707 - protein, 277 aa, Glycine max
  Coding DNA Sequence Number=SeqID_50022
MGTGGCINYNLVLAIRQLGYPMRGAPQEENLAPIIARGSSNGPIGGYHRWLKAHMQGLGWLPSLRTTEGVEVEAPKEDKEVQALRTELEKTQTVKEKFKSAALKIRKARREEHGRNKFRGALWGSNSELKLQREEMDQSRVDSLILKDELRICLRSKRSLSQRLCETETNMLAIISKYQEELNLATTYEHKVADEYARVYVDKEARGRVIDSLHQEATMWMDRFALTLNGSQELPRLLAKAKAMADAYSTPEEIHGLLSYCQHMIDLMAHIIRNHYK

SEQ ID NO: 141708 - protein, 286 aa, Glycine max
  Coding DNA Sequence Number=SeqID_50023
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=23%, HitCoverage=65%, E-value=9e-33, Identity=100%"; Hit description=LacZ protein
MASISEVMLKLQKTIEDKATTTASSTVREAEPVLQPALNPGLDRNTAVFGRRYSPQAYPYGLPPNFTPRATPEDLSQAPTFEGQLPPYEDYPGQDDGEGDTHLGPLLHLKDPSPHELPQPNIVRHIPASPIPVKEYVPFAEDKGKIEALEEILRAVEGLGNYPFSDLADLCLVPNIVIPPKFKVPYFDKYGDPLESTCRHASLALAVVLQRRDWENPGVTQLNRLAAHPPFASWRNSEEARTDRPSQQLRSLNGEWRLMRYFLLTHLCGISHRIWCTLSTICSDAA

SEQ ID NO: 141709 - protein, 95 aa, Glycine max; identical to SEQ ID NO: 109893
  Coding DNA Sequence Number=SeqID_50024
  Homolog annotation: Hit_ID=A0PAV3; Match level="QueryCoverage=40%, HitCoverage=17%, E-value=5e-07, Identity=76%"; Hit description =Restriction endonuclease

SEQ ID NO: 141710 - protein, 89 aa, Glycine max
  Coding DNA Sequence Number=SeqID_50025
  Gene Ontology: Mol. function=hydrolase activity; Cellular component =cytoplasm; Biological process=regulation of translational termination
  Homolog annotation: Hit_ID=A8G959; Match level="QueryCoverage=100%, HitCoverage=69%, E-value=7e-33, Identity=85%"; Hit description =Putative endoribonuclease L-PSP
  Pfam annotation: Domain name=Ribonuc_L-PSP; Domain location=7-89; Score=77.2; E_value=5.2e-20; Accession=PF01042.12; Description =Endoribonuclease L-PSP
MSRNISTELAPAAIGPYVQGVDLGSMIITSGQIPVDPKTGAVADDVAAQARQSLENVKAIVEAAGLIVADIVKTTVFVKDLNDFATVNA

SEQ ID NO: 141711 - protein, 70 aa, Glycine max
  Coding DNA Sequence Number=SeqID_50026
MSLHSSSSVIGEGSTRKDPLYKILDELRSLKFWKEKQERKVRNHVPSWEDAQERGVEGKSPEFQEPLDLR

SEQ ID NO: 141712 - protein, 43 aa, Glycine max
  Coding DNA Sequence Number=SeqID_50027
STKNESKMQPKVAWGSKNRESRGNITMALYRLAFAFSNPLKVD

SEQ ID NO: 141713 - protein, 44 aa, Glycine max
  Coding DNA Sequence Number=SeqID_50028
MTVSKLRNDAKRTMAVCGGYWWLWVMEKDLGMLEMVLEERMRKM

SEQ ID NO: 141714 - protein, 71 aa, Glycine max
  Coding DNA Sequence Number=SeqID_50029
MLLSSKVIYICVRVVMLARMIHTCLFAAIWVKSCPETYSAPFIIQEQQAEWVNAQRQILRPLSFRNNRPSG

SEQ ID NO: 141715 - protein, 148 aa, Glycine max
  Coding DNA Sequence Number=SeqID_50030
MAPTRHPLDPDKSNRALGFPALITGLCQSFGVPVTPSKVIRSPITRAFIKKYCTQRQVQGDAPQAADAPPPHQAGPAGLFDTEQYLRHLMSLSLQSQGFTSFSCPTPDQFRAEVAWPGDWPKAQAGEAPAGAQQRLPTRQMRSARTKR

SEQ ID NO: 141716 - protein, 116 aa, Glycine max
  Coding DNA Sequence Number=SeqID_50031
MASHEEKSHNFSVSGRGYGARGELASYSRFPKLRPDPQELAARLCIPGTGFVLNVEGLSWKFLRKDLTTLAQTWSVLSYSNLAPTSHTSDLNLDRAKLVYGLVMKMNMNSGSLISG

SEQ ID NO: 141717 - protein, 147 aa, Glycine max
  Coding DNA Sequence Number=SeqID_50032
  Homolog annotation: Hit_ID=Q2HW90; Match level="QueryCoverage=58%, HitCoverage=18%, E-value=1e-08, Identity=32%"; Hit description =Putative uncharacterized protein
MGQLQRQAFHKAYGKIWDLARVEVSMEPIASLSQYYDQPLRCFTFEDFQLVPTVKEFEEILGCPLGGRKPYLFSGLYPSTTRVAKVVKISAQELDRKEGRIRILSSCEGCPMRGVPSDESITPFIARGFSDHNARVLQGVRKAWDAA

SEQ ID NO: 141718 - protein, 44 aa, Glycine max
  Coding DNA Sequence Number=SeqID_50033
MIENSPKFPFALRHTPLKGPPMTEWSVQFSHQPKDGRSTSPRKI

SEQ ID NO: 141719 - protein, 91 aa, Glycine max
  Coding DNA Sequence Number=SeqID_50034
MCNKRGCQVISKSGQSKLYIIETNNPPNLKKASSKESGVNDEASRTVKLKNHSQIINLTDSISFNGSSRFFTEQSDQFRLSNFERMRRAKK

SEQ ID NO: 141720 - protein, 49 aa, Glycine max
  Coding DNA Sequence Number=SeqID_50035
MKEVDLITKKGWVPISRSLALAIIKVSNTSGVDRKVLVWDLEDGYCTHS

SEQ ID NO: 141721 - protein, 111 aa, Glycine max
  Coding DNA Sequence Number=SeqID_50036
  Subcellular localization annotation: CTP_CleavageSite=36; ConfidenceScore=5.06e-01
MQVGSATFIIRVIKHSGICSGDSKILQVASRFQDVTTSHVTSAFCSPCLHALTVVKQFTAAFCKLQIYKSFPGCQDISCDISFLLPLSPCSYCIFYQLLVSVAAAVSPSKS

SEQ ID NO: 141722 - protein, 266 aa, Glycine max
  Coding DNA Sequence Number=SeqID_50037
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDLCVSAVATRPTPDMLMDAIVNFYKALVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141723 - protein, 209 aa, Glycine max
  Coding DNA Sequence Number=SeqID_50038
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=24%, HitCoverage=50%, E-value=1e-23, Identity=100%"; Hit description=LacZ protein
  Pfam annotation: Domain name=DUF617; Domain location=1-92; Score= -59.6; E_value=0.0001; Accession=PF04759.4; Description=Protein of unknown function, DUF617
MQLARQVSRLESGQEQKLVPGPPSRSTVSISLICGYAVSRTCGDLDWHVLSTIQSVSVGAGVIPLLEDGKAASAAAGGGSEGELMYMRASPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141724 - protein, 22 aa, Glycine max
  Coding DNA Sequence Number=SeqID_50039
MEEKMQWKIKEKRSEEAPSTRE

SEQ ID NO: 141725 - protein, 51 aa, Glycine max
  Coding DNA Sequence Number=SeqID_50040
MTGDKNRSCMNTLKRELNLKGTSLMQAITGSHAGNQIMMIKQKELLIWMTC

SEQ ID NO: 141726 - protein, 139 aa, Glycine max
  Coding DNA Sequence Number=SeqID_50041
MSIPHKEKGQGGGHDIQRMWRNIDIVRERLTFMAFPYSLGQQSLSMVSQLTALPLVELASIMWFTFLSMIAGSCQVLLLIQAPMANDAVKGRTRLPSTNQGIMGVCPTHRSSVPKSRAGIHDRAKGNIMPIFVRDTVIF

SEQ ID NO: 141727 - protein, 331 aa, Glycine max
  Coding DNA Sequence Number=SeqID_50042
  Gene Ontology: Mol. function=inorganic phosphate transmembrane transporter activity; Cellular component=periplasmic space; Biological process=phosphate transport
  Homolog annotation: Hit_ID=P0AG82; Match level="QueryCoverage=100%, HitCoverage=100%, E-value=1e-163, Identity=82%"; Hit description =Phosphate-binding protein pstS precursor
  Pfam annotation: Domain name=SBP_bac_1; Domain location=8-297; Score =107.8; E_value=3.2e-29; Accession=PF01547.16; Description=Bacterial extracellular solute-binding protein
MKVMRTTVATVVAATLSLSAFSVFAEASLTGAGATFPAPVYAKWADTYHKETGNKVNYQGIGSSGGVKQITANTVDFGASDAPLSDDKLAQEGLFQFPTVIGGVVLAINLPGVKSGELVLDGKTLGDIYLGKIKKWDDETIAKLNPGLKLPSQNIAVLPGKVNEEWKSKVGSGSTVNWPTGLGGKGNDGIAAFVQRLPGSIGYVEYAYAKQNNLSYTKLVSADGKPVSPTEENFANAAKGADWSKSFAQDLTNQKGEGAWPITSTTFILVHKEQKKPEQGAEVLKFFDWAYKNGGKQANALDYATLPDNVVEQIRAAWKTNVKDSSGKALY

SEQ ID NO: 141728 - protein, 121 aa, Glycine max
  Coding DNA Sequence Number=SeqID_50043
MVGYTPSSFDDMVFTDERNKVGLKRGKSDHHALINAKKKLGQMKRLSTKAIPKSTTKSVYRTSNVSQRALCGRARVRLTGALSKGGKMRGVATNEGISTSHVDKSGAFAPTYTPLERKSDQ

SEQ ID NO: 141729 - protein, 87 aa, Glycine max
  Coding DNA Sequence Number=SeqID_50044
MAAEWRRKRERRRHFKEQMSLEEAHHHRRLWIRAWRKKEMNEWGGREDDQGVPVNLKRIKVIPEWPTPPNIRKIWGFHDLTNFYKSC

SEQ ID NO: 141730 - protein, 124 aa, Glycine max
  Coding DNA Sequence Number=SeqID_50045
MPMLDQFHPFIHDFIDNIVDVKADGMGEDSWSLVRNHLLIELGKWSDDYIKLFGGTNRFEELRRSLLVDGLSMVTMDKWMDITEMGYVIASRLIRQALESVVFHLLAKPICWLSEHPLSAKLLG

SEQ ID NO: 141731 - protein, 166 aa, Glycine max
  Coding DNA Sequence Number=SeqID_50046
MPPTRHPLDPDKSNRALGFPAFITGLYQSFGVPVTPKKYCTPRQAHGGDPQAPDAPPPPHQADPAGSFDTEWYLWHLVRPQAANHRAHMQTHDCLYQLSLSLQSQGFAPFPCLTLDQFRAEVAWPGDWPEAQAREAPAEAPDDADEARMDEEMTDLLDFLGRSGAT

SEQ ID NO: 141732 - protein, 252 aa, Glycine max
  Coding DNA Sequence Number=SeqID_50047
  Homolog annotation: Hit_ID=Q6WAY4; Match level="QueryCoverage=82%, HitCoverage=37%, E-value=9e-23, Identity=33%"; Hit description =Putative uncharacterized protein
MGTNQTGKRFYQVKVKSLDTTSIKELGRLMKPLQMQAFRKTYGKILELTIAEVSIEAIASLTQYYDQPLRCFTFGDFQLVPTIEEFEEILGCPLGGRKPYLSSWCLPSLSRIATVVKDSARGLDRVKQTRNGIAGLPRKYLEDKAKDMVSQGDWVPFMDVLALLIFGVVLFPNVDGLVDLAAIDAFLAYHHSKESPVVAVLAALFDTFDRRCEKSSARIILSYLLGWGQNVDSRNQSRYLGTDASGDGVTTD

SEQ ID NO: 141733 - protein, 48 aa, Glycine max
  Coding DNA Sequence Number=SeqID_50048
MENNDGCYTVDPEKYNRALGFPALVMGLCQFYRVPIPPSKGSRPQDTQ

SEQ ID NO: 141734 - protein, 155 aa, Glycine max
  Coding DNA Sequence Number=SeqID_50049
  Subcellular localization annotation: CTP_CleavageSite=67; ConfidenceScore=5.16e-01
LFCLTDSKKFITDNQLGYFRPAQKTTLVSACYQAFRLTDSKNFITDNQSGISARQRVSKFSMTNLVSAEDDKSPRVNGLVAAIDEGFSSYRQQKVYTDNHSGISARQRDSKVSMTYLVSAEEIQQKVYTDNHSGISARQRDSKVSMTDLVSAEDD

SEQ ID NO: 141735 - protein, 298 aa, Glycine max
  Coding DNA Sequence Number=SeqID_50050
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSTASQNSAITPGCGFFIAKRRRFSFCQLALTAGSSLPLYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141736 - protein, 170 aa, Glycine max
  Coding DNA Sequence Number=SeqID_50051
  Pfam annotation: Domain name=Transposase_23; Domain location=69-126; Score=-15.5; E_value=0.058; Accession=PF03017.5; Description =TNP1ENSPM transposase
MSCSSSSLPPEEFATADPANQGPARGVDHRKSDSVAHGIIQPDAVPVSVPDAISGTCTASGAFGWSLSKSYPPGCPGRVYEGSTIVHNTPLLPGQVKVGVEEVKDPDAPVPIPIDEVSLVGQTIHTFLAWPTHLVKSLSQQHLTETSMRAGNSDIYGFLEPQPIQRSGQS

SEQ ID NO: 141737 - protein, 47 aa, Glycine max
  Coding DNA Sequence Number=SeqID_50052
EFFEEENSSRALEFQFLLFLHTVHAKSPALFSFEDQAQLSLRFCYYY

SEQ ID NO: 141738 - protein, 269 aa, Glycine max
  Coding DNA Sequence Number=SeqID_50053
  Gene Ontology: Mol. function=hydrolase activity, hydrolyzing O -glycosyl compounds; Cellular component=extracellular region; Biological process=carbohydrate metabolic process
  Homolog annotation: Hit_ID=A8AIM7; Match level="QueryCoverage=100%, HitCoverage=29%, E-value=1e-110, Identity=72%"; Hit description =Putative uncharacterized protein
  Pfam annotation: Domain name=CBM_5_12; Domain location=185-225; Score= 58.4; E_value=2.5e-14; Accession=PF02839.5; Description=Carbohydrate binding domain
  Pfam annotation: Domain name=CBM_5_12; Domain location=235-268; Score= 38.4; E_value=2.5e-08; Accession=PF02839.5; Description=Carbohydrate binding domain
  Pfam annotation: Domain name=PKD; Domain location=54-133; Score=28.5; E_value=2.5e-05; Accession=PF00801.11; Description=PKD domain
  Pfam module annotation: Pfam domain module=CBM_5_12::CBM_5_12::PKD; Domain location=185-225::235-268::54-133
  Subcellular localization annotation: CTP_CleavageSite=10; ConfidenceScore=5.09e-01
TKAKATFNVAAATSDQTMVFRLTVTDAKGLSNAIDVQVVNKAPKANQAPVVNPMEAVTLQAGETYVVHAQAADPDGDNLTYTWSVPADMHATGTDTANVTITAPEVASTSSYTLSVVVGDGKTSVQSNVQVTVNPKPADVTPPADDVTPPSDDVTPPADDVTPPSDEGTATGSCDAPVDANAGNYAAWDSSKIYNTGDTVSFDHLVWKAKYWTQGNQPGFGVDAWELASNVKMNWRSDLVYNGGETTTYQGNVYRAKWWTRGDNPANSD

SEQ ID NO: 141739 - protein, 252 aa, Glycine max
  Coding DNA Sequence Number=SeqID_50054
  Homolog annotation: Hit_ID=UPI00006A2D9E; Match level="QueryCoverage =76%, HitCoverage=95%, E-value=3e-12, Identity=20%"; Hit description =UPI00006A2D9E related cluster
RTTRPRLKGLHALAFRRLLVLAFRGLHVFPFRGLHVPTFIGLHALTFRGLHVLAIRGLHILTFKGLHILTFRGLHALTFRGQHILAFRGLHVLPFRGLHVLAFRGIHILTFRGLHVLPLRGLHALAFKGLHVLALRGLHAVTFRGLHVLAFRGLHRPRLQRTTSSSPSEGYTPSPSEDYTSNLSKGYIVLTFIGLHTLTFRGTTRLPLQRTTRCCHQRATLSPPLEGYTSSPSEDYTPSTLEATCPHLQRAT

SEQ ID NO: 141740 - protein, 74 aa, Glycine max
  Coding DNA Sequence Number=SeqID_50055
MKGNQQRMESPTVATYPSAGGRRETRGMRVPRKEYARSRHQRLFEENVGKTGKDAIYELLSERFRSCIYAQGRY

SEQ ID NO: 141741 - protein, 70 aa, Glycine max
  Coding DNA Sequence Number=SeqID_50056
MGIQKNSQAGEERPKEFRQLVLGEFFLAKGEGNEKMNSTSFQGLENHKTSESFWYKEEEEVQRDSRLAND

SEQ ID NO: 141742 - protein, 71 aa, Glycine max
  Coding DNA Sequence Number=SeqID_50057
MAKSRIVLGHGQKSRQINGRNQPRYIGTDASGDGVTTDQSLPLPGAKQAENVAARQPSILYGCSFFYYCLF

SEQ ID NO: 141743 - protein, 202 aa, Glycine max
  Coding DNA Sequence Number=SeqID_50058
  Gene Ontology: Mol. function=RNA-directed DNA polymerase activity; Biological process=regulation of transcription, DNA-dependent
  Homolog annotation: Hit_ID=A5BNN5; Match level="QueryCoverage=89%, HitCoverage=65%, E-value=2e-29, Identity=36%"; Hit description =Putative uncharacterized protein
MNGNIDAQTEYNIMNTLQHMTMVATAYQTSHECSEETIIDILVCRTLADFRWYRDTFLTRVYTREDSQQPFWKENFLAGLPRSLGDKVRDKIRNQSANGDISYENLSYGPLIFYVQKVALKICQDDKIQRQLAKEKAQTKRDLGSFCEQFGLPAYPKQKKKQTSRKEIQDHKPANKRRFSKRRYSQKPSTSKEIENPRQKTK

SEQ ID NO: 141744 - protein, 125 aa, Glycine max
  Coding DNA Sequence Number=SeqID_50059
MRTLTDSNLKQGCGPQDTKSEIVLSSPHLTRNLRSQKENADLVKEEHKTNTVPQVHQFRCLSWIQIPKMSNRNYNHSLGCTLSNNEEFLPMGESPCNINISASTPNKQHEHILGTSTTKLVEVQF

SEQ ID NO: 141745 - protein, 50 aa, Glycine max
  Coding DNA Sequence Number=SeqID_50060
MVHDIFVKVKLEVTRTSIVQNVFGSRRSSDVYDPNMVGSWYLTHATKNAV

SEQ ID NO: 141746 - protein, 97 aa, Glycine max
  Coding DNA Sequence Number=SeqID_50061
MTLDLHRHPKKSVVEPIDKSMLVDDPLHGLVKILYYVCLGVMRHRNGESKRERRRHFKEKMSLEEAHHHRRPWIRAWRKKEMNEGRGRDEHKILCSK

SEQ ID NO: 141747 - protein, 256 aa, Glycine max
  Coding DNA Sequence Number=SeqID_50062
  Gene Ontology: Cellular component=mitochondrion
  Homolog annotation: Hit_ID=P92567; Match level="QueryCoverage=30%, HitCoverage=41%, E-value=2e-18, Identity=63%"; Hit description =Uncharacterized mitochondrial protein AtMg01410
SDDSAAVRNGVSRLVDLIFRGQYIPKGALVIFDGLNKELCVGIHLVVIRIVHLGRKSGWLFCAFYFKQAASSLMMAYGGDEFVHPDNAVPVSLTRSGYPRIIPSHHRRMILKKDEKADMLGTQWSHGCLWPPRIRYAFDGPFYHPATIWAAITGKLGCTCEGAGKRRIFAIGNYVLRRIPMDDQTAPLIRLVPSKTCLSYDLKSATDWWPLVFLFERLALLFDRSFASSVVNTTLGTNVFEVPFVKRALSQVSFVT

SEQ ID NO: 141748 - protein, 95 aa, Glycine max
  Coding DNA Sequence Number=SeqID_50063
MAPPTFNTPQWARSEDLRPRRRPRGNSPPEDYPGQAWEKDTHLPPAHLKNPKLTYQPIARQLSRTHPHVKESVPFAEDKGKIEALEERLRAVEGL

SEQ ID NO: 141749 - protein, 205 aa, Glycine max
  Coding DNA Sequence Number=SeqID_50064
  Homolog annotation: Hit_ID=Q949K7; Match level="QueryCoverage=14%, HitCoverage=34%, E-value=6e-07, Identity=76%"; Hit description =Putative gag polyprotein
DTLGHDGSPHLGYNRAAYPYGLPPNYSPPILQEDAGHIASPVHEKEPPQQPDEVHKDPQDYARRDVEFYPPIPEGPAPGTLPQPNLAASPIVLSMEGPPPATEERRKLDLLEERLRAVEGFGDYPFADMTDLCLVPDVVIPPKFKVPDFDKYKGTTCPKNHSQNVLPFPYPYLEGSDYRLPKAVSVQFLIWAPDRTQLQNMFKKE

SEQ ID NO: 141750 - protein, 58 aa, Glycine max
  Coding DNA Sequence Number=SeqID_50065
  Subcellular localization annotation: CTP_CleavageSite=49; ConfidenceScore=5.15e-01
MGGANSTQATWALQNIPPEGSEALPKRFRNVFREEFRKGFNRSSTFFIRSSSFFDLQR

SEQ ID NO: 141751 - protein, 92 aa, Glycine max
  Coding DNA Sequence Number=SeqID_50066
QGVPFESTLVNDWKYVYSSHDTRKMVCIDHADMIGRLLARCTNLAQASEEDLLLLWALQTDHEPFVKVKRSFAIGAGAVTSFGYRKNMDGQW

SEQ ID NO: 141752 - protein, 141 aa, Glycine max
  Coding DNA Sequence Number=SeqID_50067
  Homolog annotation: Hit_ID=Q6UUU1; Match level="QueryCoverage=66%, HitCoverage=82%, E-value=3e-24, Identity=55%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTRRFPLAAPRALSCSAFVYGVIPLYGR

SEQ ID NO: 141753 - protein, 58 aa, Glycine max
  Coding DNA Sequence Number=SeqID_50068
MATTPPVLLKNGIPGLPGHPMIFEAGLLLEEATQVSWRKQPSSPGRAGRQPPPPFSYK

SEQ ID NO: 141754 - protein, 310 aa, Glycine max
  Coding DNA Sequence Number=SeqID_50069
  Gene Ontology: Mol. function=transporter activity; Cellular component= integral to membrane; Biological process=transport
  Homolog annotation: Hit_ID=A1FSX7; Match level="QueryCoverage=100%, HitCoverage=26%, E-value=1e-133, Identity=83%"; Hit description =Acriflavin resistance protein
  Pfam annotation: Domain name=SecD_SecF; Domain location=82-278; Score= -89.3; E_value=0.01; Accession=PF02355.7; Description=Protein export membrane protein
VRGDVATRYSFRDRKIDVLVRAQEGDRASVESIRRLIVNPGSTRPVTLDAVADVVATTGPSEIHRADQTRVAVVSANLRDIDLGAAMREVQQMVAEQPLGAGVGLHIGGQGEELAQAAKSLIFAFGLAIFLVYPLMASQFESLLHPFVILFTIPLALVGAILALMLTGKPISVVVFIGLILLVGLVTKNAIILIDKVNQLREAGVAKHEALVEGARSRLRPIIMTTLCTLFGFLPLAVAMGEGAEVRAPMAITVIGGLLVSTLLTLLVIPVVYDLMDRRGDAYYRERGRKHAGEIEPGAAGSAAGVEEPA

SEQ ID NO: 141755 - protein, 416 aa, Glycine max
  Coding DNA Sequence Number=SeqID_50070
  Homolog annotation: Hit_ID=Q6WAY6; Match level="QueryCoverage=57%, HitCoverage=38%, E-value=2e-18, Identity=32%"; Hit description =Putative uncharacterized protein
MTSRLRCFTFGDFQIVPTVEEFEEILGCPLGGRKLYLFSGFLPSLSKIATVVGDSARELDRMKQTRNGVVGLPRKYLEGRARDMASQEEWVPFADILALLIFGVVLFPNMDGLVDLAAIDAFLAYHHSKESPVVAILADLFDTFDRRCKKNSARIVCCLPALCVWVVSHLFQQDIRHPCPLQIPTEESLAPFLVRDFSAQSLKIVQRVHKAWECPLRKDNELRGIRNGIIGGYHEWLRVHTRGLDCLSKLKIINEENFEAPEEDEEVQALKSELGKARLAKEKFKLVATDIQKECAELQEENAATARALERETKKARKEEHGRDKFRGALWGSNNELKLRREEKDQSRVHGMVLKKELAACSRSKRSLAQHLEATEQSMLAIIGQYKEVLNQSLTHEQKLVEDFAQVYAEKEARGR

SEQ ID NO: 141756 - protein, 241 aa, Glycine max
  Coding DNA Sequence Number=SeqID_50071
  Gene Ontology: Mol. function=tryptophan synthase activity; Cellular component=chloroplast; Biological process=aromatic amino acid family biosynthetic process
  Homolog annotation: Hit_ID=A3J660; Match level="QueryCoverage=98%, HitCoverage=59%, E-value=3e-99, Identity=72%"; Hit description =Tryptophan synthase, beta subunit
  Pfam annotation: Domain name=PALP; Domain location=1-228; Score=94.4; E_value=3.5e-25; Accession=PF00291.16; Description=Pyridoxal -phosphate dependent enzyme
MKMLGAEVVPATSGSKTLKDAVNEALRDWINNPVTTHYVIGSVVGPHPFPDLVARFQSVISKEIREQLHEQTGRENPDYVIACVGGGSNAAGTFYHFVEEENVKIIAAEAGGFGVESGKSAATTFLGTLGVLHGSKSLVMQTRDGQVIEPHSISAGLDYPGIGPFHAHLFKEKRAEFFSINDDEALKSAFELTKLEGIIPALESSHALAVLDKKKFDENDIVVICLSGRGDKDMETYLANL

SEQ ID NO: 141757 - protein, 94 aa, Glycine max
  Coding DNA Sequence Number=SeqID_50072
  Gene Ontology: Mol. function=structural constituent of ribosome; Cellular component=intracellular; Biological process=translation
  Homolog annotation: Hit_ID=Q32703; Match level="QueryCoverage=40%, HitCoverage=90%, E-value=3e-11, Identity=84%"; Hit description =Putative uncharacterized protein
MVRYSGVLGVEEPHQSIPNLVVKLYCGDDTVGEISSGDDGVGPVAQRIRARGYEPRCRGFESLLAHNRPKKGRIFPSGGRKIMIGLADPKLWNL

SEQ ID NO: 141758 - protein, 88 aa, Glycine max
  Coding DNA Sequence Number=SeqID_50073
MEDWGNFLHRILEKDFEDSAPIKVFLLVRGFNGGSRRPPVVVGGGGGVWECWGGFWGKGGGRNGCFPLLVHNLKSATLAWASWCTAPI

SEQ ID NO: 141759 - protein, 212 aa, Glycine max
  Coding DNA Sequence Number=SeqID_50074
DRPPKQSRVRGHLVKIDANSLNAFLETPVVLAEGETLPAYSRYYRLPTDFREIEAALCIPGRGFILNSKGHPGKILRKDLTRLAQVWSVLSYSNLALTSQTSNLTMDRARLIFGLVSHLEMNIGAAKGVDSNSLTFERLSPIMNLAYIKKNFWNPEDLTVSIRGARRERARAADLPSTSAAPTPASTSTTPSVPAQTNCQCLEAMLQSIHQG

SEQ ID NO: 141760 - protein, 96 aa, Glycine max
  Coding DNA Sequence Number=SeqID_50075
MQQQQQQQQRQRATEAPSQPSLEELNPKNVSAITLRSGKQIEVPPQVATPAPEPVKLHSTPEKEDELAAQKRKLPNHEGANKIFHAGGPFSRSFDL

SEQ ID NO: 141761 - protein, 134 aa, Glycine max
  Coding DNA Sequence Number=SeqID_50076
MEAMKEKMATMMEAMMSMKKIMEANAVTIAATSTVAKVNLMPPSGLNQMNHPTSAMVGKIWEVPAAPMMCKFKTSTPSRHMACLSTIHHPMWRTLPTRMSIIPLLYPLRANNPKLIMHMSLKLWGRHMKFPTTI

SEQ ID NO: 141762 - protein, 114 aa, Glycine max
  Coding DNA Sequence Number=SeqID_50077
  Subcellular localization annotation: CTP_CleavageSite=30; ConfidenceScore=5.04e-01
MVLISRCSSGVSGFYQLFPPVQLLKRGGVTVNSATSIPAGHQRWQVAIGAEAGLALLRQLALKADVLHTGDYYVGYTDARVSSHEVRSWQEKKGCTGASVRICEYGLTMAANSV

SEQ ID NO: 141763 - protein, 169 aa, Glycine max
  Coding DNA Sequence Number=SeqID_50078
MTTLAQIWMTLLLSNILPSDHNADLPLRKDRSHKTPSGPGGAQQGPGVSSSGYGPLSFLQGARPPQQEIAPARHLVDPEKSNRVLGIPTLITSLCQFYRVPVTSSKGQGSASFVCPTLEQFGAEVACPGDWPDAQAREESAGSPDEADEFHMDEDMTDLLGFLGGSGAT

SEQ ID NO: 141764 - protein, 87 aa, Glycine max
  Coding DNA Sequence Number=SeqID_50079
MSDSGASHIETPEIEHQKIVRNSNFHNFSHGGPIQAHNISGGIKLNNESSREIQIVINFHTDVQFGRIIYLDARNLSPEALEKFKWS

SEQ ID NO: 141765 - protein, 89 aa, Glycine max
  Coding DNA Sequence Number=SeqID_50080
MSASYLLLKICVLIVPELDTSLSVERPSFDVLEALLVLGAPETVAIKLGGGTGPFSRGVPPRSLCGKLFQSQFLRGQTFGKLIYKEMLF

SEQ ID NO: 141766 - protein, 71 aa, Glycine max
  Coding DNA Sequence Number=SeqID_50081
MASRKRKSIGSRPTTQYDTRRFHSLDAWNRYTDNVLGRNILPERKLELYHIELDDIKTELERRNFHKCLTN

SEQ ID NO: 141767 - protein, 107 aa, Glycine max
  Coding DNA Sequence Number=SeqID_50082
QTQEHRSLEQTDQWLAPTSGFTRDSPQISASPYQLDLAPYASEPYNAQWNAPGLLRDKHALRSSRILGKMEVDEPWLGLWLPLNYQVDMGASDVRHWKCGRQTLWLI

SEQ ID NO: 141768 - protein, 321 aa, Glycine max
  Coding DNA Sequence Number=SeqID_50083
  Homolog annotation: Hit_ID=A2Q4S5; Match level="QueryCoverage=49%, HitCoverage=27%, E-value=1e-22, Identity=36%"; Hit description=IMP dehydrogenase/GMP reductase, putative
MAGHWTVAARAYLLHLLGCTLFANKSATNVHVVYLEALHDLSQTGRYSWGVAALCWIYEHFPSVTESTADQDYDEDSLRACRWIATKKTVKSIHTPAYRECLDRLRILDVCCIPYGEHRPVQDFHMISCYSGLLRWGPVVVYYRPEKVMRQFGYTQTIPTPPADSWVSYDDIHDRWIHYSDHMVLVGEVCDVPSQCANDYIDWFFRISHFFMAPGQASDPLLDGHAPQPRVVPQAPETDIPHVPEPGAPSTSARPVVEEPRHAVIKVCYGIAERLERHLSLGVVTPGSSTLELIEECLKMVRSVTQDQLVYVRSRCRWRTN

SEQ ID NO: 141769 - protein, 232 aa, Glycine max
  Coding DNA Sequence Number=SeqID_50084
  Gene Ontology: Mol. function=diaminohydroxyphosphoribosylaminopyrimidi ne deaminase activity; Biological process=riboflavin biosynthetic process
  Homolog annotation: Hit_ID=A6X1Y7; Match level="QueryCoverage=98%, HitCoverage=61%, E-value=1e-121, Identity=98%"; Hit description =Riboflavin biosynthesis protein RibD
  Pfam annotation: Domain name=RibD_C; Domain location=17-225; Score =127.3; E_value=4.5e-35; Accession=PF01872.8; Description=RibD C -terminal domain
AADDLAGYLNRSAKKRPEVILKLALSADGMIGRRGEGQLAITGSVARAQSHILRAQTDIILIGIETALADDPVLNCRLPGLEQRSPVRVVLDSGLRLPLSSKLVQTADAQPLWIACGEEALPERRYELQAAGCRILATEAYDCRIALPELMDDLAAQGISSVLVEGGAGVAKSFLGEGLVDRLAIFRSPVEIGSELGVAVDGLETHIADKFKILRQARYGDDAYAEYVSARM

SEQ ID NO: 141770 - protein, 142 aa, Glycine max
  Coding DNA Sequence Number=SeqID_50085
MRLLFHLPLVNVKKAKGEESSEEIYPQEEGQPLMVKEECKEVSVSSKRLAKKEIHFTIKTNIKETSLLRQPPHFLICKKTLVSIATPLGLEFIPQVKELLDEGLVRKSLNPCALLVPKIGIIRHQIPMIGGMMNVLSGATLF

SEQ ID NO: 141771 - protein, 105 aa, Glycine max
  Coding DNA Sequence Number=SeqID_50086
MASLVGTHEWLKVHIRGLGWLAKLKVVSEESFEAPEEDEEVQTLKSELGKAKLAKEKFKLAHTHAFGRNLAAIELRSAYPIARKVAVVAVLQDYLTHLTEGAEKE

SEQ ID NO: 141772 - protein, 76 aa, Glycine max
  Coding DNA Sequence Number=SeqID_50087
MQSQGFAPFSCPTPDQFRAEVAWPGDWPEAQAGEASPEAPGDGEEAHEDEEMADLLDFLGGSGDTVLRLGTSSKSI

SEQ ID NO: 141773 - protein, 55 aa, Glycine max
  Coding DNA Sequence Number=SeqID_50088
MVARVMLGYGYERRMGLGKNNYGRTRLEKYRGKEEQRPSFGIGMTSRRGPTLPHQ

SEQ ID NO: 141774 - protein, 137 aa, Glycine max
  Coding DNA Sequence Number=SeqID_50089
MERSMIDAASGGALGDMTPTEARNLIEKMASNSYQFSTRNDAIVIRGVHEVATNSAASFETKKLEGKLDALVNLVTQLALNQKSIPVARVCGLCSSADHHTDLCPSMQQPGTIEQLKAYAANIYNRPPQPQQQNQPL

SEQ ID NO: 141775 - protein, 224 aa, Glycine max
  Coding DNA Sequence Number=SeqID_50090
MAPRKLASKRYRKDKAAEGTSSAPKYDNHHFRSAEHQQRFEAIKGWSFLRERRVQLRDDEYTDFQEEIGRRRWASLVTPMAKFDPNIVLEFYANAWPTEEGVRDMRSWVRGQWIPFDADAIGQLLGYPLVLEEGQECEYGQRRNQSDGFDEEVIAQLLCIPGQDFARTAARRRVRIMRTNMTTLTQIWMTLLLSNILPSDHNSDLPLPKCQLVYDAYQAPSGPR

SEQ ID NO: 141776 - protein, 92 aa, Glycine max
  Coding DNA Sequence Number=SeqID_50091
MMVKGWSFVGASMVEEEEENSNSQRGKNLTFATLKPCLGLHAVSLVPVPRVSLRPSGPVFESNQYIYQNAQNKTPSMVQRLVLLNFKSHAKR

SEQ ID NO: 141777 - protein, 248 aa, Glycine max
  Coding DNA Sequence Number=SeqID_50092
  Homolog annotation: Hit_ID=A7UQU7; Match level="QueryCoverage=73%, HitCoverage=27%, E-value=2e-16, Identity=31%"; Hit description=IMP dehydrogenase/GMP reductase, putative
GFAWGAAALVHMYEHLNDASQASTRQMGDYITLLQCWIYEHFPTVHTCVVHDAYDEGSPRACRWLMGKAHMTRIKGAPYQRRMDALTVTDVCWMPYAKHRGVRGFDLISSYTGQLRWGQIVVYVPPERVAPDYMDWFFWILHPFVTPIEETAEPRHPPPSHDEEFVEPPIPEVSVASDLPTHSMVDCEGCQGMVEDLGVIAEDLERVINLRMVTEGTDLYDIMTRCLRRARGDAADGSLRPRQRRRID

SEQ ID NO: 141778 - protein, 275 aa, Glycine max
  Coding DNA Sequence Number=SeqID_50093
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSDSLLEETAFVSVIEAEIAEDTCFPLAVLRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141779 - protein, 64 aa, Glycine max
  Coding DNA Sequence Number=SeqID_50094
MTKARQKGIQKGKEGEACHLARPGELGCFLQKAPPSGELPGRPKWAWLLFAPPYLLNTTPAFFC

SEQ ID NO: 141780 - protein, 193 aa, Glycine max
  Coding DNA Sequence Number=SeqID_50095
DGVHQLALRHGEVGIMIGGQDVAEQQSHPYLSQGGHVGAHDPHPSSGSSPGKILPRPVPPLAILAFLTLFQYHRISQELADSVGIERDPLTPNPGSHVTHALLCWPSIGIKLKDYFWIKLGHGSNQWCPPPAPYFLLEISILVVPELDASLPEKRPSLDGFEALLVYNAPKAVTVVLRGGTSSFGRLVLPGPL

SEQ ID NO: 141781 - protein, 101 aa, Glycine max
  Coding DNA Sequence Number=SeqID_50096
MHRSPTGNLVPLDLEIEATLRRRNRAKRRRKLLQDRTVASILEEETYFSDSSSSDSPSSRESATYLPKAVSMADEHQQRVTLEDYSSSSVPQFFTSIARPE

SEQ ID NO: 141782 - protein, 166 aa, Glycine max
  Coding DNA Sequence Number=SeqID_50097
MVVYTIEFDEFLDEIARRHWDEELTDFIDGSIDVAIVKEFYANLYDPEDKTPKQVQVLAAKLCIPGRGFEIKADGYLVKILRKNMTTLAQTWSVLSFSNLIPTSHTSDITLDRARLIYGIIMKMDMNMGYLISHQISLIAQHDTSRHGFSALIIALCKARGVQSNS

SEQ ID NO: 141783 - protein, 171 aa, Glycine max
  Coding DNA Sequence Number=SeqID_50098
  Homolog annotation: Hit_ID=Q84VI1; Match level="QueryCoverage=100%, HitCoverage=25%, E-value=1e-49, Identity=64%"; Hit description =Envelope-like protein
MATSPKETSAPGSPAVPSSPHQEQPEFNIQPIQIIPGQASAPEKLAPRRQQGVKIAENPSLATSPREVDTEMDKKIRSIVSSILKDASVPDADEDVPTSSTPNGSVPDVDKDVPTSSAPNAEALPSPSEEESTEEEDQASEETPAPRAPEPAPGDLIDLEEVESDEEPIAN

SEQ ID NO: 141784 - protein, 61 aa, Glycine max
  Coding DNA Sequence Number=SeqID_50099
KLLPFKECNHLFASPTREKEKRLRRIASSGTPVILTVLHISIYEARCAYGSLLGRPWKRFP

SEQ ID NO: 141785 - protein, 56 aa, Glycine max
  Coding DNA Sequence Number=SeqID_50100
  Homolog annotation: Hit_ID=Q6WAY3; Match level="QueryCoverage=98%, HitCoverage=3%, E-value=3e-08, Identity=52%"; Hit description =Gag/pol polyprotein
MVPVKYIFEKPASDRADRPVAGDKGKLLVDYLAQQPLNDYQPMHPEFPDEDIMALV

SEQ ID NO: 141786 - protein, 269 aa, Glycine max
  Coding DNA Sequence Number=SeqID_50101
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
LELYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPEFDVLGTWLLDFGASDHMTSNQSLTQLSFPDSLPSITIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141787 - protein, 106 aa, Glycine max
  Coding DNA Sequence Number=SeqID_50102
  Subcellular localization annotation: CTP_CleavageSite=27; ConfidenceScore=5.43e-01
MSSTICRDRAHKTPSGPGGAQQGPGVSSSGYGPLSVLSGCSSPQQGITPAGHPLFPALITGLCQFYRVPVAPSKVIGPPTNRVFIMKYCAPKQAQGETPQQPGDGW

SEQ ID NO: 141788 - protein, 110 aa, Glycine max
  Coding DNA Sequence Number=SeqID_50103
MDISEDTDIPVILGRPFMLTTSCIVDMGKRKLELGFEDQKIDFDLFVEDKPAPEHNVFLQVMEGCQEVLKIIGNLLFNMYVGVYQLILECRYKGVYFLEKGLKNNLENIF

SEQ ID NO: 141789 - protein, 187 aa, Glycine max
  Coding DNA Sequence Number=SeqID_50104
MVMGDFISRLSFPENTETFSSLTSYPELRRSEFLIGGYVGARASLLSTTPSFVCTLTLSRGVIARGDHLTVIRTLLSFQSGGPDDTSRDQVWSFCTLVSSRGGGPDDTRRYLTVIRTLLSSRGGGPDDKQRPKAAGPMTSRDQVWSFCTLVSSRGGGPDDTRRYLTVIRTLLSSRGGGPDDTRKYPS

SEQ ID NO: 141790 - protein, 160 aa, Glycine max
  Coding DNA Sequence Number=SeqID_50105
MATADALERETKKAQKEEHVPALYGRNSMILKDELKVCLRSKRNLSQQLSEIEGNTWAIIDKCKEKLNLAATHEQRLEDEYAKISAKREARERVIDSLHQEATMWTDRFALTLNRSQELPRLLAKAKAVADTYSAPEEIHGLLSYCQHMIDLMDHMIGNR

SEQ ID NO: 141791 - protein, 72 aa, Glycine max
  Coding DNA Sequence Number=SeqID_50106
MAILIANTSTTFHRDERLGNTHAMHGKFKKTIWIFRLPTTKDETHIQRMCDGMMQMRKSATGGFTQHDNILK

SEQ ID NO: 141792 - protein, 90 aa, Glycine max
  Coding DNA Sequence Number=SeqID_50107
MGNQPRQNFNVGGYFGFQHGQPYNSEQGQWRNHPENQFNKDQGGPSNMPQQQGHNLYDRTMKLEETLAQFMQVSMSNHKSTESAIKNLEV

SEQ ID NO: 141793 - protein, 68 aa, Glycine max
  Coding DNA Sequence Number=SeqID_50108
  Subcellular localization annotation: CTP_CleavageSite=21; ConfidenceScore=5.01e-01
MTSILGSVATYTSAGGRRVTRGMRVPRKEYARSRHQRLFEENVGKTGKGAIYELLSERFGSCIYARGR

SEQ ID NO: 141794 - protein, 167 aa, Glycine max
  Coding DNA Sequence Number=SeqID_50109
MTTLTWIWMTLLFSNILPSDHNANLPLQMYQLGSRPQDAQWTRRSPTGPWGFQLWLQASVSPTGCPSPPVRSCHRDIGITPTRRPVDPKKSNRALGFPALVTGLCSHTRCPFPPARSCHHDIGIVPARHPVDPKKSNRVLELPSSNYGSLSVLQSACHLQQGHQAPY

SEQ ID NO: 141795 - protein, 163 aa, Glycine max
  Coding DNA Sequence Number=SeqID_50110
  Homolog annotation: Hit_ID=Q6UUU1; Match level="QueryCoverage=52%, HitCoverage=55%, E-value=8e-19, Identity=61%"; Hit description =Putative uncharacterized protein
GKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGKTIKIPGVSPWRLPRALSFRSKLDCMHEPPVQSDRCALSGNYRLESNPERHAKAPLAAAT

SEQ ID NO: 141796 - protein, 102 aa, Glycine max
  Coding DNA Sequence Number=SeqID_50111
MARSVFALCPYLRDLYGRELTRLLVITPKVVISLLMVSRGKTNKGVSHGKTLRKIKWPNSLKTVPSGVANCRNLPFGGRAMRDSRDACSTKGIRAESPPTFI

SEQ ID NO: 141797 - protein, 278 aa, Glycine max
  Coding DNA Sequence Number=SeqID_50112
  Gene Ontology: Mol. function=transmembrane receptor activity; Cellular component=membrane; Biological process=signal transduction
  Homolog annotation: Hit_ID=A4WAA7; Match level="QueryCoverage=100%, HitCoverage=49%, E-value=1e-123, Identity=83%"; Hit description =Methyl-accepting chemotaxis sensory transducer precursor
  Pfam annotation: Domain name=HAMP; Domain location=159-228; Score =59.7; E_value=1e-14; Accession=PF00672.16; Description=HAMP domain
  Pfam annotation: Domain name=TarH; Domain location=2-140; Score =105.8; E_value=1.4e-28; Accession=PF02203.6; Description=Tar ligand binding domain homologue
  Pfam module annotation: Pfam domain module=HAMP::TarH; Domain location=159-228::2-140
ADNDQQDVTSEIQVRMGLSNSSNHLRTARINLIHAGAASRIAEMDAMKQNISEAETRIKQSQESFTAYMNRAVRTAEGAALDADLKARYDAYIAGMQPMVKFAKNGMFEAIINHENETARPLDDAYNAVLLKAIKIRTDRANALTAQAHSRTQLGLMFMVGAFALALVLTAMTFVVLRRTVINPLQRAAKRIENIAKGDLTMPDDVAGRSEIGRLTRDLQTMQHSLENTVGTVRQGAEEIYRGTSEISAGNTDLSSRTEQQAAAIEQTAASMEQLTAT

SEQ ID NO: 141798 - protein, 91 aa, Glycine max
  Coding DNA Sequence Number=SeqID_50113
  Gene Ontology: Biological process=transposition, DNA-mediated
  Homolog annotation: Hit_ID=Q1J7G7; Match level="QueryCoverage=36%, HitCoverage=47%, E-value=1e-11, Identity=96%"; Hit description =Transposase
MVKSWNLLRADQRLIFAKSWPRASRYQQGHQDLFILRSDLPSQVLQWLLFLSAVPPVQLLTGWCVTAKAPPDISAGKCSGHAARNHHTRRA

SEQ ID NO: 141799 - protein, 71 aa, Glycine max
  Coding DNA Sequence Number=SeqID_50114
MEVEEPWLGLFRCEIPSFVGVLVRAKGGVHDWKCGRQALGMAFVDSWVVGKEKGCYWLSNDIVGLVGNLVV

SEQ ID NO: 141800 - protein, 60 aa, Glycine max
  Coding DNA Sequence Number=SeqID_50115
MVAITPAKVPQPPFLRGYDSNATCACHGGAPGHSIEHCRALKRKDFQVYAIIVNHSYNAK

SEQ ID NO: 141801 - protein, 95 aa, Glycine max
  Coding DNA Sequence Number=SeqID_50116
  Homolog annotation: Hit_ID=A5C0F5; Match level="QueryCoverage=60%, HitCoverage=8%, E-value=4e-08, Identity=40%"; Hit description =Putative uncharacterized protein
WLRRGNQHIGNDDLRVFRRKLDLMKQHEFVWEPYTATVMAALPPICVVGSVAWFAVVPLICFHVLSGTNPIEFYDNLDCNNLFPGFLRNRRISMA

SEQ ID NO: 141802 - protein, 129 aa, Glycine max
  Coding DNA Sequence Number=SeqID_50117
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q8GEG0; Match level="QueryCoverage=44%, HitCoverage=46%, E-value=9e-25, Identity=94%"; Hit description =Putative uncharacterized protein
MNENAIHGAPKRFRMENCTKHRIPAARGIHYESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141803 - protein, 103 aa, Glycine max
  Coding DNA Sequence Number=SeqID_50118
  Subcellular localization annotation: CTP_CleavageSite=35; ConfidenceScore=5.54e-01
MSPPPLGPHNHSQTHLKLLGRLPLQTRFSAGGFVRACTLSATLDRLVLISGFWLNTCFSRLADGLKRCASLDDPSLSANAQLILLPDSSSRLVEECCAQRMAR

SEQ ID NO: 141804 - protein, 130 aa, Glycine max
  Coding DNA Sequence Number=SeqID_50119
MLAKFDIAEAPKVKMKDVVTKYGLDHEAWKQFEATRLTPNWEGIRKRAQSIQKHNDCPHVLSRGGYDLLEKKLLDEKRKRLQEEALLSENPASVDDPPSPIKRHVKWKVARTRAFGNMTSESAQEIADKI

SEQ ID NO: 141805 - protein, 209 aa, Glycine max
  Coding DNA Sequence Number=SeqID_50120
MDNEEGVQEQMKADLSALKDQMASISEVMLKLQKTIEDKATATASSTVREVEPVLQPALNPGRDRNTAVFGRRYSPQAYPYGLPSDFTPRATPEDLSQASTFEGQLPPYDDYPEQDDEEGDTHLGPLLHLKDPSPHELPQPNIVRHIPASPTPVKESVPFAEDKGKIEALEERLRAVEGLGNYPFSDLADYVSCPISSFLPSSKYQTLI

SEQ ID NO: 141806 - protein, 215 aa, Glycine max
  Coding DNA Sequence Number=SeqID_50121
  Homolog annotation: Hit_ID=Q5CDC4; Match level="QueryCoverage=19%, HitCoverage=32%, E-value=2e-15, Identity=100%"; Hit description =LacOPZ-alpha peptide from pUC9
  Subcellular localization annotation: CTP_CleavageSite=84; ConfidenceScore=5.12e-01
MVKVGTSYVPINVSFSPKVGPGLPGINRDTRIYLFCEHRRTSALASVAVTLRVTTTPAALNAPLQGASHSPFRLRNCWEGRSVRASSLLRQLAKGGCAARRLSWGELELHRGGGRSRTSGSPGLQEFDQVGGRFAGRAVIHAHIAAPRRAWQVRHQGHHQAYRYRRPRGGARYQLLFPLVRVNFELGVIMVIAVSCVKLLSAHNSTQHTSRKHKV

SEQ ID NO: 141807 - protein, 256 aa, Glycine max
  Coding DNA Sequence Number=SeqID_50122
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNASVFPVTTLNSMGDQCRDMSQCPHRQIQDKSPSPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 141808 - protein, 169 aa, Glycine max
  Coding DNA Sequence Number=SeqID_50123
MVSGNRLPGLKTRLRNGTGRLWRPLRDRPLVIDYQIVMAAQLIHDRVEMECLEGAWETLEGNTRCRFRGTIRFTATSLVHPDEPARMLQRTVEWILPTPTPYRLVEPVQVIEVTSSEEDPEEDLEELPPKPAVDALDFLEGDEDPLPEVDSPEDIMSASEADSTEDSGP

SEQ ID NO: 141809 - protein, 77 aa, Glycine max
  Coding DNA Sequence Number=SeqID_50124
  Subcellular localization annotation: CTP_CleavageSite=62; ConfidenceScore=5.20e-01
MLCRDDSRGTPSPGPRESHLTDLSSLAHEAPGFVFVARTRRPGARGAVSSPPSRRKMNKQVRGFTYGNLVTTSPSSK

SEQ ID NO: 141810 - protein, 90 aa, Glycine max
  Coding DNA Sequence Number=SeqID_50125
LAPYASEPYNAQWNAPGLLRDKHTLRSSRILGEMEVDEPWIGLSRCKIHFLVGVLDFVVDLGMAFVDNWAVGKEKTHFDPFVGEDHIIKA

SEQ ID NO: 141811 - protein, 31 aa, Glycine max
  Coding DNA Sequence Number=SeqID_50126
DDVGRSVLIIFKIFASSASGDIDWPNDVPLE

SEQ ID NO: 141812 - protein, 334 aa, Glycine max
  Coding DNA Sequence Number=SeqID_50127
  Gene Ontology: Mol. function=transketolase activity; Cellular component=cytoplasm; Biological process=metabolic process
  Homolog annotation: Hit_ID=A7MKZ1; Match level="QueryCoverage=99%, HitCoverage=49%, E-value=1e-151, Identity=81%"; Hit description =Putative uncharacterized protein
  Pfam annotation: Domain name=Transket_pyr; Domain location=21-193; Score=246.0; E_value=8.1e-71; Accession=PF02779.15; Description =Transketolase, pyrimidine binding dom
  Pfam annotation: Domain name=Transketolase_C; Domain location=208 -323; Score=52.9; E_value=1.1e-12; Accession=PF02780.11; Description =Transketolase, C-terminal domain
  Pfam module annotation: Pfam domain module=Transket_pyr::Transketolase _C; Domain location=21-193::208-323
MPADWENKTSQFIRDLQANPQKIASRKASQNTLEAFGKLLPEFLGGSADLAPSNLTIWSGSKPIKEDHAGNYIHYGVREFGMTAIANGIAHHGGFVPYTATFLMFVEYARNAARMAALMKARQIMVYTHDSIGLGEDGPTHQPVEQLASLRVTPNFSTWRPCDQVETAVAWKAAIERHHGPTALILSRQNLLQPERSAQQVENIARGGYILKDCDGTPDVILIATGSEVEITLGAEAKLSADGHKVRVVSLPSTDVFDKQDVAYRESVLPSNVRARVAVEAGIADYWYKYVGIDGKIVGMTTFGESAPAGKLFPAFGFTVENVVSHAESLLKPA

SEQ ID NO: 141813 - protein, 134 aa, Glycine max
  Coding DNA Sequence Number=SeqID_50128
MLSFSQMQSLFQSRMQSQELALPPEPEVGPSAARVGTNKSCVDSLGNDPDMGDLDKCGLYIEENPPRLVALRRVYEGSTTVHNIPLLHDQVKVGVEEVKDADASIPVPIEDVKELWDQQNLQIGRIMRSMIPYI

SEQ ID NO: 141814 - protein, 102 aa, Glycine max
  Coding DNA Sequence Number=SeqID_50129
MGDRGNRSQELNICMGLPSNSYVGVSGGMINGLVICEAFSCFLSSDRLFLSVNSLLEGYRKSDLDNAGSGEQVIGGGVAQEVNLIFNKARTSSSIPGHPYIG

SEQ ID NO: 141815 - protein, 347 aa, Glycine max
  Coding DNA Sequence Number=SeqID_50130
  Homolog annotation: Hit_ID=Q84VH5; Match level="QueryCoverage=100%, HitCoverage=52%, E-value=1e-132, Identity=71%"; Hit description =Envelope-like protein
MDKKIRSIVSNILKNASVPDADEDVPTSSTPNASVPDVEKDVPTSSAPNAEALPSPSEEESTEEDDQAAEETPAPRAPEPAPGDLIDLEEVESDEEPIANKLAPGIAERLQSRKGKTPIKRSGRIKTMAQKKSTPITPTSSRRSKVAIPSKKRKEISSSDSDDDVELDVSTSKRAKKSGKKVPENVPDAPLDNISFHSIGNAERWKFVYQRRLALERELGRAALDCKETVTKLGDCYESLVREFIVNIPSDITNRKSDEYQRVFVRGKCVKFSPAVINKYLGRPTDGVVDITVSEHQIAKEITAKQIQHWPKKGKLSAGKLSVKYAILHMIGAANWVPTNHTSTVAT

SEQ ID NO: 141816 - protein, 35 aa, Glycine max
  Coding DNA Sequence Number=SeqID_50131
MVFGASVASVKFLKTLAIWGKKHVFVKKNRVEVLP

SEQ ID NO: 141817 - protein, 250 aa, Glycine max
  Coding DNA Sequence Number=SeqID_50132
MAQSNSSRLGFPALITALCKTRGVASDTLVFECLHPVINLAYIRKNCWNPDDPTIIIRGAKRPRARPVEAPSTSTTPHLASTSEAPPPARIAAAPSTPPLGQIILLQSLQLVAPPDSIPTVEKFNEWVAWPGTQPPPHRDDANPAAQVPHQPSNESSESSTPKPLIRKRRVVVTQEAVATPEKSPEATPEPPTPMADTTSPQQAANPSTPEVQTTPVLSLNTSPVATPVLHLIDDEEVQTQDTQDQSQDF

SEQ ID NO: 141818 - protein, 101 aa, Glycine max
  Coding DNA Sequence Number=SeqID_50133
MGETHEIPHHNLADFEPCLGYATEGQAVGEMGKLDHIEERLKVVEESGGYAFANLEELFLVPNVVTPPKFKVSDFDKYKETTCPKNRLKDVLSEDGGIRKR

SEQ ID NO: 141819 - protein, 37 aa, Glycine max
  Coding DNA Sequence Number=SeqID_50134
MKMLLIPYDMNGSKMEKEEREETPLQGEDESRRCSPP

SEQ ID NO: 141820 - protein, 34 aa, Glycine max
  Coding DNA Sequence Number=SeqID_50135
MWNRHRLKGEFKLDVFTPKAYTPKSPSRPLPPDS

SEQ ID NO: 141821 - protein, 70 aa, Glycine max
  Coding DNA Sequence Number=SeqID_50136
MIAKKYFVVGQKVLLYNSRLGLMSVEIKSESTNKSFKVNGHRLKPFLTNPSLADVVVEETSLLHPTSLPP

SEQ ID NO: 141822 - protein, 97 aa, Glycine max
  Coding DNA Sequence Number=SeqID_50137
MAEEHDQRITLEDYSSSSAPQCFTSIARPEVQANNFNYPHSLIHLIQGNLFQGLPMKTPMHTWKHSLKYATLLRLPVYQMKPLGSAFSHSRWQEKPR

SEQ ID NO: 141823 - protein, 31 aa, Glycine max
  Coding DNA Sequence Number=SeqID_50138
MAPYSDVFRLSSAGKDDDLSVVTLSSICIRP

SEQ ID NO: 141824 - protein, 146 aa, Glycine max
  Coding DNA Sequence Number=SeqID_50139
  Subcellular localization annotation: CTP_CleavageSite=57; ConfidenceScore=5.25e-01
MLVRMVRTLLFAAARVKSCPSMHSSCVIASLSGCARTVGHPPISGGRATLCWQGRVVLFKVRACSPLLARMCSPLKVRACIPLLARTCSPLQGEGVQPYEGRAALCWRGRVVLFKVRACSPLLARTCSPLKVRTCSPLTMRVTSTQ

SEQ ID NO: 141825 - protein, 90 aa, Glycine max
  Coding DNA Sequence Number=SeqID_50140
  Subcellular localization annotation: CTP_CleavageSite=35; ConfidenceScore=5.06e-01
MWGYRMVTRTFVNPGANEPIDAQRLTSSSTPLPFRDSESGGRRRYLMVIRTFHQPRGTNSTVLLSSSGNIQARRCARFFFAGRGQSSAMA

SEQ ID NO: 141826 - protein, 92 aa, Glycine max
  Coding DNA Sequence Number=SeqID_50141
MSSDSQSLPEDADISGKGADDHIGLCLSIEHGSMNAEVQITVRCLRMLLESWAMIAKGRVVDKSEAFAPKYPQFVMRNSDLCSSCESGVRLK

SEQ ID NO: 141827 - protein, 26 aa, Glycine max
  Coding DNA Sequence Number=SeqID_50142
MVFVIFPIDSFAKHNKEGVETRVIID

SEQ ID NO: 141828 - protein, 156 aa, Glycine max
  Coding DNA Sequence Number=SeqID_50143
  Subcellular localization annotation: CTP_CleavageSite=22; ConfidenceScore=5.19e-01
MVKVGTSYVPINVSFSPKVGPRASRYQQGHQDLFICLRSNDLRFRHSLFGANRASRAVLLFVNCYPRHNSTQAYQPDISAGKCKAGERAIEAAFAYWALAECHTGLMLALMRDGSTAVGGRSRTSGLLRRAAGIRVGGLERGGDFLEDARKILNRE

SEQ ID NO: 141829 - protein, 50 aa, Glycine max
  Coding DNA Sequence Number=SeqID_50144
MVTSILQLDSMNLFVKARAWFNPITQGMKWVYDPNMVGSWYLTHATKNAS

SEQ ID NO: 141830 - protein, 205 aa, Glycine max
  Coding DNA Sequence Number=SeqID_50145
  Homolog annotation: Hit_ID=Q88MK2; Match level="QueryCoverage=27%, HitCoverage=35%, E-value=9e-08, Identity=53%"; Hit description =Putative uncharacterized protein
MALLTPEECIVHCRAEPDDAPLLASLLASAESAVAGHLNRAVFASAAELDAALDGLPDAAGAAQDAYEGAIARAASLDSPAARDMAIEVARQRLAEAVQSFNRTLHGMVATPRIEAAVRLTLGSLYANREQVVVGATAVELPQGVAGAFNRLVTVFGPPGAQDSWGHPDGARQNLGTLWANVGRLSGKALIRAGGLQAEVTTSIR

SEQ ID NO: 141831 - protein, 118 aa, Glycine max
  Coding DNA Sequence Number=SeqID_50146
  Subcellular localization annotation: CTP_CleavageSite=93; ConfidenceScore=5.43e-01
MVHDIFLNVKLGVTRISTILNVFGSSRSNDVTRSIFCPNLCKMVTSMLQLDSMNLFVNARAWFNPITQRMTILIANTSTTFHRDERLENTHARMENKWVYDPNMVGSWYLTHATKNAS

SEQ ID NO: 141832 - protein, 160 aa, Glycine max
  Coding DNA Sequence Number=SeqID_50147
  Gene Ontology: Mol. function=hydrolase activity, acting on acid anhydrides, catalyzing transmembrane movement of substances; Cellular component=mitochondrion; Biological process=ATP synthesis coupled proton transport
  Homolog annotation: Hit_ID=Q6E2W4; Match level="QueryCoverage=40%, HitCoverage=15%, E-value=4e-28, Identity=100%"; Hit description=ATP synthase subunit alpha
  Pfam annotation: Domain name=ATP-synt_ab_C; Domain location=29-101; Score=21.7; E_value=0.00036; Accession=PF00306.18; Description=ATP synthase alphabeta chain, C terminal domain
LFYRGIRPAINVGLSVSRVGSAAQLKAMKQVCGSLKLELAQYREVAAFAQFGSDLDAATQALLNRVKYSFSSFFDIDTLLAFFTPAFCMDDVGASSQSSLPTVNPTPDPAAPAEPQAPDPDLSLPLLDDNARRAELNERGGFLHFGDLSDQQKDKVLNAQ

SEQ ID NO: 141833 - protein, 27 aa, Glycine max
  Coding DNA Sequence Number=SeqID_50148
MKWSMKHSLQLDNQLCNQYFKPTYKLI

SEQ ID NO: 141834 - protein, 198 aa, Glycine max
  Coding DNA Sequence Number=SeqID_50149
  Homolog annotation: Hit_ID=Q0KIL1; Match level="QueryCoverage=41%, HitCoverage=9%, E-value=9e-08, Identity=35%"; Hit description =Gag/pol polyprotein, 3'-partial, putative
  Pfam annotation: Domain name=G-patch; Domain location=38-82; Score =30.4; E_value=6.5e-06; Accession=PF01585.14; Description=G-patch domain
MPYVEAAEESLEIAFQSFEVVSIASVDSFFGQPCMFDTAMMVARVMLGNGYEPGLGLGRNNSGRTSLISTKGNRGKFGLGYKPTQVNIRKSVAGWKSGSQGSQLGQKVEGGPPCHISRSFISAGLGHCRNLPFCGRARRGSRVRLPKEDKCAESPPTFICGKHQKNRRKLVMKNIPDSGVVFTFEEGISTSHVCPKGQ

SEQ ID NO: 141835 - protein, 170 aa, Glycine max
  Coding DNA Sequence Number=SeqID_50150
  Homolog annotation: Hit_ID=Q6UUU1; Match level="QueryCoverage=35%, HitCoverage=40%, E-value=1e-18, Identity=78%"; Hit description =Putative uncharacterized protein
VPPVQLLTGWCVTAKAPPDISAGKCSGHAARRVPFAIQAAQLLGRAIGAGLFAITPAGERGMCCKAIKLVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 141836 - protein, 123 aa, Glycine max
  Coding DNA Sequence Number=SeqID_50151
MAPTRHSLDPDKSNRALRFPALITGLCQSFGVPVTPSKAANHRGQVQIHECLYRFSLSQQGQGSAPFACPTPEQFGAEVAWPGDWPEAQAGEESAGSLGEADESHMDEEMIDLLGFLGGSGAT

SEQ ID NO: 141837 - protein, 119 aa, Glycine max
  Coding DNA Sequence Number=SeqID_50152
MPYRSITIPALTEALRLGTPWRYSANLTPCTHPPFASWRNSEEARPIALPNSCDSLECSEWQTAFRLESGALSAERDVGGYASRHGTPALHLPALCSGVYAFAELTDNTIPVILNRRNS

SEQ ID NO: 141838 - protein, 69 aa, Glycine max
  Coding DNA Sequence Number=SeqID_50153
  Homolog annotation: Hit_ID=Q83SY1; Match level="QueryCoverage=49%, HitCoverage=87%, E-value=1e-11, Identity=94%"; Hit description =Putative uncharacterized protein
MVHPGGFEPPTARFVAEYSIQLSYGCIGKASLLQNKSESGMKVHPGGLLGCASPFGPLLTQRYPPWCLR

SEQ ID NO: 141839 - protein, 136 aa, Glycine max
  Coding DNA Sequence Number=SeqID_50154
  Homolog annotation: Hit_ID=Q84VI1; Match level="QueryCoverage=70%, HitCoverage=14%, E-value=5e-34, Identity=80%"; Hit description =Envelope-like protein
MLSQHPNMLNYTDSVMKRESPLSLHYKLVEGTHVPDIVSTSVSTSGKAAASGAVSKDALIAELKDTCKVLEATIKATTEKKMELELLIKRLSESGIDDEEAAEEEGEAAEEEEEAAEEEEDAAEETESDDDSEATP

SEQ ID NO: 141840 - protein, 67 aa, Glycine max
  Coding DNA Sequence Number=SeqID_50155
  Subcellular localization annotation: CTP_CleavageSite=49; ConfidenceScore=5.10e-01
MVDAATINYFALFHDIAPPTKRNTKPRVNFLVSTHPAKSESGYPITSSCKAYVWSSTDLGIHNTPNN

SEQ ID NO: 141841 - protein, 63 aa, Glycine max
  Coding DNA Sequence Number=SeqID_50156
MHLLFDNSLLRNFIVKHARLEAIMGWWPFGNFFGKHHELIIEVSKRATYKGFKLVKDSDQQGY

SEQ ID NO: 141842 - protein, 95 aa, Glycine max
  Coding DNA Sequence Number=SeqID_50157
MGRKKLEIGFEDQKIDFDLFVENKPTPEQNVCLQSPFAKRKPHAKRIFGHALSRKSQALSAQPLHLRLIWSTELAAAELSQFQFDLNSTMRRSDL

SEQ ID NO: 141843 - protein, 79 aa, Glycine max
  Coding DNA Sequence Number=SeqID_50158
MPMQPARLGELQPPQNGFFPLNSHVGGFKGLEGLEVERIERKEGEREKEEETKLRHYRITTVITPYIVLLFHVPHATVN

SEQ ID NO: 141844 - protein, 144 aa, Glycine max
  Coding DNA Sequence Number=SeqID_50159
MALGVMAARPGVLLLQSDVTLLAQTSWEVKIRTRISFERSCYSIVSQPTLWREGNARAHECVFQGRKARGVATNVYLRKTSEKSERCDLQTLIVKGSGVVFTHGEGCFPHSYVSSIAMKKSDLRSSFITRCLLSCFDLFPQDQF

SEQ ID NO: 141845 - protein, 255 aa, Glycine max
  Coding DNA Sequence Number=SeqID_50160
  Homolog annotation: Hit_ID=A5C169; Match level="QueryCoverage=60%, HitCoverage=13%, E-value=1e-08, Identity=28%"; Hit description =Putative uncharacterized protein
MVIDQSLFYDLTQLSSEGVPFEGALNDDWKFDFSVHDARWLVCTNQADMTGRLLAGSLAFESRILHYLIVHILLPRSSNLAQVSEEDLIVMWAFHTGRQIDWAHLVRYRMHKALRLNAPLPYPHLVTLFLQHFNIPLDSEPYVPIKRSFLIGAAVIASFGYRKEHDGSWVKKGAQPIDDEGNLPVGEDSSLLQKILDRFDGLQTYVGERVVIIKKGEIVEASFMMMNQVDSSSFDDDKKPKRMISRLSQQVQDQY

SEQ ID NO: 141846 - protein, 183 aa, Glycine max
  Coding DNA Sequence Number=SeqID_50161
  Homolog annotation: Hit_ID=A5BSR3; Match level="QueryCoverage=66%, HitCoverage=33%, E-value=9e-11, Identity=33%"; Hit description =Putative uncharacterized protein
NKDSVDDTVCEKYGISKEDVWKKAQAIQKQNTVPHVLSRRGYEYLKQKLMAKKTKKKLEEVAQSRSTEAMIDPPSPIRRHVKWKMVCTKKTGQMTSKAAKEIVEKIDSLEEQAPQGSFVPHGRQDVLTVAIGRPEHPGRVRAAGAGVTIKQHYGSAPRTARTSSSMTPKELEQLTQQIRDQLE

SEQ ID NO: 141847 - protein, 304 aa, Glycine max
  Coding DNA Sequence Number=SeqID_50162
YIYLGLTENKRGYISCGSVLVEGTSTRFKENKGGYIPCGSLLVKGFLQGHSIQHLEELVRILKVHEQEFAQDEGTKKGKLLALTTQRPKRSTTSKESLSKSLVVSDTLEEESDDDSDEEDYELSLITRKEKKKKFFKSKKKSLMSTWEDLNDYFSNKDSEEEANLCLIDDASTSKAKPALDASSDDEDSQSDDIVNSNCEEDLKEAHQVHLVDFVLETTSPDSAQDASICEKVKALLDEKVSNGHKTLLKDFQDLEEKVKSLAITLEDSEEGPKEMFKQKLLLKKECILANDELHKLKKKDSDL

SEQ ID NO: 141848 - protein, 185 aa, Glycine max
  Coding DNA Sequence Number=SeqID_50163
MAVCTLYYGVSHLVGNSLVAQADHRRVGGSYGARLGGLDKYCMAIPLVLDTVCIAFHLRVKVSIGSFYNEITLAILYHVVDTCDDREPCSWEQDDISRVQESGDIVATRRVVTMPIGWTSQNSEADIQEEEPIDLKSNPLQGGGDDAILPRKGPVARAMSKRLQEDWARAAKEDPRVLMNLGVDF

SEQ ID NO: 141849 - protein, 142 aa, Glycine max
  Coding DNA Sequence Number=SeqID_50164
MKFVDYPSNYLGSGVLDILNRDRILRYHEIPAAAARGGRSRAAASPPAAAPTAAPAPRPAHPRKKPDRTRLENSRAGWGRFGAGEGRERGAGRRVWAKSGWEVAVVAGGGSSEAGAGERKRNGIRNGVADVEEFEYSIGTGI

SEQ ID NO: 141850 - protein, 79 aa, Glycine max
  Coding DNA Sequence Number=SeqID_50165
MSVKNLVERLGLHDKIDHTLHGHAHATQHDHAQGARPCSHGQGQIINVPKHRHAAHQAQASLMNMMISTGVLSSSQLQK

SEQ ID NO: 141851 - protein, 155 aa, Glycine max
  Coding DNA Sequence Number=SeqID_50166
MWRSKSKVSKRCFIAEIFELKEDEEEEKLSLEFEKMLKILSFDNKDFSLHQYPKFVNINQCTLRVRLIASEPNLRSCLMDEGLTGASDIAMTLEVNAESCLHTKLHSRVLKNQYIATELFTEIAKPSNLESQRHQRMQQQATSTINVNENEDNLT

SEQ ID NO: 141852 - protein, 72 aa, Glycine max
  Coding DNA Sequence Number=SeqID_50167
MRPRRYQIVTVINFYIVLRLSFGAWGANTFPMHKQLPNPHFQNSQTFVGGDSTCFLHEKMHLCISPCPPTER

SEQ ID NO: 141853 - protein, 151 aa, Glycine max
  Coding DNA Sequence Number=SeqID_50168
MEIRLRTKIQFWRLAKKEEEMDVAREARRKFGDESSGDGESNHEGPKSQVPKKKRRLGSMYHGATVDEHLLERDGERSVIIVDHHCRGVANETEVDVDGAVLLPQLAHLHTLKSSITHTRWKMKVKEKKERRGIKIRHFIATKVEDAETLP

SEQ ID NO: 141854 - protein, 163 aa, Glycine max
  Coding DNA Sequence Number=SeqID_50169
MATSMKLRQFVLLLIVFTLLVVSSEARLVPEFSTLISKKINRKLGLRELINNVRNGDEWHQKRSMLGGSDLIVDNEGSDCTVIIKGSTLLIEYDVNVGDLLVMGYVDYFDYVDGLDDRRFTIYKIMELMASGQILIMKIHTFDNAYDVLIELVTTGNLKNCLD

SEQ ID NO: 141855 - protein, 145 aa, Glycine max
  Coding DNA Sequence Number=SeqID_50170
  Gene Ontology: Cellular component=nucleus; Biological process =regulation of transcription, DNA-dependent
  Homolog annotation: Hit_ID=A7QDZ6; Match level="QueryCoverage=82%, HitCoverage=43%, E-value=1e-38, Identity=64%"; Hit description =Chromosome chr4 scaffold_83, whole genome shotgun sequence
MNTKRINLQAYGDMDRMQTQMYQHLKLYPEDEYGPQSMKKPVVVESYNEIVFPEPSEVFLARVQNHPAVNVPRLPAGLNLSCSVPSDVVNDMERGDTKDHPLTQWFLNFSEDDEILKLAAARQQLWGLPSKSKYNQFTDPFLMCN

SEQ ID NO: 141856 - protein, 109 aa, Glycine max
  Coding DNA Sequence Number=SeqID_50171
MAEFDYRMEFYQWITGRDHSFTNFYSPYICPFGCWRSSTCLRIKGWHEVYIEDPVFVKSNINKLHRHQQFSPALGRSAAITGTYSVGTDGGLLTHGGNGDACWSGLMSL

SEQ ID NO: 141857 - protein, 272 aa, Glycine max
  Coding DNA Sequence Number=SeqID_50172
MLKENCTYMMHNFKVVKNDGQCRVYVHQYKLVFTGVTIVRQTDLGDAPLRMHNFIQFNDIISGDFQHGLSVGIEAHSVMTPRNQTSSQLLGSSQLSAKDAFFYKVEAKSLSKINNMLEGPLPELSWKIIHGVMQLASIVTRKLMYRLEVMVNHKEECTKFLLWDRECTELISQSADEVNRLKIALKFSQKFRNSVVLKYSSDSYLIKTIADLLPNAEASCKTHIPLPDSNDSPCYEIQSLFATADHDPLLRAPITPTKRQTPQGCDDEPLSS

SEQ ID NO: 141858 - protein, 117 aa, Glycine max
  Coding DNA Sequence Number=SeqID_50173
  Subcellular localization annotation: CTP_CleavageSite=34; ConfidenceScore=5.22e-01
MDLVSHNLDFWKSTYRTIKKRYNVSQRALRGRARARLTGALSKGGKMRGVATNVYLWETSEKPKETGQNENSKVRELYLRLRKVDKSGAFAPTYPPLERKSDLRSSFLCVNQVILFT

SEQ ID NO: 141859 - protein, 226 aa, Glycine max
  Coding DNA Sequence Number=SeqID_50174
MKGTFYPKLVKVFYTYEHADLEGNLFCTINGVEMVIDVVVWKEVAGLHMVGVHKFDETTDGYNKMRTYRRMLLDPTRNLRNCLGVGGLTAKDRMLGYLFTNILTPRYQDELILLIEHIMLKSSHLVDYEFPYVVLPSRFIDYFNVDVSNEIMDFTKASSNITERHLKKLGMRFVVHEWIMVGEPTAGNIEQMEENDKVEAPQEPGYQWSPFESLMIQKMDTMFHLH

SEQ ID NO: 141860 - protein, 77 aa, Glycine max
  Coding DNA Sequence Number=SeqID_50175
MPRVGSRDYVNDKDRFCIYKIMVFKDRFNPKVNKNHIPYGIFFTHILTLVGVEVSLMEPSFGAPQLKGTTFVKMGVA

SEQ ID NO: 141861 - protein, 76 aa, Glycine max
  Coding DNA Sequence Number=SeqID_50176
MAAEWRRKRERRCNFKEKMSLEEAHYHRRSWIRAWRKKEMNKGRGREEHEILFSKRALKSEPTNPRSIPRFSTKCD

SEQ ID NO: 141862 - protein, 143 aa, Glycine max
  Coding DNA Sequence Number=SeqID_50177
  Subcellular localization annotation: CTP_CleavageSite=30; ConfidenceScore=5.12e-01
MAGRWVRKQDLPPPIPNERTPSPPPQRDTSSSLLTKVLTEFCDLQAFVVVFSGRFWLFDVAKGGENLRVEFIINLGRNSNLKGDEHLLSTRKNLEEDELYRFAKRTASVHPLSEKGMLSQKSLTCAKRSICALSTQAQTRPPI

SEQ ID NO: 141863 - protein, 110 aa, Glycine max
  Coding DNA Sequence Number=SeqID_50178
MGTLVINLQFKFKDDPTINEFGIAVLPEQHPGPLGPSRRFLQKAVASGGSNPARLGELGGNHLPYFAINRGGNEEGRDPNPLGTSLSFEFAWKNRFREENLSRGASETFP

SEQ ID NO: 141864 - protein, 438 aa, Glycine max
  Coding DNA Sequence Number=SeqID_50179
  Gene Ontology: Biological process=intracellular signaling cascade
  Homolog annotation: Hit_ID=A7P1X7; Match level="QueryCoverage=93%, HitCoverage=97%, E-value=0.0, Identity=74%"; Hit description =Chromosome chr19 scaffold_4, whole genome shotgun sequence
  Pfam annotation: Domain name=DUF231; Domain location=262-430; Score =267.7; E_value=2.5e-77; Accession=PF03005.6; Description=Arabidopsis proteins of unknown function
MLATKVKTLAIFSSFNHPMSIQSLIDHRRIQSLFPIVLYSILVLGAARLVLDSLKISHNNSYVFRLYGMPNGGRNSRLLPVVVLPEDRIEEDCNVFEGTWMWDNVSYPLYEEESCPYLVKQTTCHKNGRPDSFYKNWRWQPSGCNLPRFDALKLLHMLRDKRMMFIGDSLQRGQFESMICLIQSVIPEGKKSLERIPPMKIFKIEEFNVSIEYYWAPFIVESISDHATNHTVHKRMVRLDSIANHGKHWKGVDILVFESYVWWMHKPLINATYESPHHVKEYNVTTAYKLALETWANWLESNIKPLTQKVFFMSMSPTHLWSWEWKPGSNENCFNESYPIQGPYWGTGSNLEIMQIIHDALRLLKIDVTLLNITQLSEYRKDAHTSVYGERKGKLLTKKQRANPKDFADCIHWCLPGVPDAWNEILYAYLLKGYQNFS

SEQ ID NO: 141865 - protein, 118 aa, Glycine max
  Coding DNA Sequence Number=SeqID_50180
  Homolog annotation: Hit_ID=A7Q0I0; Match level="QueryCoverage=82%, HitCoverage=22%, E-value=1e-07, Identity=31%"; Hit description =Chromosome chr7 scaffold_42, whole genome shotgun sequence
MESSNVKNKSSGKIKMSSEDTRSYFTWNLEIERVLADVLRDQRNLGNKGDGNWKPKAYSTATQILSKHFGVHFMADNVKNRFKLWRTWYGIVSDILSQSVFDWDSTNHMKRPNDFDSK

SEQ ID NO: 141866 - protein, 55 aa, Glycine max
  Coding DNA Sequence Number=SeqID_50181
MVFVSPSTSEWQYFQPGSALFFLVALAVAASDDGRGGFECKLLEGRLAVLNASCG

SEQ ID NO: 141867 - protein, 80 aa, Glycine max
  Coding DNA Sequence Number=SeqID_50182
MVFPLTKLYAINSGCGTHYRASAERPLAAMSTLVVEKSKGGGCDYNRDGAITPQQVIKGMEGDSGRLLQMDMSDVPSPQE

SEQ ID NO: 141868 - protein, 73 aa, Glycine max
  Coding DNA Sequence Number=SeqID_50183
  Gene Ontology: Mol. function=electron carrier activity; Cellular component=integral to thylakoid membrane; Biological process =electron transport
  Homolog annotation: Hit_ID=P49161; Match level="QueryCoverage=76%, HitCoverage=17%, E-value=4e-22, Identity=89%"; Hit description =Apocytochrome f precursor
MSLGQFSLTLKMLQGFMGYENPQEAIGRIVCANFHLANKPVDIEVPQVVLPNTIFEAVVRIPYDMQVKQVLAN

SEQ ID NO: 141869 - protein, 66 aa, Glycine max
  Coding DNA Sequence Number=SeqID_50184
MDKSLKVGEDEWRERERRSMKFCASNEVGQWRVQVPSTKVLGCLFKIQSDLDARPRPRRRENDIHH

SEQ ID NO: 141870 - protein, 89 aa, Glycine max
  Coding DNA Sequence Number=SeqID_50185
MERSMIDAASYVALVNEQPEAYVANIYNRPPQQQNQQQQNNYDLSSNRYNPGWRNHPNLRWTSPPQQQQPIPPFQNATGPSKPYVPPPI

SEQ ID NO: 141871 - protein, 77 aa, Glycine max
  Coding DNA Sequence Number=SeqID_50186
MAGDISPQRFKWLMQSYPARALGRRLQVDWARDPREGPRVLMSLKEVSLAIRELLKEVFSKKLLKEVFSRKLLKEAT

SEQ ID NO: 141872 - protein, 108 aa, Glycine max
  Coding DNA Sequence Number=SeqID_50187
MLQYLKGLKGISGIRLGRVLKFTVSYGVPRPCKVEHRCSLFDGGATSSSNDPLHGIGGPMTRSKTKRMNQALQGLILKIKEKEDQCELRVAPNWVTLLQIDEDALRPT

SEQ ID NO: 141873 - protein, 52 aa, Glycine max
  Coding DNA Sequence Number=SeqID_50188
MKEIRGEDDEEQGIKLYVLDLLHQWSPLLLEDQWQWNGEGGKVIGDSTSRRR

SEQ ID NO: 141874 - protein, 58 aa, Glycine max
  Coding DNA Sequence Number=SeqID_50189
MRVRVRVGVRAALKKEKKVKKSSSDWMVVKFNKNEGADLRTKNRRGWGTGGSQWLRDG

SEQ ID NO: 141875 - protein, 174 aa, Glycine max
  Coding DNA Sequence Number=SeqID_50190
  Gene Ontology: Mol. function=motor activity; Cellular component=cell projection
  Homolog annotation: Hit_ID=UPI00016621D1; Match level="QueryCoverage =85%, HitCoverage=40%, E-value=1e-12, Identity=32%"; Hit description =UPI00016621D1 related cluster
MSSTSESCMSSPLEDFTSSPLKGMHILAFRGQHVLAFRGLHVLAFGGLQVLAFRGLHVLDFRGLHILAFRGIHTLAFRGLHALNFRGLHILDIRGLHVLAFKGLHALGFNGLHVLAFRGLHVLAFRGLYILTFRGLHVLTFRGLHVLTLRGLQVLALRGLHVLAFRGLHICAFR

SEQ ID NO: 141876 - protein, 67 aa, Glycine max
  Coding DNA Sequence Number=SeqID_50191
MEVDLPLGWKLLSLEHYDGTTNLDEHIDVFFMQANIYTMTVITYPSAGGRRPNRWAKALVSKGENKQ

SEQ ID NO: 141877 - protein, 118 aa, Glycine max
  Coding DNA Sequence Number=SeqID_50192
MYKDKWTQPWPMGSKIYPEVHENPRAFFSSSSPILLEPLAHGSSDCLELLEWIVVHHGGRQSGHKWSFTVAPRWAPNVLAKIWSQFDIRVGHRRCDSDDLCGGECRSKLHCFMMMNQD

SEQ ID NO: 141878 - protein, 264 aa, Glycine max
  Coding DNA Sequence Number=SeqID_50193
MASMMEAMLSMKQLIEKNAATAAAVSSAAEADPTLLATAHHPPSNIVGRGRDTLGHDGSPHLGYNRAAYPYGLPPNYSPPVLQEDAGHIASPVFEREPPQQPEEGHKDPQDYARRDVEFYPTIPEGLAPGTLPQLNIAAPPIVLSTEGPPPATEERRKEGDAHAVSSTPAWVKTQQTPHGTHQYAQHHPSFSAHTGNASSSTPVQPKAPTQREAPQVPTPNTTRPAGNSNTTSNFPPRPFPEFTPLPMTYEDLLPSLIANHLAV

SEQ ID NO: 141879 - protein, 70 aa, Glycine max
  Coding DNA Sequence Number=SeqID_50194
  Homolog annotation: Hit_ID=Q6WAY3; Match level="QueryCoverage=48%, HitCoverage=1%, E-value=6e-07, Identity=70%"; Hit description =Gag/pol polyprotein
MARLGFDCTNNIAKYEACTLGIQAAIDSKVKLLKAYMVLLQCVDAREAEQMLVEVHEGSFGTHANGHAMA

SEQ ID NO: 141880 - protein, 122 aa, Glycine max
  Coding DNA Sequence Number=SeqID_50195
MVAAKLEAATGPRHGQSVQATPTACALLPLILNSGPTTHYNQPYLRAGAGVEASTGNGCGQLGLSRVCSVYELVKVGLEQEGMVVYMLALFESHGSWESQLVVRIGAAGSSTLAFSSWDASS

SEQ ID NO: 141881 - protein, 39 aa, Glycine max
  Coding DNA Sequence Number=SeqID_50196
MQAEEEEEAAEEEEEAAEAEEDAAEDTDTESDDDSEATP

SEQ ID NO: 141882 - protein, 172 aa, Glycine max
  Coding DNA Sequence Number=SeqID_50197
MTQKLVARGDVLRLSAPLHSMTPSVIDEQRPMWPSAPFSEMSASSGGDFFKSHKLSRTTHSRVRWHAETNCGHSAPFCHPEAAGPMTCGDKLWSFRTPFAIQTQSCPMARRDKLWSFCTLLSSRGGGSDDMRRQIMVIPHPFFHSDTVVSDGTQRQIMVILRPFVIQRRQAR

SEQ ID NO: 141883 - protein, 173 aa, Glycine max
  Coding DNA Sequence Number=SeqID_50198
  Gene Ontology: Biological process=transposition, DNA-mediated
  Homolog annotation: Hit_ID=Q1J7G7; Match level="QueryCoverage=23%, HitCoverage=71%, E-value=3e-12, Identity=74%"; Hit description =Transposase
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLGYIYLGCYTENKKGYISCGSVQVEGTSTWLFKENKGAYIPCGSLLVKDFT

SEQ ID NO: 141884 - protein, 92 aa, Glycine max
  Coding DNA Sequence Number=SeqID_50199
  Pfam annotation: Domain name=zf-CCHC; Domain location=46-63; Score =22.5; E_value=0.00059; Accession=PF00098.14; Description=Zinc knuckle
MCVREEERLIMQEGERVNLTVHGKKKGDQPKNKGKIPAQPVIKKESKCFLCKKKGHMKKNCLKIKSWTDKKGYGKPKEASGEVSNTSIQEAR

SEQ ID NO: 141885 - protein, 236 aa, Glycine max
  Coding DNA Sequence Number=SeqID_50200
  Homolog annotation: Hit_ID=Q6WAY6; Match level="QueryCoverage=42%, HitCoverage=17%, E-value=3e-08, Identity=34%"; Hit description =Putative uncharacterized protein
FLPSLSKIAVVVRDLARGLDRVKQTRNSIVGLPRKYLEDKARDMANQEEWVPFMDVLALLIFGVVLFPNVDGLVDLAAIDAFVAYHHSKDSPVAAILADLFDTFDRRRVDWDQHLAGIGGRTINWFPRWKEGKGGELLFSCGDYPKHPVDRNEGKDKELRGIRNGLIGGYHEWLKVLTRGLDWLSKLKIINEENFKAPKEDEETFGKSVPGYEKKMQLPQEPLNKKPRGLARKSMA

SEQ ID NO: 141886 - protein, 139 aa, Glycine max
  Coding DNA Sequence Number=SeqID_50201
MELQRLNQNEETDKRKQSIALKASSSMQEENEDEESEDEEDFSLFVKKLTNLSRIKESRGVKISVATCPFAGERRRGSRVRFPKEERCAESPPTFICGKRRKNRRKPVEMKILSSGVVFTFEDGISTSYVCLKGQQPTF

SEQ ID NO: 141887 - protein, 87 aa, Glycine max
  Coding DNA Sequence Number=SeqID_50202
  Homolog annotation: Hit_ID=A5AYU6; Match level="QueryCoverage=56%, HitCoverage=8%, E-value=8e-08, Identity=51%"; Hit description =Putative uncharacterized protein
MEKSEKKNIYEKKLKKAYITWDENDMESSEDSENEEINLCLMAKSYESDEEEPLRKKWYIDSGCSKHMTGDESKFTHISPKKSGHVT

SEQ ID NO: 141888 - protein, 34 aa, Glycine max; identical to SEQ ID NO: 97560
  Coding DNA Sequence Number=SeqID_50203

SEQ ID NO: 141889 - protein, 90 aa, Glycine max
  Coding DNA Sequence Number=SeqID_50204
MASFEETLDMDRDKWIVWFDGASNVLGHGVGAALVSLDNQYSILEGEANFETLEKEVPFEKKKIELKILPNHLKYVFLEEDKPVVISVIP

SEQ ID NO: 141890 - protein, 16 aa, Glycine max
  Coding DNA Sequence Number=SeqID_50205
NLQDSGTLKRVAWGLD

SEQ ID NO: 141891 - protein, 153 aa, Glycine max
  Coding DNA Sequence Number=SeqID_50206
  Homolog annotation: Hit_ID=A6FJQ2; Match level="QueryCoverage=24%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPGGFGVGADINNPIIALAPILGYQGKSESNPKPSQCDFSPSKSKRVRFNPHEARAPKVIARCLGSEI

SEQ ID NO: 141892 - protein, 134 aa, Glycine max
  Coding DNA Sequence Number=SeqID_50207
MERSMIYASSGGALGDMTPVEARNLIEKMASNSQQFSSRSDAIVIRGVHEVATNSSSSSENKKLEGKLDALVNLVTQLAMNKKSAPVARLCGLCSSTDHHTDLCPSVQQSEAIEQLEAYAANIYNRTIMTSLAT

SEQ ID NO: 141893 - protein, 85 aa, Glycine max
  Coding DNA Sequence Number=SeqID_50208
MIDIWYPVERELGHFKSFVRNKAQPEGSIAEGEFREFIKRSSRGRRPSSTEIEKKVNKEFADWFRKRIMNPDTMNEMSTNLKFLA

SEQ ID NO: 141894 - protein, 102 aa, Glycine max
  Coding DNA Sequence Number=SeqID_50209
MRIPFFIGQGSKRSKVVFQWGLLSCEPNLDIWGETNLGVKVSISGRASILFHKAPKWALKHPVYGIVILRLGIYTDRPNVSKLCSFISSMNSSILISVHSGK

SEQ ID NO: 141895 - protein, 70 aa, Glycine max
  Coding DNA Sequence Number=SeqID_50210
MKLHCKNCDDESDEQNDGDSDEVYFVEAFGKRRHREAPFGGGDSDCGAKVHRQASGDGDIGKHGPKVTRR

SEQ ID NO: 141896 - protein, 340 aa, Glycine max
  Coding DNA Sequence Number=SeqID_50211
  Gene Ontology: Mol. function=glutamate synthase (NADH) activity; Cellular component=chloroplast; Biological process=nitrogen compound metabolic process
  Homolog annotation: Hit_ID=UPI0000E87EF5; Match level="QueryCoverage =96%, HitCoverage=21%, E-value=1e-143, Identity=75%"; Hit description= Glutamine amidotransferase, class-II:Glutamate synthase, alpha subunit, ...
  Homolog annotation: Hit description=C-terminal:Ferredoxin-dependent glutamate
  Pfam annotation: Domain name=GATase_2; Domain location=1-119; Score =112.6; E_value=1.2e-30; Accession=PF00310.12; Description=Glutamine amidotransferases class-II
  Pfam annotation: Domain name=Glu_syn_central; Domain location=194 -340; Score=31.1; E_value=3.9e-19; Accession=PF04898.5; Description =Glutamate synthase central domain
  Pfam module annotation: Pfam domain module=GATase_2::Glu_syn_central; Domain location=1-119::194-340
MKSAVLGEDLEKLWPLIAEGQSDSACFDNCLELLVAGGYSLPHAMMMLIPEAWAGNPLMDEDRRAFYEYHAALMEPWDGPAAVAFTDGKMIGATLDRNGLRPARYLVTEDDIVMMASEMGVITFPQEKIVKKWRLQPGKMLLIDMEQGRIIDDEEVKTELAQAKPYRQWIEQTRFHLTELPSVGSGEVSLNADLLDTQQAFGYSQEDLKFVLQPMLDNGEEGSGSMGNDAALPVLSNKAKTLYNYFKQLFAQVTNPPIDPIREELVMSLVTFIGPKPNLLAIDETNPPLRLESSQPVLSLDGLEKLKQIESLTKGQFKSIVLDLTYEAALGKAGMKQALD

SEQ ID NO: 141897 - protein, 45 aa, Glycine max
  Coding DNA Sequence Number=SeqID_50212
RTPEWIPTPPTTPELQFSDEEGGQITTPPGTPVLHLDDEEQDRDE

SEQ ID NO: 141898 - protein, 94 aa, Glycine max
  Coding DNA Sequence Number=SeqID_50213
  Pfam annotation: Domain name=zf-CCHC; Domain location=33-50; Score =28.3; E_value=2.8e-05; Accession=PF00098.14; Description=Zinc knuckle
MAFTLIQGRTKPKEFWGLHLQNPRKIRRSHCLIKCFKCLGRGHIASQCPTKKTMIKRSQDIYSSQEETTSSPSSEEVYPHEEGDLLMVRRLLGG

SEQ ID NO: 141899 - protein, 69 aa, Glycine max
  Coding DNA Sequence Number=SeqID_50214
MAEALAHAPSDVEQLRHAVEACQAKAERLEQLLNLRIVTKGTETYNVMQDCLRIASVVTVDLNVYARSR

SEQ ID NO: 141900 - protein, 182 aa, Glycine max
  Coding DNA Sequence Number=SeqID_50215
MKRSMIDAASGGALGDMTLAEARSVIEKMASNSQQFSARNNVIVFIGVHEVATNSSSSVETKKVEGKLDALVNLVTQLAMNKKSAPVARLCGLCSSADHHTDLCPYVQQSETIEQPEAYAANIYNRPPQPQQQNQPQQNNYDLSSNRPCVPPPIQQQQQQHPQKQPTVEVPLQPSLEELVRQ

SEQ ID NO: 141901 - protein, 149 aa, Glycine max
  Coding DNA Sequence Number=SeqID_50216
  Homolog annotation: Hit_ID=Q6WAY6; Match level="QueryCoverage=83%, HitCoverage=21%, E-value=1e-11, Identity=31%"; Hit description =Putative uncharacterized protein
MRHVCPLEGHRSCTEKKEANWDRLLASKEGVSVNWFPRWKEGRTGILILCGKFPNVPLMGTRGCINYNPILTIRQLGYPMRGALLEEGPTPFITRVFNSTNTGVLQRVHKAWEMLQRKDKELRGSSNGLIGGYHRWLKAYAQDLDWLPS

SEQ ID NO: 141902 - protein, 90 aa, Glycine max
  Coding DNA Sequence Number=SeqID_50217
MIDQGRLEVDDEGREEQHIRMQSADERSFGRPKPLVVYFTKDAAPQKPRYPSVVKPVPFPYRNSHAVPWRYAPPSERKEEATDVSSLSAK

SEQ ID NO: 141903 - protein, 49 aa, Glycine max
  Coding DNA Sequence Number=SeqID_50218
MELSSRLENGGHMNAANAIHPCGSGKGSKLENGGHMNDNAIHSRGFGTG

SEQ ID NO: 141904 - protein, 79 aa, Glycine max
  Coding DNA Sequence Number=SeqID_50219
  Gene Ontology: Mol. function=transcription regulator activity; Biological process=pyridine nucleotide biosynthetic process
  Homolog annotation: Hit_ID=P24518; Match level="QueryCoverage=100%, HitCoverage=19%, E-value=8e-34, Identity=84%"; Hit description =Transcriptional regulator nadR
ALIDEYRFDLVILLENNTPWVADGMRSLGSSVDRREFQTMLVDMLRENNVEFVHVEESDYDSRFLRCVELVREMMGEQG

SEQ ID NO: 141905 - protein, 98 aa, Glycine max
  Coding DNA Sequence Number=SeqID_50220
MIGKGGAVDKSEAFAPTYPQFVMRNSDLPSFCERGADNRKVSSHATGLSGRWIAKGVCGLPSGLSACHRTLGSRQQKSLPKDADISGKGANDLIGLYL

SEQ ID NO: 141906 - protein, 90 aa, Glycine max
  Coding DNA Sequence Number=SeqID_50221
  Pfam annotation: Domain name=Retrotrans_gag; Domain location=1-89; Score=5.6; E_value=0.015; Accession=PF03732.8; Description =Retrotransposon gag protein
MVALDGKALSWFQWWETCNSDIGWGDFKVAILERFQTSATLNPFAALLALKQEEMVEEYVEQFESKAIDQPVEEKCLPMEFRGANCLRTT

SEQ ID NO: 141907 - protein, 201 aa, Glycine max
  Coding DNA Sequence Number=SeqID_50222
  Homolog annotation: Hit_ID=A8P6U5; Match level="QueryCoverage=12%, HitCoverage=40%, E-value=4e-07, Identity=96%"; Hit description =Putative uncharacterized protein
  Subcellular localization annotation: CTP_CleavageSite=67; ConfidenceScore=5.55e-01
MSGPALRPYSPRNPKTLISHKVPASPKSTSADPWSASFMVETRTLFVFHKSKNFTSDYEIRMPPTVPVNHYSDPEGQHNRIRILWCYPMLMYTERRLALSTLISSKSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 141908 - protein, 92 aa, Glycine max
  Coding DNA Sequence Number=SeqID_50223
  Homolog annotation: Hit_ID=Q6UUU1; Match level="QueryCoverage=93%, HitCoverage=58%, E-value=3e-32, Identity=80%"; Hit description =Putative uncharacterized protein
MAYERGGDFLEDARKILNREVRGPRQSRFSIGSAPLTSITKSDAQISGGETRQDYKDTRRFPLAAPSCALLFLPFGLPVSFRCMAAFVSFHA

SEQ ID NO: 141909 - protein, 193 aa, Glycine max
  Coding DNA Sequence Number=SeqID_50224
  Homolog annotation: Hit_ID=UPI0000ECBAF8; Match level="QueryCoverage =18%, HitCoverage=42%, E-value=3e-12, Identity=100%"; Hit description= UPI0000ECBAF8 related cluster
ATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQLIYDHDYEFELGTALTAKMEDVHWLHVSGHASLALAVVYNVVTGKTLALPNLIALQHIPLSPAGVIAKRPAPIALPNSCAA

SEQ ID NO: 141910 - protein, 27 aa, Glycine max
  Coding DNA Sequence Number=SeqID_50225
MVLLVKRETVVIVVDMRVVETMVVVEE

SEQ ID NO: 141911 - protein, 56 aa, Glycine max
  Coding DNA Sequence Number=SeqID_50226
MRSHNIHIESSILFPCNKTHDNTFLNAMGSPKFLQSIAKNEWVSIFMKLYKVLVPS

SEQ ID NO: 141912 - protein, 144 aa, Glycine max
  Coding DNA Sequence Number=SeqID_50227
  Gene Ontology: Mol. function=phosphoprotein phosphatase activity
  Homolog annotation: Hit_ID=A5AWR0; Match level="QueryCoverage=57%, HitCoverage=8%, E-value=6e-15, Identity=48%"; Hit description =Putative uncharacterized protein
STCGWLPLIGPTNLNWADLCEELLGVRPQEGEIKGSVVKLSWLAHHFAQINNHDDKEQVRRFTRAWILRFIGGVLFVDKSSNKVSLRWLRRGNQHIGNDDVRVFCCKLDIMKRHEFVWEPYTTTVISLLSPICVVRSDARCAVV

SEQ ID NO: 141913 - protein, 183 aa, Glycine max
  Coding DNA Sequence Number=SeqID_50228
MVKEECKEVSVSSKRLATKERHFEIKTNIKEISPLKQPPHFLLCKKTLVRIATPLRLEFIPQVKELLDEGLVRKSLNPCALLVPKIGIIRHQIPKIGGMMNTLGGATLICKITRAPNIFVICVHRDSLGVPMNPKRIKVIPEWARSTKCVEGKSPEFQEHRDLRSNPFQGGGNDAILPRKGIG

SEQ ID NO: 141914 - protein, 292 aa, Glycine max
  Coding DNA Sequence Number=SeqID_50229
HPSRVHAIGTGVTIKQYFGLTPRTSYTSSSMGLEDLEQLTQQIRDQLEELITEKSQMQSQGLALPPKPKVDPSATCVSTKESCVDPLGNDPDTSDSEKCGLYIEENPPRLDALGRVYEGSIIVHNIPLLHDQVKVGVEEVRDADAPILIPTEESARAPTKSQFPSPSSSEMTMAATIAGFVPSRNVRDNANANNNNTVQTHQKSFKHNNSNTSSNGGHHPPQMSGPQGLIAPAGETLLGTGMAMVHISAKTITTIITMGADVLVFMYRSDDCMHLQNYLLRWYMFHLRHWNQ

SEQ ID NO: 141915 - protein, 304 aa, Glycine max
  Coding DNA Sequence Number=SeqID_50230
MRGAPTEESLSPFLVRNQGAQSLEAIQRVHKAWRSPLRKDKELRGIRNGVIGGYHGWLRIHAQGLDWLSKLKVIDEENFEAPEEDEEVRALTLELGKARLAKEKFKSAATHIRKECTELQEENAATAKALEQETKRARKEEYGREKFRGALWGSNNELKLRREERDRSRVHGMILKEELVACTRSKRSLAQHLEATEQSMLAIIGQYKEELNQSMAHEQKLVEDFAQVYAEKEARGRVIDALHQEATMWMDRFALTLNGSQDLPRLLAKAKAMAEVCTAPEEIHGLINYCQHMIDLMAHIIRNR

SEQ ID NO: 141916 - protein, 202 aa, Glycine max
  Coding DNA Sequence Number=SeqID_50231
MAAQLIHDRVEMECLEGVWETLEGNARCRFRGTIRFTATSLVHPEEPARTLQRTVEWILPTPTPYRLVEPVQVIEVMSSEEDPEEDPEKLPPELAVDALDFPEGDEDPLPEVDSPVDVMSASEADSTEENDPGGIVTSGGHALDPLPHGHAPQPRVVPQAPQTDIPHVLEPGASSTSTEEPRHAVVRAPSKSMGGHAWLIDT

SEQ ID NO: 141917 - protein, 38 aa, Glycine max
  Coding DNA Sequence Number=SeqID_50232
RITAHLPWWNWRMVLPENAEELPLVDLEKSKPTRKKME

SEQ ID NO: 141918 - protein, 85 aa, Glycine max
  Coding DNA Sequence Number=SeqID_50233
MTTFKVPNKTLTILREKLLKIITHKWKFGNLLEAPNTLLMKGIFVTKFESNEVLLSPIALKVADPLLLDSNSSRDDIDPPFQFSI

SEQ ID NO: 141919 - protein, 146 aa, Glycine max
  Coding DNA Sequence Number=SeqID_50234
  Pfam annotation: Domain name=G-patch; Domain location=1-42; Score =27.8; E_value=4e-05; Accession=PF01585.14; Description=G-patch domain
MVARVMLGNGYEPGMGLGKDNGGITSLISAKGNHGKFGLGYKPTQAYIRKSIAERKSGSQGSRLRHEDEGSPPCHISRSFISAGLGDEAQVIAICEDDALSGSNLLVMQSYPARALDRRLQVDWARDPREGPRVLMSLRVDFEPMG

SEQ ID NO: 141920 - protein, 331 aa, Glycine max
  Coding DNA Sequence Number=SeqID_50235
CRTSNYLNWDGTNHVDCLSDPALTTGLVFESQTLSSQSERPTGHYERKSSPWVKTRELQVHQGQQSTQAGSGQGQHVTEVLSLILPALYLGCAIWWDCLAQTPPSIPELQQLAEATQIGEPASSSAEVRQLVDHLSEQAREVASEASMERTPRALAMWMAGLTLAFAISIGACSKGRGCGMEPESTIHVLKGCPWASGIWLLCPLALHTQQMQALNFSDWVKEMGKCLDEEQLELMLVVAWALWSDRNLLLFQDIQNYPVDVVNKAISFFEEYKKEKLKIVQTPIGWQAPPHGVYKINTDAAIFNQQGIGCLLHPALPSLTSRAIDLDELA

SEQ ID NO: 141921 - protein, 147 aa, Glycine max
  Coding DNA Sequence Number=SeqID_50236
ATNFKNSVAPPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 141922 - protein, 180 aa, Glycine max
  Coding DNA Sequence Number=SeqID_50237
  Gene Ontology: Mol. function=4 iron, 4 sulfur cluster binding; Cellular component=integral to membrane; Biological process=protein -chromophore linkage
  Homolog annotation: Hit_ID=P56766; Match level="QueryCoverage=100%, HitCoverage=33%, E-value=1e-75, Identity=59%"; Hit description =Photosystem I P700 chlorophyll a apoprotein A1
GMYFHGARFSNYEAWLSDPTHIRPSAQIWRASGITSELQLYCTAIGALVFAALMLFAGWFHYHKAAPKLAWFQDVESMLNHHLTGLLGLGSLSWAGHQIHGATPFFTLNWSKYAEFLTFRGGLDPVTGGLWLTDIIHHHLAIAILFLIAGHMHTTNWGIGHSIKDILEAHKGPFTGQGHK

SEQ ID NO: 141923 - protein, 119 aa, Glycine max
  Coding DNA Sequence Number=SeqID_50238
  Homolog annotation: Hit_ID=Q6WAY3; Match level="QueryCoverage=72%, HitCoverage=3%, E-value=4e-07, Identity=37%"; Hit description =Gag/pol polyprotein
MNFAVRKPVEFTPIPVSYADLLPYLLDNSMVAITPTKVHQPPFLREYDSNATCACHGEAPGHSIEHCRGLKRKVQGFSTFTGIGCKPLVYLLKRPVVLSLDFQDRSIRDYSSFTLVGLP

SEQ ID NO: 141924 - protein, 103 aa, Glycine max
  Coding DNA Sequence Number=SeqID_50239
MADEQHQRITLEDYSSSSISQFFTSIARPEVQAHNINYLHSLIHLIQGNLFQGLPNEDPLATCPSQASEGEAHGCAFQRRKDARSRHQHLFVENVEKTGDPLE

SEQ ID NO: 141925 - protein, 103 aa, Glycine max
  Coding DNA Sequence Number=SeqID_50240
MTKGSESKPNFGISRVLGECRNDQTWSLLVIGPAASGQNLTIRKVTKLGLCLSSGPRLCDDKRGVRITVRYLRVSSGPPPLDDTRVQNDQTWSLLVIGPVASG

SEQ ID NO: 141926 - protein, 76 aa, Glycine max
  Coding DNA Sequence Number=SeqID_50241
MFVWRLPVWEIPEWMAQLVFWVDDPAWVGDPEEVDDFFMVGSGRASLAPLPVLLPPRREIPECLRRHYHFSVRIHG

SEQ ID NO: 141927 - protein, 28 aa, Glycine max
  Coding DNA Sequence Number=SeqID_50242
MAILIANTSTTFHRDERLGNTGKRKDRA

SEQ ID NO: 141928 - protein, 165 aa, Glycine max
  Coding DNA Sequence Number=SeqID_50243
MYLNRRAPGSQPIKEQSPQSKEACVAAGQLCNFGGIWNLASGNQLPFVGNRLQGLKMETGRSMASGNRLPMVCNRLHRVTGHWLCNSFWGTGNRLHTLIVIAAQLIHDRVVMECLEGVWETLKGNERCRFRDTIRLTATSLVHSEEPARTHQQPVEWILPTPTPY

SEQ ID NO: 141929 - protein, 16 aa, Glycine max
  Coding DNA Sequence Number=SeqID_50244
MAVRLLPAASHPQAAV

SEQ ID NO: 141930 - protein, 54 aa, Glycine max
  Coding DNA Sequence Number=SeqID_50245
MNVLSGATLFCKITRTPNIFMVCVHRDPLGVEGRSPEYEEPRDLRSNPFQGGGE

SEQ ID NO: 141931 - protein, 93 aa, Glycine max
  Coding DNA Sequence Number=SeqID_50246
MGSSQKPSLKKRFYQVKIKSLEVTSLGELGQLMGQLQRCFTFEDFQLVPTVKEFEEILGCPLGGRKPYLFSGFYPSTTRVAKVVKSQHKSWTV

SEQ ID NO: 141932 - protein, 199 aa, Glycine max
  Coding DNA Sequence Number=SeqID_50247
MVIDQSLYFKLTQLSSDGVPFEGTLDDDWKFDISVSDARRLVCTNQADMTGRLLAGSLAFEFCIMHYLIVRILLPRSSNIAQPFVKVKRSFSIDVNVVSSFGYRKERDGSWVKKDAPAQAAEDRSPSPPPQRDDSSSLMHNILDRLDGLHTFVGECFDLLDNRIDAIDARFAGMDTRITQLEEDMSYVRQCFDLPQASS

SEQ ID NO: 141933 - protein, 95 aa, Glycine max
  Coding DNA Sequence Number=SeqID_50248
  Subcellular localization annotation: CTP_CleavageSite=13; ConfidenceScore=5.11e-01
MKKSKPRRFRNVSVSNYAKILDRSSTFIICSSFSSVFNGKWIIFKVQRLKMITFQVKESLDSRLKKELRRSDFLFAGGYVGARAPLLSTSKNKKK

SEQ ID NO: 141934 - protein, 76 aa, Glycine max
  Coding DNA Sequence Number=SeqID_50249
MYIKYGPKYIMKHSQQNMLSNKKPPTLIPKTIPKAPKFLKVKEASIRIKPRLLCKQSMGQNTPNDYDDGWLKFSQR

SEQ ID NO: 141935 - protein, 110 aa, Glycine max
  Coding DNA Sequence Number=SeqID_50250
MTQELVARRDALWLSAPRHSVTPGHVTRGDKIWSFCTPLPFRHSRVRWHADKLWSFCTLLSSRGGGPDDMRRQNLVIPHPFPFRHSRVRWHAETNYGHSALFVIQTRRAR

SEQ ID NO: 141936 - protein, 77 aa, Glycine max
  Coding DNA Sequence Number=SeqID_50251
MEPPVTGKYVFVIFRIGSFAKYKKKGVETTVVITERAGRTKSVPYLCFPLISDERYLAPFVAQYVKSRDVPKIKRKQ

SEQ ID NO: 141937 - protein, 31 aa, Glycine max
  Coding DNA Sequence Number=SeqID_50252
MENWRTALRNNFAGLQTRRLVGGGHMNSARQ

SEQ ID NO: 141938 - protein, 46 aa, Glycine max
  Coding DNA Sequence Number=SeqID_50253
MKLYDGAIRTFSNVRGDDITRVQVCWFKVGIQGVQGGTLGVAMIEK

SEQ ID NO: 141939 - protein, 41 aa, Glycine max
  Coding DNA Sequence Number=SeqID_50254
PTTGYCTLKKIPWVKWEAICLPKEEGGLGIKEISKFNEALL

SEQ ID NO: 141940 - protein, 195 aa, Glycine max
  Coding DNA Sequence Number=SeqID_50255
  Gene Ontology: Mol. function=subtilase activity; Biological process =proteolysis
  Homolog annotation: Hit_ID=A5BU47; Match level="QueryCoverage=85%, HitCoverage=9%, E-value=8e-11, Identity=28%"; Hit description =Putative uncharacterized protein
MISQRLLTVGTKRKLLQTVGERWRQFKSDLTRKWALAADQDGVEDTVCDKYGISKEKWAQFCQTRRDPSWEDVRMKAQAIQKHNIAPHILSRGGYDYLEQKLLAEKTKKKMQEAAQSGSIDGVIDPPSPDSFEEQATQGSFIPHGRQDVLAAAIGRPEHPGRVRGIGADVTIKQYFGLAPRTSRNASSLPPDELH

SEQ ID NO: 141941 - protein, 184 aa, Glycine max
  Coding DNA Sequence Number=SeqID_50256
VDSRGSHLYRELMAGSGPGNQRIKVRLRPFAITKNTVINALMQRLLHHRRTGEIKIGNPHRQQLCRASAEVESADAERCRHIYPGRSPRQQRFNNGAGILDSARQVLVIQPHATIGVFEQLRRNQQRQLAVTGRAGDQNGGGHGRCNQLADAFDNRQQAVDDDGQRAGQRERAGEREGAEHQQD

SEQ ID NO: 141942 - protein, 250 aa, Glycine max
  Coding DNA Sequence Number=SeqID_50257
GVLGHSIEQCVAFKHKDSLNVRTNPLTGHGGSAINAVEEWEPWGPKWMREVLTSRRFILEALREANMICLDGDKGDSCLIHLEASHDVATCPMVEELLQGMMDKGQIEVCSARKREGDLVPVKNPTPFPYKSDKAVSWKYVAQGPDGRKDVSVVHVKDDLSSTKVTNISGTSGMTHSGRIFTAPELPMRSKDPKGKAKADVEESDKAGLVPNDEVPVGRFTKEEDDFCKKGISIEEATKFLRIIQQSEFK

SEQ ID NO: 141943 - protein, 63 aa, Glycine max
  Coding DNA Sequence Number=SeqID_50258
  Gene Ontology: Mol. function=DNA-directed RNA polymerase activity; Cellular component=chloroplast; Biological process=transcription, DNA-dependent
  Homolog annotation: Hit_ID=Q8HVY5; Match level="QueryCoverage=100%, HitCoverage=9%, E-value=3e-24, Identity=63%"; Hit description=DNA -directed RNA polymerase subunit beta
  Pfam annotation: Domain name=RNA_pol_Rpb2_3; Domain location=1-33; Score=17.8; E_value=0.00018; Accession=PF04565.7; Description=RNA polymerase Rpb2, domain 3
IHPSHYGRICPIDTSEGINVGLIGSLAIHARIGNSLALNRDIQEEQTVPARYRQEFLTIAWEQ

SEQ ID NO: 141944 - protein, 105 aa, Glycine max
  Coding DNA Sequence Number=SeqID_50259
MLPQAADAPPPHQAGPAGSFDTEQYLRHLVRQQAANHRAHVQTHDCLYQLSLSLQGQGFTSFPFPTPDQFRAEVAWPGDWPEARAGEKTKQRLQTRQMRPARTRR

SEQ ID NO: 141945 - protein, 74 aa, Glycine max
  Coding DNA Sequence Number=SeqID_50260
CSRILAWCRKCLCVVGCGKSNLERIDGDPVLRETRIWATWEYVSSVGGEQQGMVGLCAHCGCGKLVVHHRPTAT

SEQ ID NO: 141946 - protein, 91 aa, Glycine max
  Coding DNA Sequence Number=SeqID_50261
MASRDQVWSFCTRYAEIPYGYLHPFARQTQLCPMASRDQVWSFCIHMIRGGADTVFAPFVPSGNNKVIYMRKFHGRPRLSSTERREISVIH

SEQ ID NO: 141947 - protein, 105 aa, Glycine max
  Coding DNA Sequence Number=SeqID_50262
MAFSKRDSTPTLHLDIKYSLGYFSANDSSSPFHLSSQNFIWSSLPTLHFISCWIICPWCELVRAFCKSLHQTDLLPTLSTSAKPLRPPYLEFSTLALLFVQLQIV

SEQ ID NO: 141948 - protein, 136 aa, Glycine max
  Coding DNA Sequence Number=SeqID_50263
MVKEECKEVSVSSKRLAKKESHFTIKTNIKETSPLRQHPHFLLCKKTLVRIATPLGLKFIPQVKELLDEGLVLKSLNPCALLVASKDKHCFKINTRLLQQTKPCFKINSGSSLASSLTQDQDLPQNKVFPRHPRLW

SEQ ID NO: 141949 - protein, 107 aa, Glycine max
  Coding DNA Sequence Number=SeqID_50264
MDGFIEPMEEHNLETLESSSFPPKQRTAESPQGRADRMLLPSAVHVSSTFEFGAVFHDCLSADPQGNPPFSPFSERYECYCLALFMCPPLSSAKPLVTGKHIILLFF

SEQ ID NO: 141950 - protein, 97 aa, Glycine max
  Coding DNA Sequence Number=SeqID_50265
MGNWRTALRNNFAGLQTPLGNNIHGAPKKKWGMENWRTALCNNFPRLHTGRWRMHEQRLAITFMGLRKKWRMENWRTALRNNFAGLQTRRWRTHEQC

SEQ ID NO: 141951 - protein, 120 aa, Glycine max
  Coding DNA Sequence Number=SeqID_50266
MDEKMKKRQHDAMTTENTPNSGDPPSLIQRHAKWVLARTKQYGQMTSHSAQEISDKIGTFVPHGREGILNTAIGPPDHGGHVRAVGSGVTISQYFGREQWKNEIQVLKDELKEQIILEMS

SEQ ID NO: 141952 - protein, 281 aa, Glycine max
  Coding DNA Sequence Number=SeqID_50267
  Homolog annotation: Hit_ID=Q6WAY6; Match level="QueryCoverage=88%, HitCoverage=40%, E-value=2e-09, Identity=25%"; Hit description =Putative uncharacterized protein
MGTRGCISYNPVLAIRQLGYPMRGAPLEDELAPVISRGFNKTNVETLQKVRKAWEVLQKKDKELRGSNNGPIGGYRKWLKAHVQGLDWLPSLRTAKREEVEAPEEDEEVQALRAELEQAQTVKERFKSAALKIQKENTELRDINVATTKALERETKRACREEHGRNKFRGALWGSNSELKLRREEMYQSRVDSLILKDELKACSRSKRSLSQRLCETETNMLAIITKYQEELNLASAHEHRVAEEYAQVYAGKEARGRVIDSLHQEATMWMDRFALTLNES

SEQ ID NO: 141953 - protein, 168 aa, Glycine max
  Coding DNA Sequence Number=SeqID_50268
MSVLELYIEKDVAGNSMFHSANSLTSCGNNLSNNEAQPPRNVSNLHGDEDDDDDYLVSNSYIEESLDEDDSVDGISDTDDEVTDMIQPFDVRHKLYPLVILNKLQDVRMCHMVDPIFALGDQDFFCPDVSPFLLGQPQQKIGDANQLLISHLYQVLFWVHSMAYLMGR

SEQ ID NO: 141954 - protein, 288 aa, Glycine max
  Coding DNA Sequence Number=SeqID_50269
  Homolog annotation: Hit_ID=Q2HW90; Match level="QueryCoverage=71%, HitCoverage=39%, E-value=6e-17, Identity=31%"; Hit description =Putative uncharacterized protein
STLEDPTVVLFPNVDDLVDLAAIDAFLAYLHSKESPVVAILADLFDTFDRRCEKNSARIVCCLPALCVWLVSHLFQQDTRHPCSLQSYRSCAEKGRVDWDQHLAGIGGNAINWFPLWKEGKEGVLFSCGDYPNVPLIGTRGCINYNPALAIRQLGYPMRGAPTEESLSPFLVRDLGAQSLKVIQRVHKAWRSPLRKDKELRGIQNGVIGGYHGWLRVHTRGLDWLSKLKVINEENFEAPEEDEEVQALKLELGKARLAKEKFKSATTHIRKECTELQEENAATARALE

SEQ ID NO: 141955 - protein, 64 aa, Glycine max
  Coding DNA Sequence Number=SeqID_50270
MPSFRDLEQKWLPKVGALLELQWWRKKKRMATYAKCLHLSGAKEPTFSLDVTHAQPHEEKNLTF

SEQ ID NO: 141956 - protein, 278 aa, Glycine max
  Coding DNA Sequence Number=SeqID_50271
  Gene Ontology: Mol. function=DNA binding; Cellular component =intracellular; Biological process=regulation of transcription, DNA -dependent
  Homolog annotation: Hit_ID=A4WDN3; Match level="QueryCoverage=39%, HitCoverage=81%, E-value=4e-29, Identity=63%"; Hit description =Nucleoid protein StpA
  Pfam annotation: Domain name=Histone_HNS; Domain location=5-110; Score=124.4; E_value=3.4e-34; Accession=PF00816.12; Description=H-NS histone family
MARELSLDVLEEMLEKVRVVAEEKRSELAELEQQRAEQQEKINALLELMKADGISPTELLNSERALAGKTVKKRKPREAKYRFIDQNGEEKTWTGQGRTPKPIASALANANIEPPHRFSDLHLSPRMTSGTAYFTDDGLRGTPVPGHHPEQSRHTAKARHTGEQQPGSDKTAEQEKAAGDAIAQHHAAQNEQPGGNLHLTHQRQRLGSVFDGLQPGLLPALNPPFDHKCLSGRGCPGKAIGIPRGPGTGLAVENYRVTGPGFKPCRWDPLESTCRHAS

SEQ ID NO: 141957 - protein, 159 aa, Glycine max
  Coding DNA Sequence Number=SeqID_50272
  Homolog annotation: Hit_ID=Q6UUU1; Match level="QueryCoverage=69%, HitCoverage=93%, E-value=2e-25, Identity=53%"; Hit description =Putative uncharacterized protein
AWATTGIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTGNGGETRQDYKDTGVSPGGSLVRSSLFLPFGLPVSFR

SEQ ID NO: 141958 - protein, 82 aa, Glycine max
  Coding DNA Sequence Number=SeqID_50273
MGHNNSFQNCPMYGVACQCYDSTSDSPQISASPYQLDFTLYASGSWNAPGLLHDKHTLRSSRILRKMEVVFVIGSAVDRLCG

SEQ ID NO: 141959 - protein, 128 aa, Glycine max
  Coding DNA Sequence Number=SeqID_50274
MTKLGLCVPSDTTVSEWQRGADNRKVSPRIIMTKLGLCVPSDTTVSEWQRGADNRKVSPRIIMTKLGLCVPSDTTVSEWQRGADNRKVSPRIIMTKLGLCVPIGHDLCLNGKAGADNRKVSPRIMCAE

SEQ ID NO: 141960 - protein, 117 aa, Glycine max
  Coding DNA Sequence Number=SeqID_50275
MATMMEAMMSINEIMEVNVTAIASTGTIAEVYLTPQYGLNKINHPTSDMVGLEGKELGGTGGPHLVQKISVPYGLPPNYTPPNVTYTLGEDVNNSAPILVERRQPQTDHAHVSQPMG

SEQ ID NO: 141961 - protein, 151 aa, Glycine max
  Coding DNA Sequence Number=SeqID_50276
MTRGNPSDLQPFDPEIDRTFHRLVRHHFIPFDHPEHSITGESVHSVIGDFEHPDLEHYDSDHSDSAHSENMAQPPPRERTLREMAAPDFTYKSLCIQYPDEDVPYVLKIGLIHLLPKFHGLAGEDPHKHLKEFHIFCSTMKPPDVQEDHIF

SEQ ID NO: 141962 - protein, 119 aa, Glycine max
  Coding DNA Sequence Number=SeqID_50277
MSGFTHNSPQISASPHQLDLAPYASEPYNAQWNAPGLLHDKHTLRSSRILRKMEVEEPWLGLWLPLNYRVDRGSSLAYDNGIWGEPYRLFAAKFLFVGVFWFVLKAVFVIGSAVDRLCG

SEQ ID NO: 141963 - protein, 59 aa, Glycine max
  Coding DNA Sequence Number=SeqID_50278
MVSALMMLMFHTSYYMEIEKYLYLGACHSVQNFLKTQVDHHGGGGELPMHDKVTLTLVA

SEQ ID NO: 141964 - protein, 392 aa, Glycine max
  Coding DNA Sequence Number=SeqID_50279
MEFYANLYDPEDKSPKQVRVRGHLVKFDEDTLNTFLKTPVILEDGENLCTYSRFALLRPDPQELAAKFCIPGKGFELNVDGQPLKILRKNMTTLAQTWSVLSFSNMIPTSHTSDVTLDSAKSIYGIIMKMDMNLEYLICHQISLIAQHDTSRLGFSALIIALCKARGVQSDSRSLENLSHTINLAYIKKNYWNLDDPTVTFRGPRKARGKRSEVPTTSAAPETPTPTSSTAPVPLIQTPVIPPTFTQLPLPAPLYAGPSDFSFTPQMLHSMAQSLHRGQSIIMQSLQGLGLPSIMSMDEFNMQEPILEEPAAAVEGEDELTPPKPFYFDADAHMAQEEGTSIDQILKPSPAPVPEETQPSTPVTEPEQPIQDSSAAPTLDHNEDQPQDEQDV

SEQ ID NO: 141965 - protein, 53 aa, Glycine max
  Coding DNA Sequence Number=SeqID_50280
MEGGIGSIQDLAPKEEKRIKGEWRRRRVERRHHFKEKMSQEEAHHHRKPWIRA

SEQ ID NO: 141966 - protein, 84 aa, Glycine max
  Coding DNA Sequence Number=SeqID_50281
MVLRREVVFDGGDHGGEGGGHGSAEVVEHGRGGTGYDEAATVEVNDERSLVRTGRVGSEEGAVWGMWRKRVRVPLRLRTMSRCL

SEQ ID NO: 141967 - protein, 104 aa, Glycine max
  Coding DNA Sequence Number=SeqID_50282
MLKLAAKDKSFIHKGNKNPDPVYAHSGPVLVQMIDPKKEAGPTLVQMAQAEEMALARVEWTLRSLECRPPGPAEAHGLQRPHPLPKEKVGLLARPPSKEILQCL

SEQ ID NO: 141968 - protein, 162 aa, Glycine max
  Coding DNA Sequence Number=SeqID_50283
  Gene Ontology: Mol. function=motor activity; Cellular component=cell projection
  Homolog annotation: Hit_ID=UPI00016621D1; Match level="QueryCoverage =96%, HitCoverage=40%, E-value=1e-13, Identity=33%"; Hit description =UPI00016621D1 related cluster
LHVLAFKGLHALTFRGLHVLALRGPQALAFRGLHILLFRGLHVLPFRGLHVLSFQGRHVLTFRGLHVLAFRGLHVLAFRGLHVLVFRGLHAHAFRVLHVLAFRGLHVLTFRGLHVVAFSGIHALVFRGLHILAFRGLDALAFRGLHVLPIRGLHVLPFRGLH

SEQ ID NO: 141969 - protein, 257 aa, Glycine max
  Coding DNA Sequence Number=SeqID_50284
MSKSFEFGMTGSLDESISCFLIRMDPRFLGPPLDIGGQPTVQAQPERKAITQLLCIPGQDFTRAAAKRRQHSAQQPQCQSPPADVSVGLRRHDIGIAPTRRPVDPKNSNRALGFPALVTGLCQSYRVPVPPARSCHRDIGIAPTKTPSGLGEVQQGHGVLVPPGKGLCPQDAQWTWRSPTGSWSCQALITGLCQFYGVPVAPSKVIRPPTKRAFIKKYCVPRQVQGETPQQLGDGRQRATDAPPSPLEFTSADPQKG

SEQ ID NO: 141970 - protein, 18 aa, Glycine max
  Coding DNA Sequence Number=SeqID_50285
LCKDKSKRAGSLKMTLDQ

SEQ ID NO: 141971 - protein, 236 aa, Glycine max
  Coding DNA Sequence Number=SeqID_50286
  Gene Ontology: Mol. function=oxidoreductase activity, acting on the CH-OH group of donors, NAD or NADP as acceptor; Cellular component =cytoplasm; Biological process=lipopolysaccharide biosynthetic process
  Homolog annotation: Hit_ID=A6TF98; Match level="QueryCoverage=100%, HitCoverage=35%, E-value=1e-103, Identity=76%"; Hit description =Bifunctional polymyxin resistance protein arnA [Includes: UDP-4 -amino- ...
  Homolog annotation: Hit description=4-deoxy-L-arabinose formyltransferase (EC 2.1.2.n1) (UDP-L-Ara4N formyltransferase) (ArnAFT); UDP-glucuronic acid oxidase, UDP-4-keto- hexauronic acid decarboxylating (EC 1.1.1.n1) ...
  Homolog annotation: Hit description=(UDP-GlcUA decarboxylase) (UDP -glucuronic acid dehydrogenase) (ArnADH)]
  Pfam annotation: Domain name=Formyl_trans_N; Domain location=1-177; Score=81.2; E_value=3.4e-21; Accession=PF00551.10; Description =Formyl transferase
MKAVVFAYHDMGCTGTLALLEAGYDIAAIFTHPDTAGENHFFSSVARIAAERGIPVYAPDDVNHPLWVERIRALAPDVIFSFYYRNLICDEILGLAAKGAFNLHGSLLPAYRGRAPLNWVLVNGETETGVTLHRMVHRADAGAIIAQHRVAIDADETALQLHQKLCTVAQSLLRDALPAILNGTFSETAQDESKASTFGRRTPEDGRLDWNQPARQLHNLVRAVTDPWPGAYSFAG

SEQ ID NO: 141972 - protein, 63 aa, Glycine max
  Coding DNA Sequence Number=SeqID_50287
MGLHSSSSVNGEDYTPKDPLHRAHPRPHSHWREKERKPQEANINLLYFHGKDNVEANLDWEIR

SEQ ID NO: 141973 - protein, 185 aa, Glycine max
  Coding DNA Sequence Number=SeqID_50288
  Gene Ontology: Mol. function=hydrolase activity, hydrolyzing O -glycosyl compounds; Cellular component=extracellular region; Biological process=polysaccharide catabolic process
  Homolog annotation: Hit_ID=A4WFV3; Match level="QueryCoverage=88%, HitCoverage=45%, E-value=3e-77, Identity=80%"; Hit description =Cellulase. Glycosyl Hydrolase family 8. precursor
  Pfam annotation: Domain name=Glyco_hydro_8; Domain location=1-185; Score=-19.2; E_value=6.4e-09; Accession=PF01270.8; Description =Glycosyl hydrolases family 8
MKAFRWCAVAALMLAALPLRAACTWPAWEQFKKDYISEGGRVIDPSDTRKITTSEGQSYALFFALAANDRRAFEQILTWTRDNLAGGNLNDHLPAWLWGQKDKENWAVIDTNSASDADVWIAWSLLEAGRLWKHPDYTRTGKALLKRIAGEEVVKVPGLGAMLLPCKVGFADENAWRFNPSYLPP

SEQ ID NO: 141974 - protein, 148 aa, Glycine max
  Coding DNA Sequence Number=SeqID_50289
VHQVKVKYGSNQLAKFGAEDGSRKEHALQCPYQTRARARVMSEIEEVQEQMKADMEAMKKKIAMLSMKKIMEVNTAAVATTSAAAEGGKALGSTGGPHFVNKNSFPPYGLPPNYTPPDVAHAPDKNVNNSTPILFESQQLQSDQAHVS

SEQ ID NO: 141975 - protein, 61 aa, Glycine max
  Coding DNA Sequence Number=SeqID_50290
MTKSKGKDPLEGLGGPMTRARARKAKDALQQVLSILFEYKPKFQGEKSKVLHSAIKFVLIP

SEQ ID NO: 141976 - protein, 178 aa, Glycine max
  Coding DNA Sequence Number=SeqID_50291
  Homolog annotation: Hit_ID=A7MPS4; Match level="QueryCoverage=35%, HitCoverage=55%, E-value=5e-25, Identity=85%"; Hit description =Putative uncharacterized protein
QQLIAVGVDEKGFAAVFIHDQLIAIAETGNGDLIAVLQTRALLPGGNLEMPGWPHQRAEPVGGTRYRHGGAARAGARQGLSPSWVFSTEASHCGQEEPLHSIDFALFARLAQSPFRRRFHLGAKERQYCIEKGPAVIDQHAADFIQQRLAAAEPKNDGKQTPMRGHPVVYRPARHGNL

SEQ ID NO: 141977 - protein, 31 aa, Glycine max
  Coding DNA Sequence Number=SeqID_50292
STLEDPTTEKKMMAMIVDTLPVFYYEKMVGY

SEQ ID NO: 141978 - protein, 63 aa, Glycine max
  Coding DNA Sequence Number=SeqID_50293
MASQEKWVPFADILALLIFGVVLFPNVDGLVDLAAINAFLAYHHSKESPVVAIFDAILSRKGI

SEQ ID NO: 141979 - protein, 141 aa, Glycine max
  Coding DNA Sequence Number=SeqID_50294
  Homolog annotation: Hit_ID=A5AWZ0; Match level="QueryCoverage=97%, HitCoverage=7%, E-value=6e-11, Identity=37%"; Hit description =Putative uncharacterized protein
  Subcellular localization annotation: CTP_CleavageSite=69; ConfidenceScore=5.78e-01
PNLSPPFVAPIPQTSQASPVNSSSVPLIPPGFSPLPAHSPITTIFVPCPSTSSAPIPIQPQNSKSTNPTSSTSESVSIPNSIPVNTHPMQTRSKFGIHNPRLHPSPFLTHFEPKTVKQALASKDWLIAMQHEYDPLLKNHT

SEQ ID NO: 141980 - protein, 95 aa, Glycine max
  Coding DNA Sequence Number=SeqID_50295
MNPPPLRPKPHELIAVATYPSAGGRRETRGMRVPRKEYARSRHQRLFEENVGITGKDAIYELFSERFGSCIYARGRVFPFAPTYSSIWDEKIRPT

SEQ ID NO: 141981 - protein, 151 aa, Glycine max
  Coding DNA Sequence Number=SeqID_50296
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=34%, HitCoverage=50%, E-value=4e-24, Identity=100%"; Hit description=LacZ protein
MVCNCYELLFSISSISIYYGIHSDIRRSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 141982 - protein, 76 aa, Glycine max
  Coding DNA Sequence Number=SeqID_50297
MESPTVATYPSAGGRRETHKCVFQEKKMRGVATNVYSRKTSEKPERCGLRTLSVKGSGVVFTHGKGISTLCVRHKG

SEQ ID NO: 141983 - protein, 84 aa, Glycine max
  Coding DNA Sequence Number=SeqID_50298
  Gene Ontology: Mol. function=RNA-directed DNA polymerase activity; Biological process=RNA-dependent DNA replication
  Homolog annotation: Hit_ID=A5B0P7; Match level="QueryCoverage=79%, HitCoverage=36%, E-value=9e-11, Identity=35%"; Hit description =Putative uncharacterized protein
MSPYQVVFGKACHLPVEIEHRAYWAVKSCNMAFDEAFEIKNDVTGKVFKVNSHQLKLFHESLQAEEEFMADLSLILPILCDDMF

SEQ ID NO: 141984 - protein, 99 aa, Glycine max
  Coding DNA Sequence Number=SeqID_50299
MGAKYLEVVKRGSHPNKRMAHNDHNLSLRSLGHDRAWMARHRMTIICLCVPSDTIATCPSRASEGEAHGCAFQRRKDVRSCHQRLFVENVGKTEGNWSK

SEQ ID NO: 141985 - protein, 109 aa, Glycine max
  Coding DNA Sequence Number=SeqID_50300
MTKYIPPTRGLYGRDFHPSLVCHIDLITSAIPKYVLNFFLWGPSAFPVAGSMLTTDLSALGSLVAKDHSHVALHVRFKVDGDADAIAGGGGGGGEGGGGGEAGGVAMGL

SEQ ID NO: 141986 - protein, 72 aa, Glycine max
  Coding DNA Sequence Number=SeqID_50301
MSHDVKDNRGKWAPNYEGPFVVKRAFSRGALGQNRLRQWSDAGTKLKAETNQGKTVTRPQFAAQCHFLLSGT

SEQ ID NO: 141987 - protein, 181 aa, Glycine max
  Coding DNA Sequence Number=SeqID_50302
MHNYYEKGRAPDLESVLEDFMTYQASSKGDCYSMQQQGAQFERDYSSVDYQWESKWKPYYHNEVEGLSNLDDLLMQFKDTIDSMQQAFKRTETQLGKLVDDMTKVVVRREEEYEKIEAHQESILQVTTIHHQLINEEEKDEVSSTPEYPCMATAGYVVGTNKGRLPLSVEDQKIILTSLKP

SEQ ID NO: 141988 - protein, 293 aa, Glycine max
  Coding DNA Sequence Number=SeqID_50303
  Homolog annotation: Hit_ID=Q6WAY6; Match level="QueryCoverage=51%, HitCoverage=29%, E-value=5e-21, Identity=37%"; Hit description =Putative uncharacterized protein
ILAGKGEWAPFIDILALLIFGGVLFLNVDGLVDLAAIDAFLAYHDHKESPVVAMLADLYDTFDQRHACPLESHRSCTEKGGANWDQLLANKEGASVNWFPRWKEGRTGVLISCGGFPNVPLIGTRGCISYNPVLAIRQLGYPMKGAPLEEEIAPIISRGFNRNNMETLQKVRKAWKVVRKKDKELWAVTMGPRWLPTAKREEVEAPEEDEEVQALLTELEQAQTVKERFKSAALKIRKENAELRDINIATTKALEQETKRARREEHGRNKFRGALWGINSELSSGERKGINHE

SEQ ID NO: 141989 - protein, 32 aa, Glycine max
  Coding DNA Sequence Number=SeqID_50304
MAEINQGKMMTAHDRSHIVWLLLAGNRRLILT

SEQ ID NO: 141990 - protein, 272 aa, Glycine max
  Coding DNA Sequence Number=SeqID_50305
  Gene Ontology: Mol. function=phosphoprotein phosphatase activity
  Homolog annotation: Hit_ID=Q2HTA0; Match level="QueryCoverage=64%, HitCoverage=27%, E-value=1e-19, Identity=34%"; Hit description=IMP dehydrogenase/GMP reductase, related
  Pfam annotation: Domain name=DUF1723; Domain location=165-214; Score =45.3; E_value=2.2e-10; Accession=PF08330.1; Description=Protein of unknown function (DUF1723)
MVRTRGLRHVVGTGRGRGLSQDVAEDVPHRRRPTASARRQRVTQRVEDVPQLPEDVPQLAEDVPHVFDGSPERTGAADGAESDRVASNGTAADDEGFPGGPHDPSVLIGFADHVAHNIWSGQERPDLKLVSHGRKVDKFGRPAAKIECMIAATRLDPLIRCSVITTDPGLISAFVERWHRETSSFHLLVGEVTITLDNISSLLHILITGTLHSFELLATSDAVALLTEILEVTPDEATAKTRQAGGPHVRLSWLRDMYQSRCRARQWVAAAR

SEQ ID NO: 141991 - protein, 146 aa, Glycine max
  Coding DNA Sequence Number=SeqID_50306
MHKALRSGAPLPYPQLVTLFLQHFEIPLDSEPFVLVKRSFAIGAGAVTSFGYRKDVDGQWLKKDAQPLQDECTPSPPPQRDDSSVLMNEVLLELRGLCTYVGERFNSLDGRIDAIDARFEGMDTRITQLEKDVSYLRRCFDLPPPS

SEQ ID NO: 141992 - protein, 303 aa, Glycine max
  Coding DNA Sequence Number=SeqID_50307
MALKKLPTKRSRKHTTGAGSNAAPQADMDFDWHRFWSTEHHQHFKTIKGWHWAPLVTPKAKFDSEIWIPFDTNALNQFLGHPLVLVEGQQCEYNQRRRQVSGFDEVAIAQLLCIPRKDFTRTAAGRRVRIMRTSMTTLTHIWMMLLCSNILPSEHNSDLPLPKCQLVYAILTQVSVHVAQLVSNDIYQFAGAAPMRHLIDLERSNRALGFPALITGLCQFYRVVVTPSKGEAPQQPGDGHPQAADAPLSPLESTSAHLRRLERCIRHVADQQAANHRGPAGTSGGGDEAQEDEDMADLIDFLL

SEQ ID NO: 141993 - protein, 112 aa, Glycine max
  Coding DNA Sequence Number=SeqID_50308
MEGYSANKDSVDDTVCEKYGISKEDVWKKAQAIQKQNTVPHVLSRRGYEYLKQKLMAKKTKKKLEEVAQSRSTEAMIDPPSPIRRHVKWKMVCTKKTGQMTSKAAKEIVEKI

SEQ ID NO: 141994 - protein, 92 aa, Glycine max
  Coding DNA Sequence Number=SeqID_50309
MMRIMKLAKYRLKAQVEKDEGPSNPCGVYPDLSSFTGSGVYPDLSSFTGSGVYPDLSSFTGSGVIQKLYSLYQVIRPVRFTSSGIRASALDT

SEQ ID NO: 141995 - protein, 174 aa, Glycine max
  Coding DNA Sequence Number=SeqID_50310
  Homolog annotation: Hit_ID=Q6WAY6; Match level="QueryCoverage=25%, HitCoverage=7%, E-value=4e-12, Identity=70%"; Hit description =Putative uncharacterized protein
EHLSTGSLDGRKTRVLISCGGFPNVPLMGTRGCISYNPVLAIRQLGYPMRGAPLEDELTPIISRGFNKTNVETLQKAIASLAQYYDPPLRCFTFGDFQLSPMVEEFEEILGCPLGENWTSPYLFSERGKWASFSRYSRTVDLRKDESSFRMWRVGGLAAIKDKLFSLIIITRKA

SEQ ID NO: 141996 - protein, 150 aa, Glycine max
  Coding DNA Sequence Number=SeqID_50311
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=39%, HitCoverage=46%, E-value=2e-09, Identity=57%"; Hit description=LacZ protein
MQWHDRFPEWKAGSERNAINGTKAGTGPPLEVGGIDKHDLPCTVRLSSILHFSSEPHELIGTHASSTNESGAPRIDCLALFAYPPFSTFIRSPIPGDPLVLERPPPRWSSNSPYSESYYNSLAVVLQRRDWENPGVTQVNRLAAHPPFAS

SEQ ID NO: 141997 - protein, 58 aa, Glycine max; identical to SEQ ID NO: 136396
  Coding DNA Sequence Number=SeqID_50312

SEQ ID NO: 141998 - protein, 158 aa, Glycine max
  Coding DNA Sequence Number=SeqID_50313
LCCLNVELLGCWGKLGRIDGDPVLRETRIWATWAYVSSVGGGQQGMVGLCAICGCGKLLCTIARPPPSTTCDGVVPGDMSRGSGDLGDVRRAPGSQQIKGTKTTKQGGLWWLASCESCVIYGLWPLVIDYQGLENEVVEASGNRLPVCVIDYTEEWVT

SEQ ID NO: 141999 - protein, 120 aa, Glycine max
  Coding DNA Sequence Number=SeqID_50314
  Subcellular localization annotation: CTP_CleavageSite=50; ConfidenceScore=5.37e-01
TYQGNPCGVYPDLSSFTGSGVYPDLSSFIGSGVYPDLSSFTGSGVYPNLSSFTRSGVIQTFVACIKRSAPGSTFNFERLVILRDSKRHPRKKLLSFEFAQSFNIQFRASRYITGLNQTSE

SEQ ID NO: 142000 - protein, 79 aa, Glycine max
  Coding DNA Sequence Number=SeqID_50315
MSFTKGKMSVNEMTLKKLSTKRSRRDATGEGSSAASEFDSHWFRSVEHQQRFEAIKGWSFHRERLVQLRENEYLTSRER

SEQ ID NO: 142001 - protein, 191 aa, Glycine max
  Coding DNA Sequence Number=SeqID_50316
MQAYRLPSYLDGVLRCSSGHAATNSTTTYDREAINVNAVQGAFRLIQSAANCNWEGCDRCGPHLPAITPVGKPGIVLQGCIKLIGPTRGEAFSQHVRWALKRRPVNCILAYYVGTDEGVSEVELPPRVAGAQKKAGHRCVSRNSDTDIVKFQASSLTDLDYLESFDCGERKWLTNGAEISWKMPGRYLTGK

SEQ ID NO: 142002 - protein, 39 aa, Glycine max
  Coding DNA Sequence Number=SeqID_50317
MSLGTNEGNKIQNLGIQVKWWLDRNIEMAITEATGLQMR

SEQ ID NO: 142003 - protein, 256 aa, Glycine max
  Coding DNA Sequence Number=SeqID_50318
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGSIKHQRVSSKADSLEPSQSTTVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142004 - protein, 69 aa, Glycine max
  Coding DNA Sequence Number=SeqID_50319
MSDQEEIQEQMKADMSALKEQMASMMDARLGMRQVMENNTATAAAVSSAAEADKTLPATAHHPIPNVAG

SEQ ID NO: 142005 - protein, 45 aa, Glycine max
  Coding DNA Sequence Number=SeqID_50320
GEWRIALRVHTLAIMKHSSKLEGSALMAIMKHSSKLEGGGHMNAC

SEQ ID NO: 142006 - protein, 183 aa, Glycine max
  Coding DNA Sequence Number=SeqID_50321
MSGAPTEESLSPFLVRDLGAQSLKVIQRVHKAWRSRLRKDKELRGIQNGVIGGYRGWLRVHTRGLDWLSKLKVINEENFEAPEEDEEVQALKLELGKARLAKEKFKSAATHIRKEYTELQEENAVTARDLEQETKRDRKEEYGREKFRGALWGSNNELKLRREERDRSREHGMILKEELAACA

SEQ ID NO: 142007 - protein, 45 aa, Glycine max
  Coding DNA Sequence Number=SeqID_50322
MAVTGGQWWWRRSLGVLGEGLREEKEEENGSFMLLDVFVACNTRQ

SEQ ID NO: 142008 - protein, 49 aa, Glycine max
  Coding DNA Sequence Number=SeqID_50323
IVGARYAGRRETRGMRVPRKEYARSRHQRLFEENVGKTGKDAIYELFSE

SEQ ID NO: 142009 - protein, 49 aa, Glycine max
  Coding DNA Sequence Number=SeqID_50324
MYIWQHKVNDSAQNIGLSNSKGCASVSSPENQNYMSSANEPAINREGNN

SEQ ID NO: 142010 - protein, 231 aa, Glycine max
  Coding DNA Sequence Number=SeqID_50325
  Gene Ontology: Mol. function=chloramphenicol O-acetyltransferase activity; Biological process=response to antibiotic
  Homolog annotation: Hit_ID=P62577; Match level="QueryCoverage=83%, HitCoverage=84%, E-value=2e-97, Identity=89%"; Hit description =Chloramphenicol acetyltransferase
  Pfam annotation: Domain name=CAT; Domain location=6-166; Score=322.8; E_value=6.3e-94; Accession=PF00302.9; Description=Chloramphenicol acetyltransferase
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFSPPFSPWANIYARRQGADAAGDSVVLLHVFPGWTQDDSYRIRRSGRTERGVRAYSPAWSELPTRN

SEQ ID NO: 142011 - protein, 129 aa, Glycine max
  Coding DNA Sequence Number=SeqID_50326
MPQNVLYDAIGIYQRWYLNSDAYIPCARGDAPVSFTDSLVYDGVNFEVLQWRNHGFYQLSLPVQLLTGNGVIRQFGTQATEPEASALASVKPGVPKTLQLTHHLPIAVALHCAAIPVGETCRAIRCIQG

SEQ ID NO: 142012 - protein, 109 aa, Glycine max
  Coding DNA Sequence Number=SeqID_50327
  Homolog annotation: Hit_ID=A0ST23; Match level="QueryCoverage=22%, HitCoverage=51%, E-value=3e-07, Identity=100%"; Hit description =Putative reverse transcriptase
MAKWIALRNLMLEDTETQRSDRMWHWGMGGARYQLLFPLVRVNFELGVIMVIAVSFGKPVVPAALMNRPTRGERRFAYWALAECILAYYVGTDEGVSEVLHVAGEKRLH

SEQ ID NO: 142013 - protein, 188 aa, Glycine max
  Coding DNA Sequence Number=SeqID_50328
GETPGIFIVLSGFATTDLSVRFRDACQGGGAYGNNGYARTLSLPTVSKYLPGIFEFRPGGFNTVVTGTPWRYSQLVIASMQHIRPLAPAGVIAQRPAPIALRATVGRFSLNAANGDSLVHPRLYTCRADASGCITPRGARYCAISYTCDILGVKRTTVYAEFQSQILVSLLIPGSPGPTFGENETLIG

SEQ ID NO: 142014 - protein, 61 aa, Glycine max
  Coding DNA Sequence Number=SeqID_50329
  Gene Ontology: Mol. function=oxidoreductase activity, acting on NADH or NADPH, quinone or similar compound as acceptor; Cellular component=photosystem II; Biological process=electron transport
  Homolog annotation: Hit_ID=Q2PMN8; Match level="QueryCoverage=90%, HitCoverage=13%, E-value=7e-25, Identity=92%"; Hit description =NAD(P)H-quinone oxidoreductase chain H, chloroplast (EC 1.6.5.-) (NAD(P)H dehydrogenase, chain H)
RVEGVGVVDIKEVINWGLSGPMLRASGIQWDLRKVDNYECYRRIDWEVQWQKEGEQYNSLA

SEQ ID NO: 142015 - protein, 94 aa, Glycine max
  Coding DNA Sequence Number=SeqID_50330
  Subcellular localization annotation: CTP_CleavageSite=44; ConfidenceScore=5.50e-01
MTSSKHQSQSLYFYNFMVNAVSRTYPLDLMMKFVHFQLSSWAKRASTAKRSFSMLSAKENLAEHQHQSRALSAAGAFSQAKRKTSTKSNSTYSR

SEQ ID NO: 142016 - protein, 253 aa, Glycine max
  Coding DNA Sequence Number=SeqID_50331
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTFYPTYTPDYGADQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142017 - protein, 122 aa, Glycine max
  Coding DNA Sequence Number=SeqID_50332
  Subcellular localization annotation: CTP_CleavageSite=33; ConfidenceScore=5.31e-01
MWQVSSPGRATPALKYKNKGGDVFCTQKLPPPPSFKRRKLTGLTVFAPPSHLWLHFAFIFGTPTHSHKFVWEGPRPMLDSKTMGHGTLPPLSWYSFLNMRPRSGRGNASMTYEHGFGQHEGI

SEQ ID NO: 142018 - protein, 62 aa, Glycine max
  Coding DNA Sequence Number=SeqID_50333
ILTTCVFAVFHLVLLFVVKEVSGLWKAKSSVGSSLGNWSDSKVLDSTGLSCCAITRNRGTRT

SEQ ID NO: 142019 - protein, 47 aa, Glycine max
  Coding DNA Sequence Number=SeqID_50334
MWVSREWFPADFRREEKEKSDFRQEDDKEKREGKLTDVNIKYITSVF

SEQ ID NO: 142020 - protein, 94 aa, Glycine max
  Coding DNA Sequence Number=SeqID_50335
MECPRAPPRYAHVAFESYPQKNGGLREPSRGYGYHCIIKNGSHNMGFSLILTLFHLPQFSHSSKQEDEYISTFDQTHIDPFTGKDQIRSALKVP

SEQ ID NO: 142021 - protein, 85 aa, Glycine max
  Coding DNA Sequence Number=SeqID_50336
MGWKKGMHGLPANIESDEAAVTQADQLPDSAHLRPKACAQLMGVSIATFWRLVSTGKLKTHKLTERTTTVRAGDLRAFMSGKVEG

SEQ ID NO: 142022 - protein, 190 aa, Glycine max
  Coding DNA Sequence Number=SeqID_50337
  Homolog annotation: Hit_ID=A5ACQ2; Match level="QueryCoverage=54%, HitCoverage=7%, E-value=3e-08, Identity=30%"; Hit description =Putative uncharacterized protein
  Pfam annotation: Domain name=G-patch; Domain location=61-100; Score =25.4; E_value=0.00016; Accession=PF01585.14; Description=G-patch domain
  Subcellular localization annotation: CTP_CleavageSite=37; ConfidenceScore=5.18e-01
MDHIVAKVLIDNGSSLNVMPKSTLEKLPFNASHLKPSSMVVRAFDGTRREPCLSDAAVMMARVMLGNGYEPGMGLGKDNGGITSLINAKGNRGKYGLGYKPTQEDIKRSIAGRKSGSQSSRLRQESEGSPPYHISRSFISAGLGDEGQVVAIYGDDVPSTLDLVRPCPPDFQLGNWRVEERPDIYAMSIM

SEQ ID NO: 142023 - protein, 37 aa, Glycine max
  Coding DNA Sequence Number=SeqID_50338
MVLRDGEYISESDVEEEEESEYVEDEETSEGDLLMIR

SEQ ID NO: 142024 - protein, 104 aa, Glycine max
  Coding DNA Sequence Number=SeqID_50339
  Homolog annotation: Hit_ID=UPI0000ECBAF8; Match level="QueryCoverage =41%, HitCoverage=50%, E-value=1e-17, Identity=100%"; Hit description= UPI0000ECBAF8 related cluster
EALPKRFRNVFREEFRKGFNRSSTFFIRSSSFFDLQRSGRHRGGAPIRPIVSRITIHWPSFYNVVTGKTLALPNLIALQHIPLSPAGVIAKRPAPIALPNSCAA

SEQ ID NO: 142025 - protein, 59 aa, Glycine max
  Coding DNA Sequence Number=SeqID_50340
MAGRGRDHNRDVLDRITTVLETLVQERDVEPAEYRGLMAFRKNHPPMFSGDYDPEGARL

SEQ ID NO: 142026 - protein, 64 aa, Glycine max
  Coding DNA Sequence Number=SeqID_50341
MTSKELNEEPYEVKISCTNRSESNSNDSKHSTLFWNPRTQSYGYVNTGFPILAGKGGERILNFK

SEQ ID NO: 142027 - protein, 23 aa, Glycine max
  Coding DNA Sequence Number=SeqID_50342
SGRTKLFFRFVCVPLHVQFAMVG

SEQ ID NO: 142028 - protein, 340 aa, Glycine max
  Coding DNA Sequence Number=SeqID_50343
  Gene Ontology: Mol. function=dihydroorotate dehydrogenase activity; Cellular component=membrane; Biological process='de novo' pyrimidine base biosynthetic process
  Homolog annotation: Hit_ID=A3XN90; Match level="QueryCoverage=98%, HitCoverage=99%, E-value=1e-136, Identity=75%"; Hit description =Dihydroorotate dehydrogenase
  Pfam annotation: Domain name=DHO_dh; Domain location=45-335; Score =385.1; E_value=1.1e-112; Accession=PF01180.12; Description =Dihydroorotate dehydrogenase
MYKSIIRPILFKFDPEEVHHLTFSMLKNFGFLTKLFFPKPIEDKRLEREVFGLKFKNPVGLAAGFDKNAVLFEELADLGFGFVEIGTLTPKGQPGNDKKRLFRLKEDSAIINRMGFNNEGVDAAVERLKKNKNVLIGGNIGKNKVTPNEEAVNDYKICFEKLFPYVDYFVVNVSSPNTPNLRELQDKEPLTQLLGTLQQMNNGKANPKPILLKIAPDLSDDQLLDIIDIVKDTKIAGVIATNTTLSRENLSSENKSETGGLSGKPLAKRSTEVIRFLSEKSGRAFPIIGVGGIHSAKDAIEKLDAGASLIQLYTGFIYEGPELINEINKELLKRASRLPR

SEQ ID NO: 142029 - protein, 64 aa, Glycine max
  Coding DNA Sequence Number=SeqID_50344
MKKQQWKRSGRQRRRGERRHHPLGNKPWKKELHHHVEPWIRSLERMLQWRKRKRERKREGGARN

SEQ ID NO: 142030 - protein, 210 aa, Glycine max
  Coding DNA Sequence Number=SeqID_50345
  Gene Ontology: Mol. function=helicase activity; Biological process =viral genome replication
  Homolog annotation: Hit_ID=Q2A9E0; Match level="QueryCoverage=84%, HitCoverage=12%, E-value=3e-36, Identity=44%"; Hit description =Putative uncharacterized protein
MLQCEGYFSYLRHNIKIPNGENARNWVANVVFKFHNDPTVNESEIIIFSKTGSKRDIIVETQNGELQRIHELHPSYLSLQYPLLFPYGEDGYKADILHRSTSSSKKRKRNRLTMRECFAYRLQFKSNEAQTLLHSRKLFQQFIVEGYTMVESIRLSYIRNNQKKLRVDKYCSLQNSLDTGTAKGLTKGKRVILPSTFVGSPRYMDQLYFD

SEQ ID NO: 142031 - protein, 30 aa, Glycine max
  Coding DNA Sequence Number=SeqID_50346
MAFVDNWPVGKEEELRPICPHHILDNSLLL

SEQ ID NO: 142032 - protein, 101 aa, Glycine max
  Coding DNA Sequence Number=SeqID_50347
MSILILRSKKEEKGNFQSKKKRRKISNQRKKGSKGIPNHEWEKENRKERKFPTKGWEKRLFHPALNKNRKGKANKKSKAKNTQKPKNPPKEPIPKGSPIDP

SEQ ID NO: 142033 - protein, 310 aa, Glycine max
  Coding DNA Sequence Number=SeqID_50348
  Gene Ontology: Biological process=transposition, DNA-mediated
  Homolog annotation: Hit_ID=Q6UUU1; Match level="QueryCoverage=19%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGIRSSPGASTLQGVSYDGTTAGVTERDAVSKSVNEITGRRSLRLTFQEGLFGPSRHGASRQSSQHFGRSSLSIPSTSRGGPVPAFVPFSEVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142034 - protein, 107 aa, Glycine max
  Coding DNA Sequence Number=SeqID_50349
MVQMTIQKGADDQVLSLRAVATCPSRASEGEAHGCAFQRRKGARSRHQRLFVENVGKTEGNQSNENSKFGSCIYARGRSTKVGLLLLRTLLWRGNQTYVVLTYAWIK

SEQ ID NO: 142035 - protein, 167 aa, Glycine max
  Coding DNA Sequence Number=SeqID_50350
MVIQTPFAIQRQSSPMARGDKTWSSAPFLLSRDNQVHWHAERKHDHPHPLCYLETIMFDCTQRQNMVIHTFFAIQTQSSPMARGDKKKQSRPMACRDKTRSSAPFLLSKDNEVRWHVETKHGHPYLVCHPETIKSDGAWRQTWLSTPFLLYRDSQVGWYPETEHGHT

SEQ ID NO: 142036 - protein, 149 aa, Glycine max
  Coding DNA Sequence Number=SeqID_50351
MAHREKTWSSTGASSIGACRPRIFFINGFLCFLEDEWQRNGERKRERRRHFKEKMSLEEAHHHRRPWIRAWTKKEMNEGRGREIERGEHEIEGIKEVEKWYSETIKSDGTRRPNMVIRLFTIQRQSTSMARRDKTWSSTPFSLSRDNKV

SEQ ID NO: 142037 - protein, 339 aa, Glycine max
  Coding DNA Sequence Number=SeqID_50352
  Homolog annotation: Hit_ID=Q6WAY6; Match level="QueryCoverage=91%, HitCoverage=51%, E-value=8e-29, Identity=30%"; Hit description =Putative uncharacterized protein
MGSSQAPSLKKRFYQVKVKSLGTTSLKELGQLMGQLQQQAFRKAYGKIWDLAMAEVSTEAIASLAQYYDQPLRCFTFGDFQLSPMVEEFEEILGCPIGGRKPYLFSGFYPSLARISKIVQISAQELDHRKQVKNGVVGVPRRCLEAKAIILAGRGEWAPFIDILTLLIFRGFLFPNVDVLVGLAAIDTFLAYHDRKESPVVAILADLYDTFDRRCEKSSARIVCCTPAFYVWLVSHLCRQEVRHPCPLESHRSCTEKRGANWDQLLASKEGASVNWFPHWKEGRIGVFIPCAGFPNVPLIGTRGCISYNPVLVIKSTWLPYERGTTRGRAHAYYCTRFQ

SEQ ID NO: 142038 - protein, 200 aa, Glycine max
  Coding DNA Sequence Number=SeqID_50353
  Gene Ontology: Mol. function=motor activity; Cellular component=cell projection
  Homolog annotation: Hit_ID=UPI00006A2D9E; Match level="QueryCoverage =99%, HitCoverage=86%, E-value=5e-16, Identity=17%"; Hit description =UPI00006A2D9E related cluster
GLHTLAFRGLHVLAFRGLHVLAFRGQHALAFRGLHVLAFRGLHALAFRGLHFLAFRGLHVLAFRGLHALAFRGLHVLAFRGLHALAIRWLHALTFRGLHALTFRGLHALAIRGLHVLAIIGLHDLTIRGLHAFTIRGLHALAFRGLHVLAIRGLHDLTIRGLHILAFSGLHIIAFRGLHVLAIRGQHALAFRGLHVLAFR

SEQ ID NO: 142039 - protein, 273 aa, Glycine max
  Coding DNA Sequence Number=SeqID_50354
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTFFNAIHACLLDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142040 - protein, 119 aa, Glycine max
  Coding DNA Sequence Number=SeqID_50355
  Homolog annotation: Hit_ID=Q6WAY6; Match level="QueryCoverage=72%, HitCoverage=15%, E-value=3e-08, Identity=38%"; Hit description =Putative uncharacterized protein
MGTRGCISCNPVLAIRQLGYPMRGAPLEEELAPVISRGFNKANGETLQKVRKAWEVVQKKDKELKGSNNGPIGGYRRWLKAHVQGLDWLPSLRTARRVEVEAPEDDEEVQALRAELEQA

SEQ ID NO: 142041 - protein, 41 aa, Glycine max
  Coding DNA Sequence Number=SeqID_50356
MRPPLSSTEPTVRGKYEKEEGETGVTYFKSFWVGTIVIEIN

SEQ ID NO: 142042 - protein, 181 aa, Glycine max
  Coding DNA Sequence Number=SeqID_50357
  Homolog annotation: Hit_ID=A2Q2J0; Match level="QueryCoverage=28%, HitCoverage=4%, E-value=5e-08, Identity=45%"; Hit description=RNA -directed DNA polymerase (Reverse transcriptase); Ribonuclease H
MGPHQEEATLVDLGTGSGKKEVKIGMGMAAPIREELIALLKDYQDIFAWLYQEFIFFLNWLTNVPVSACMRRSSVGELVPLDLEIEATFRRNNAERKRKILHDRTVASILEEAHFSESSSSNSPTSMESQTAEFEAEVMAEEQPQRVTLEDYSSTSVPQFFTSIVQLEVQAHNITYPHSLI

SEQ ID NO: 142043 - protein, 202 aa, Glycine max
  Coding DNA Sequence Number=SeqID_50358
  Homolog annotation: Hit_ID=A9CEP8; Match level="QueryCoverage=100%, HitCoverage=52%, E-value=7e-93, Identity=83%"; Hit description =Putative uncharacterized protein
  Pfam annotation: Domain name=DUF993; Domain location=2-202; Score =261.3; E_value=2.1e-75; Accession=PF06187.2; Description=Protein of unknown function (DUF993)
MSELKLPKDDRSIEVYRLSGTPVAVEKRSAADFNRVAFAAAHVVADPLADNDPWLTPAIDWDATLRFRHRLWDLGLGVAEAMDTAQRGMGLAWPQAQELISRSLKEAASRKDALIACGVGTDHLNGSGYDLNQIVHSYLEQLDFVQGEGGRVILMASRALAAAARSPDDYLKTYTRVLSRAEQKVVIHWLGEMFDPALEGYW

SEQ ID NO: 142044 - protein, 284 aa, Glycine max
  Coding DNA Sequence Number=SeqID_50359
PPLTLSSRITIARRVQWWLPWQICLIPLTGDVRKTVHGLSIVYPLSVCGWFHTYSNKTQDTRVRFKAIAHVPKKGRVDWDQHLAGIGGNAINWFPRWKEGKEGVLFSCGDYPNVPLIGTRGAQSLKVIQRVHKAWRSPLKKDKELRGIRNGVIGGYHGWLRVHTRGLDWLSKLKVINEENFEAPEEDEEVQALKIRAREGETRQGEVQISRYTHPEREHCGVATTSSSSEGRKETGHGSKRSLAQCLEATEQSMLAIIGQYKEELNQSVTHEQKLVEDFDGPHN

SEQ ID NO: 142045 - protein, 94 aa, Glycine max
  Coding DNA Sequence Number=SeqID_50360
MGIAPTRHPVDPEKSNRALGFPALVTGLYQSYRVPVPPRQGHVIIALITGLCQFYGVPVTSSKGIRPPTNRAFIKKYCAPDRRKAKHHSSIGMA

SEQ ID NO: 142046 - protein, 132 aa, Glycine max
  Coding DNA Sequence Number=SeqID_50361
  Gene Ontology: Mol. function=transporter activity; Cellular component= integral to membrane; Biological process=transport
  Homolog annotation: Hit_ID=Q32DZ3; Match level="QueryCoverage=86%, HitCoverage=50%, E-value=2e-42, Identity=76%"; Hit description =Transmembrane water channel
  Pfam annotation: Domain name=MIP; Domain location=13-132; Score= -30.5; E_value=8.2e-08; Accession=PF00230.11; Description=Major intrinsic protein
MAIYPACGKACGNYVEVVMFRKLAAECFGTFWLVFGGCGSAVLAAAFPELGIGFVGVALAFGLTVLTMAFAVGHISGGHFNPAVTLGLWAGGRFPAKEVIGYIVAQVVGGIIAAAVLYVIASGKEGFDAAAS

SEQ ID NO: 142047 - protein, 133 aa, Glycine max
  Coding DNA Sequence Number=SeqID_50362
MTPEQQQILLRASAASTFSGLIAGVSGPSGQCLTGDWCQCPRFAEAVYPDLLNHPAGADGDYAGRGAGRVAGYRALFCPDHDRAGQNGYFYRNAQQYQARMGEYASGSPCRDRLAAGENASAPVCAEFCGFNA

SEQ ID NO: 142048 - protein, 183 aa, Glycine max
  Coding DNA Sequence Number=SeqID_50363
LLPESYVVVYYTEFDKFKEELERRHWDEKLTNFSNSSIDIAIVKEFYANLYEPDDKSPKQVRVRGHLVKFDEDTLNTFLKTPVVLEEGENLCTYSRFALVRPDPQELAAKLCIPGRGFGLNANGKPLKILRKNMTTLAQTWSILSFSNLIPTSHTSDVTLDRAKLISVLSTAVVQQEGSKDEA

SEQ ID NO: 142049 - protein, 186 aa, Glycine max
  Coding DNA Sequence Number=SeqID_50364
MHYIIVRILLPRYSNLAQASEEDLILMWAFLTGHQIDWAHLVRYRMHKALRANAPLPYPQLVTLFLRHFQIPLDDEPFVQVKRAFAIGVGAVTSFGYHKDRNGQWLKKDALPPQDERSLSPPPQRDDSALMTEVLSELWGLRTYVGECFDSLDTRFAGMDICLTQLEEDVGYIRQCFDLPPPPPPF

SEQ ID NO: 142050 - protein, 218 aa, Glycine max
  Coding DNA Sequence Number=SeqID_50365
  Gene Ontology: Mol. function=peptidyl-prolyl cis-trans isomerase activity; Cellular component=periplasmic space; Biological process =protein folding
  Homolog annotation: Hit_ID=P20753; Match level="QueryCoverage=73%, HitCoverage=84%, E-value=2e-86, Identity=96%"; Hit description =Peptidyl-prolyl cis-trans isomerase A precursor
  Pfam annotation: Domain name=Pro_isomerase; Domain location=32-191; Score=257.2; E_value=3.4e-74; Accession=PF00160.12; Description =Cyclophilin type peptidyl-prolyl cis-tr
ILMLKSTLAAVAAVFALSAVSPAALAAKGDPHVLLTTSAGNIELELNSQKAPVSVKNFLDYVNSGFYNNTTFHRVIPGFMVQGGGFNEQMQQKQPNPPIKNEADNGLLNTRGTISMARTADKDSATSQFFINVADNAFLDHGQRDFGYAVFGKVVKGMDVADKISQVPTHDVGPYQNVPSKPVVILSAKVLPPVVSLKKVMVLSEPHIERWSLGLSAP

SEQ ID NO: 142051 - protein, 215 aa, Glycine max
  Coding DNA Sequence Number=SeqID_50366
METLQKARKAREMVQKKDKELRGSNNGPIGGYHKWLRAHVQGLDWVPSLRTAKREEVEAPEEDEEVQAFRAELKQAQTVKERFKSAALKIRKENTELRDINIATTKALEQETKRARREEHGRNKFRGALWGSNNELKLRREERDQSRVDSLILKDELKVCSRSKRNLSQRLCKTETNILAIVSRYQEELNLATAHEHRVADEYAQVYAEKEARGR

SEQ ID NO: 142052 - protein, 197 aa, Glycine max
  Coding DNA Sequence Number=SeqID_50367
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=9e-24, Identity=100%"; Hit description=LacZ protein
MKHFTDTLISANIGTKAGTGPPLEVDGIDKLDIAPRVLRPETTYPLAKRWSGGRLEYRATPHGDLVGYRSRIDQVTMSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142053 - protein, 217 aa, Glycine max
  Coding DNA Sequence Number=SeqID_50368
  Homolog annotation: Hit_ID=Q6UUU1; Match level="QueryCoverage=27%, HitCoverage=40%, E-value=2e-18, Identity=78%"; Hit description =Putative uncharacterized protein
  Subcellular localization annotation: CTP_CleavageSite=42; ConfidenceScore=5.17e-01
GTSYVPINVSFSPKVGPGLPAVPPVQLLTGWCVTAKAPPDISAGKCSGRVPFAIQAAQLLGRAIGAGLFAITPAGERGMCCKAIKLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142054 - protein, 73 aa, Glycine max
  Coding DNA Sequence Number=SeqID_50369
MNLKRKGHALRCPYRTRARARVMGEAEEVQEKMKAEMEAMKEQMATMMEAIISMKKIREVDMVAVSATNAVAK

SEQ ID NO: 142055 - protein, 231 aa, Glycine max
  Coding DNA Sequence Number=SeqID_50370
MELTSPMWRHFRRSARHGRWCKRRTKNSRVVTMGLLVAPEFENSKKGGVEAPEDDEEVQALRAELEQAQTVKERFKSAALKIRKENAELRDINIATTKALEQETKRARREEHGRNKFRVALWGSNSELKLRREERDQSQVESLILKDELKVCSRSKRNMSQRLCETETNMLAIISKYQEEQNLATAHEHRVADEYAQVYTEKEARGRVIDSLQTPTLPLRRSTDFSAIVSI

SEQ ID NO: 142056 - protein, 217 aa, Glycine max
  Coding DNA Sequence Number=SeqID_50371
  Homolog annotation: Hit_ID=Q84VH5; Match level="QueryCoverage=78%, HitCoverage=29%, E-value=8e-72, Identity=73%"; Hit description =Envelope-like protein
MVDIDVSEHQIAKEITANRVQHWPKKGKLSAGKLSVKYAILHRIGAANWVPTNHTSTVATESFAVKLPIAFPTVLCGIMLSQHPNMLNYTDSVIKRESPLSLHYKLFEGTHVPDIVSTSGKAAASGAVSKNALIAELKDTCKVLEATIKATTEKKMELERLITRLSESGIDDEEAAEEEEEAAEEDKEAAEEEEEAAEEEEEAAEETESDDDSEATP

SEQ ID NO: 142057 - protein, 22 aa, Glycine max
  Coding DNA Sequence Number=SeqID_50372
MEEKLACVDSMEAGSWSLNEVL

SEQ ID NO: 142058 - protein, 1204 aa, Glycine max
  Coding DNA Sequence Number=SeqID_50373
  Gene Ontology: Mol. function=protein binding; Cellular component =membrane; Biological process=primary shoot apical meristem specification
  Homolog annotation: Hit_ID=A7PF76; Match level="QueryCoverage=92%, HitCoverage=100%, E-value=0.0, Identity=76%"; Hit description =Chromosome chr11 scaffold_13, whole genome shotgun sequence
  Pfam annotation: Domain name=LisH; Domain location=101-127; Score =19.0; E_value=0.009; Accession=PF08513.2; Description=LisH
  Pfam annotation: Domain name=WD40; Domain location=403-441; Score =6.1; E_value=5.6; Accession=PF00400.23; Description=WD domain, G -beta repeat
  Pfam annotation: Domain name=WD40; Domain location=464-502; Score =7.2; E_value=4.1; Accession=PF00400.23; Description=WD domain, G -beta repeat
  Pfam annotation: Domain name=WD40; Domain location=509-549; Score =29.4; E_value=1.4e-05; Accession=PF00400.23; Description=WD domain, G-beta repeat
  Pfam annotation: Domain name=WD40; Domain location=553-593; Score =26.6; E_value=9.5e-05; Accession=PF00400.23; Description=WD domain, G-beta repeat
  Pfam annotation: Domain name=WD40; Domain location=643-682; Score =5.1; E_value=7.4; Accession=PF00400.23; Description=WD domain, G -beta repeat
  Pfam annotation: Domain name=WD40; Domain location=904-941; Score =11.5; E_value=1.2; Accession=PF00400.23; Description=WD domain, G -beta repeat
  Pfam annotation: Domain name=WD40; Domain location=945-984; Score =9.2; E_value=2.3; Accession=PF00400.23; Description=WD domain, G -beta repeat
  Pfam annotation: Domain name=WD40; Domain location=988-1026; Score =34.0; E_value=5.3e-07; Accession=PF00400.23; Description=WD domain, G-beta repeat
  Pfam module annotation: Pfam domain module=LisH::WD40::WD40::WD40::WD4 0::WD40::WD40::WD40::WD40; Domain location=101-127::403-441::464 -502::509-549::553-593::643-682::904-941::945-984::988-1026
MLPVVENTASPPENKFKSRTLDKPIAYHRPHKHKSSNTRKARERERKWSEKNTETLLRHSRSAPSLSIFARDSLAGIVDLFGSRSFRAGFVDGSVMSSLSRELVFLILQFLDEEKFKETVHKLEQESGFFFNMRYFEDMVTNGEWDEVEKYLSGFTKVDDNRYSMKIFFEIRKQKYLEALDKHNEQLSKYGDTKSARGIMLAELKKLIEANPLFRDKLQFPTLKNSRLRTLINQSLNWQHQLCKNPRPNPDIKTLFVDHSCGQPNGARAPSPVTNPLMGAVPKAGGFPPLGAHGPFQPTPAALPTSLAGWMANPSPVPHPSASAGPIGLAAANNAAILKRPRTPPTNNPAMDYQTADSDHVLKRTRPFGLSDEVSNLPVNLLPVAYSGQSHGQSSYSSDDLPKTIVMTLNQGSIVKSMDFHPLQQILLLVGTNMGDVMVWDIGSRERIAQRNFKVWELGSCSVALQASLSNDYSASVNRVVWSPDGTLCSVAYSKHIVHIYSYQGGDDLRNHLEIEAHAGSVNDLAFSYPNKQLCVVTCGEDRVIKVWDAVTGAKQYTFEGHEAPVYSVCPHHKESIQFIFSTATDGKIKAWLYDNMGSRVDYDAPGHSSTTMAYSADGTRLFSCGTNKEGESFLVEWNESEGAVKRTYHGLGKRSVGVVQFDTTKNRFLAAGDEFMIKFWDMDNTNMLTSVEADGGLLASPCIRFNKDGILLAVSTNDSGVKILANAEGIRLLRTVENRTFDASRVASAAVVKAPTIGAFPSTNVTVGTSLADRAPPVAAMVGINNDTRNLADVKPRIVDEAVEKSRIWKLTEINEPSQCRSLKLPDSLSSMRVLSDIKIVYIHNIFLVSRLIYTNQGVAILALAANAVHKLWKWQRNERNTTGKATASIQPQLWQPSSGILMTNDISDTNPEDAVSCFALSKNDSYVMSASGGKISLFNMMTFKTMTTFMPPPPAATFLAFHPQDNNIIAIGMEDSSIQIYNVRVDEVKTKLKGHQKRITGLAFSHVLNVLVSSGADSQLCVWSTDGWEKQASKFLQMPSGRPPAPLADTRVQFHLDQTHLLAVHETQIALYEAPKLECIKQFSPREANPITHATYSCDSQSIYVSFEDGSIGILTVPALRLRCRINQSAYLHPNPSLRVHPLVIAAHPSEPNQFALGLTDGGVHVLEPLEAEGKWGTPPPNENGAGPSTTSGAAVSEQTQR

SEQ ID NO: 142059 - protein, 936 aa, Glycine max
  Coding DNA Sequence Number=SeqID_50374
  Gene Ontology: Cellular component=integral to membrane
  Homolog annotation: Hit_ID=A7PF63; Match level="QueryCoverage=99%, HitCoverage=76%, E-value=0.0, Identity=62%"; Hit description =Chromosome chr11 scaffold_13, whole genome shotgun sequence
  Pfam annotation: Domain name=WD40; Domain location=208-265; Score =2.5; E_value=16; Accession=PF00400.23; Description=WD domain, G-beta repeat
  Pfam annotation: Domain name=WD40; Domain location=391-427; Score =1.9; E_value=19; Accession=PF00400.23; Description=WD domain, G-beta repeat
  Pfam annotation: Domain name=WD40; Domain location=430-474; Score =14.2; E_value=0.49; Accession=PF00400.23; Description=WD domain, G -beta repeat
  Pfam module annotation: Pfam domain module=WD40::WD40::WD40; Domain location=208-265::391-427::430-474
MPSVGTSVPSPSILSVLLCQSDSILQNIGKNYSDVPSSPYLREDFENPFDFCYESNIVSKIHLISISDDGKMWNWLLTAEGQANTQKNDKKLDLVNNDHTVSHPGANSNTLVSSAGGRDLNAGRQRERFNDNRSRLQTSVFGQEEISMKISLVGQLQLLSSTVTMLAVPTPSLTATLARGGNYPAAAVPLVALGTQSGTIDVVDVSANAVASSLSVHNGIVRGLRWLGNSRLVSFSYTQANEKSGGYINKLVVTCLRSGLNKMFRVMQKPERAPIRALRTSSSGRYLLILFRDAPVEVWAMTKNPIMLRSLALPFTVLEWTLPTVPRPSKDQTSGASDEASKLSKTSSSDSKEGSSTEGSQDDTSESFAFALVNGALGVFEVHVSIVHRPKWPSSSFVSSDGLITAMAYRLPHVVMGDRIGNIRWWDVTTGHSSSFNTHREGIRRIKFSPFVPGDQSRGRIAVLFYDNTFSVFDLDSPDPLANSLLQPQFPGTLVLELDWLPLRTVKNDPLVLCIAGADSSFRLVEVNATTIEKRPHLIPGTPSSKGDLRTYMIDIPPLGDSVVPEMLLKVLEPYRKEGCMLDDERAKLYASIVDKGCAARFAFAAIIFGESSEALFWLQLPQALKHLLNKVLRKPPPKESTAAPISDVDDETSLLSRISSKGKPTEETGRDVLSQGQLRLMAFDREELWKSASERISWHEKLEGEEAIQKRIHELVSVGNLEAAVSLLLSTPPESSYFYVNALRAVALSSAVSRSLHELAVKVVAANMVRADRSLSGMHLLCAVGRYQEACSQLQDAGCWTDAATLAASHLKGSDYARVLQRWASHVLHTEHNIWRALILYVAAGALQEALAALREAQLPDTAAMFILACRETHAEVVSNLGILDEESSSSVKDELLNLRALDPNNEDVIAVNEYLGQYQRKLVHLCMDSQPFSE

SEQ ID NO: 142060 - protein, 128 aa, Glycine max
  Coding DNA Sequence Number=SeqID_50375
  Gene Ontology: Mol. function=electron carrier activity; Biological process=electron transport
  Homolog annotation: Hit_ID=A7QIN3; Match level="QueryCoverage=42%, HitCoverage=25%, E-value=6e-16, Identity=70%"; Hit description =Chromosome chr9 scaffold_104, whole genome shotgun sequence
  Pfam annotation: Domain name=Cu_bind_like; Domain location=90-128; Score=-29.5; E_value=0.089; Accession=PF02298.8; Description =Plastocyanin-like domain
  Subcellular localization annotation: CTP_CleavageSite=42; ConfidenceScore=5.25e-01
MALSTYPPFPYKCKQKALAFNVTSSFTGRRTRRKNRHKDLVLARIKQGRSHLQEHIAMARNLLLVLFAVATLLHGSAAQTRHMVGDATGWIIPAGGAATYTAWASNKTFTVNDTLVFNFATGQHNVAK

SEQ ID NO: 142061 - protein, 197 aa, Glycine max
  Coding DNA Sequence Number=SeqID_50376
MMKRQIIEIIGYVMCRSTVKQKIMLRWAGSCSIDLNLSSVSRRVMRWRWDTRMLLLEGFALRENMTFDVAPLTAAEKRFARCFGIGVFEKDPEIMRGLGLRHQGGHFIRESVVGVVSDGVGVEDVGAEMIAIKESFNLLFPIRIIVGKKFGDIGESDASKGFGWLMGVENEGVVVGHGRQGWGTTSLIEEIGNGWIV

SEQ ID NO: 142062 - protein, 53 aa, Glycine max
  Coding DNA Sequence Number=SeqID_50377
MAQRHRVVPGDLWSKEFGEKRNQYRPYVPLLCEGMKRLWMASNVWGQNGSAGC

SEQ ID NO: 142063 - protein, 808 aa, Glycine max
  Coding DNA Sequence Number=SeqID_50378
  Gene Ontology: Mol. function=nucleic acid binding; Cellular component= intracellular
  Homolog annotation: Hit_ID=Q6Z2C8; Match level="QueryCoverage=70%, HitCoverage=75%, E-value=2e-81, Identity=36%"; Hit description =Putative uncharacterized protein OJ1034_C08.5
  Pfam annotation: Domain name=G-patch; Domain location=670-714; Score =73.0; E_value=1e-18; Accession=PF01585.14; Description=G-patch domain
  Pfam annotation: Domain name=G-patch; Domain location=763-807; Score =73.1; E_value=9.4e-19; Accession=PF01585.14; Description=G-patch domain
  Pfam annotation: Domain name=R3H; Domain location=487-541; Score =28.1; E_value=3.2e-05; Accession=PF01424.13; Description=R3H domain
  Pfam module annotation: Pfam domain module=G-patch::G-patch::R3H; Domain location=670-714::763-807::487-541
  Subcellular localization annotation: CTP_CleavageSite=29; ConfidenceScore=5.30e-01
MGGGNRRSKGGNRKSNNSSGSGIPKSRKRGSDVKTALFVEGGFLSDWHLPSPTQIPGRSSGSNNKSGSHRRGEGSVSKSGFAKSLGATIRYNYPSFDVQLLQSNLCLMTYYQEVACAGIGNNGEDSNLNQLQPFVFADSKKGQIIAHIDQTPPSKPNNVKYRYTYDADFILGDSSHRGLGFPAEQDKTPSGIGTSEQMPQSTPVLDSSPFEKDADSGEGMDCELTNQMAEDLPSNVSAERNSGFLTIGGLKLYTQDISDNESDEYNDGDSPDEDSSASSEPEELLGSSETNDSEYSSDSDSDINEEVVEDYLEGVGGSDNIMEAKWLLKPVLDESNDDSSSSSCYDEALEKLSGFVLQEASREYGMKKAQPWKKRSVGSGPLALEDLMLEKDPRSISARKKHVPRFPQSWPSHAQKSKASKRIHGPILYLVDGIGVQSYGDFTSMEFETGNGCVFYTGEKKKLRKERIAVKRRERMLHRGVDLEKINSKLEKIVLEQVDMFSFQPMHSRDCSQIQQLAAIYQLQSSSQGSGKKRFVTVMRTQSTSMPSSSGRQRLEKLLGVDDEDADFSVADYVNKKSVSGDRRLGKKNAKRNDFRFQEPQSAQNKYSGSHKVKDKKGSGQKGSYANQPVSFVSSGLIHSETVQVTVDAEETNRNGVTSSANIGSFEEHTTGFGSKMMAKMGYTEGAGLGKNGQGMAQPIEVIQRPKSLGLGVEFSNNSAEPARNKSSRVGAKSLGVGVEFSNSPAKPAPNKSSNVGAFEKHTKGFGSKMMAKMGFVEGTGLGRESQGITTPLSAVRLPKSRGLGAKS

SEQ ID NO: 142064 - protein, 482 aa, Glycine max
  Coding DNA Sequence Number=SeqID_50379
  Gene Ontology: Mol. function=ATP-dependent helicase activity; Cellular component=intracellular; Biological process=RNA-mediated gene silencing
  Homolog annotation: Hit_ID=A7QS05; Match level="QueryCoverage=32%, HitCoverage=10%, E-value=3e-29, Identity=44%"; Hit description =Chromosome undetermined scaffold_155, whole genome shotgun sequence
  Pfam annotation: Domain name=dsrm; Domain location=112-185; Score =35.9; E_value=1.4e-07; Accession=PF00035.16; Description=Double -stranded RNA binding motif
MGVDVQAQGWKAKSKTLEEVLESTSKMEPKLIGYDETPIDVTDTNTAKHIVVNADPYNNSNPEICPMQLTDEICSPCVKPFGQRLQSSAKGKLSQIFENRDCGSDSSGTGTARSRLYELCAAYCWKPPSFECCKKEGPDHLKQFTCKVTLEIEEAQNLILEFVGEPLSKKKDAAESAAEGALWTKCLPEIAEKKKMKVAYILIPLNTLLQAIYKARLHAFLMGCARSFPFITFPGPSKTPCPQGVGATTMASTFEPGSQIKMGEEMSRWSVKGEGEGVVELLSTAEVLLADSENGDPAGVRGHVRVAVGDEGNNHNGKRTGQVRPVEVTAEVVTEPTVEVVAETESADSIPKASLLEGVEQRGRGAELVLGLHLRSEWQGENGSGVHLSLDSWSACSRQDEGGGSGRWKLRTASGSHGRQPWKLRMVVAEMKEGDEGCAATKVCGDGYDSHGRRPWTLNESTNVILGFRGPSASQKLQRRRR

SEQ ID NO: 142065 - protein, 460 aa, Glycine max
  Coding DNA Sequence Number=SeqID_50380
  Gene Ontology: Mol. function=protein binding; Cellular component =cytoplasm; Biological process=response to DNA damage stimulus
  Homolog annotation: Hit_ID=A7QS01; Match level="QueryCoverage=99%, HitCoverage=99%, E-value=1e-118, Identity=50%"; Hit description =Chromosome undetermined scaffold_155, whole genome shotgun sequence
  Pfam annotation: Domain name=WD40; Domain location=195-234; Score =9.1; E_value=2.4; Accession=PF00400.23; Description=WD domain, G -beta repeat
  Pfam annotation: Domain name=WD40; Domain location=280-319; Score =26.9; E_value=7.6e-05; Accession=PF00400.23; Description=WD domain, G-beta repeat
  Pfam annotation: Domain name=WD40; Domain location=327-365; Score =21.4; E_value=0.0035; Accession=PF00400.23; Description=WD domain, G- beta repeat
  Pfam module annotation: Pfam domain module=WD40::WD40::WD40; Domain location=195-234::280-319::327-365
MAPQKLTDYERKRLENIRRNDEMMAALKLHSKATQLSNFKRPRVGTKSYNMKSEKKPKTETPIVIRRSLRTRGIPPDSKGLDGDSVGPTTPRKTEPSVVSLGPISMADARESDHSDSFFVESLMGMAQLKAQYASVEKGKVEASLGLEALYLDPENIARVVPGRITSARFFPSSSVKMIAVGNTFGNVGFWNVGQSEVHLYRPHRAPISGILIQPHCLSKIYTSCYDGILRLMDAEKEIFDLVFESDESIFALSQPTNETNCLYLAEGSGGLTIWDNRIGKRLSHWVLHESRINTIDFNCKNPHIAATSSTDGTACTWDLRYTDGDKLTALRTFTHKRSVQSAYFSPSGCSLATTSLDNTIAIYSGVNMEDAAVINHNNQTGRWLSTFSRAKWGWDDSYLFVGNLKRGVDVVSAVQRKMVMTLESQHMSAIPCRFDTHSYEVGMLAGATSGGQVYIWTSR

SEQ ID NO: 142066 - protein, 46 aa, Glycine max
  Coding DNA Sequence Number=SeqID_50381
MHQQGYKFISFLELLGLKILEVERYKMHKKFKKAVEKHDQDLREEN

SEQ ID NO: 142067 - protein, 96 aa, Glycine max
  Coding DNA Sequence Number=SeqID_50382
MRGRRKQKNQPRTTTGRHGGGGFAWRCQGKSRRGELAEERGGNNTERRSRASCEKKHRERQCDLGKKMKESESKVWCREEKEKSGKNEEMGGRDGR

SEQ ID NO: 142068 - protein, 1076 aa, Glycine max
  Coding DNA Sequence Number=SeqID_50383
  Gene Ontology: Mol. function=transporter activity; Cellular component= endoplasmic reticulum; Biological process=transport
  Homolog annotation: Hit_ID=A5AD81; Match level="QueryCoverage=63%, HitCoverage=97%, E-value=1e-144, Identity=43%"; Hit description =Putative uncharacterized protein
  Pfam annotation: Domain name=Lipocalin; Domain location=910-1053; Score=1.1; E_value=0.025; Accession=PF00061.14; Description =Lipocalin  cytosolic fatty-acid bind
  Pfam annotation: Domain name=Lipocalin_2; Domain location=904-1051; Score=273.4; E_value=4.5e-79; Accession=PF08212.3; Description =Lipocalin-like domain
  Pfam annotation: Domain name=Myb_DNA-binding; Domain location=240 -290; Score=46.6; E_value=8.7e-11; Accession=PF00249.22; Description =Myb-like DNA-binding domain
  Pfam annotation: Domain name=Response_reg; Domain location=11-153; Score=48.0; E_value=3.3e-11; Accession=PF00072.15; Description =Response regulator receiver domain
  Pfam module annotation: Pfam domain module=Lipocalin::Lipocalin _2::Myb_DNA-binding::Response_reg; Domain location=910-1053::904 -1051::240-290::11-153
MVVGDRFPVGMRVLAVDDDKTCLTVLENLLRKCQYNVTTTNQAIKALEMLRKNRNKFDLVISDVNMPDMDGFKLLELVGLEMDLPVISKLKHFCSVLTFIQLEFKQRNISKFDLLSHNDGYGDKERVMRGVIQGACDYLTKPVRIEELQNIWQHVLRRRIDSKDKNKTASEGKGCSMAGKFANEEKARYMAGECSQAMAPKNNTDQNIKLGQKRKELSEDEEEEEYDKENEEHSNQKKPRLVWDAELHRKFLAAVNHLGIDKAFPKRILDLMNVEGLTRENVASHLQKYRLGLRKPTQQPSMVAALGSSDPYLQMDSVEGFRTLSGSVGMLSTTLPSYASGGVFCRLNPPSGLRGVNSALFQPVLSQNNSMSAKAFGNMQLSMFSANQTSSLLQGIPTSIDANKFQQNRSPGIRKLSPLDDSSGFKVSSGFSDTRATVINPNNFVHDLSNNHLLLQRNSPPAQNSGAFRNHSSLGAASVNTQSFDPGICELDHNRHNKSWQGTTQISKFPTNTSAVSKVFTHDQLAQNNLKFSSSTFCSGNSPVDFSSTRAIAPPLEDARGKLQSQEGLLENILLASCYTQHQSWESDKRGCNKDMSQTFNSTKSVSPNGDTSSLGHSLDQNNSVSSEGIGASLVNPSITQSNEGEKFYSMKSNDACILRSMESQEGLMQNTFGSLNDIMSEITEQVLNMRLENGNKFSSRGLKSGDEGGSRALQSPQESGVNLGAGGEGFEVLNLIGAVKLALKNGAGEVVVLELLLLLEVPVGLDGGRDLLGVDEEPYVHALHAGLQGLPGRALHRLVDESGGSSSPAATALSPPLPLSCCGEWRHGWSWAWAWAWAFEEVIAEAVASMVGIEKKERARWEGTEDCSKTLQTPSAFCPYVVIKKRNAFTTMVTKAMEVVKDLDVKRYMGRWYEIACFPSRFQPSDGTNTRATYTLRDDGTINVLNETWSGGKRGFIEGTAYKADPNSDEAKLKVKFWVPPFLPIIPVTGDYWLLYIDQDYHYAVIGQPSRNYLWILSRKNHMDEETYNQLVERAKDEGYDVSKLHKTPHSDSPPEEEGPQDTKGVWWIKSLLGK

SEQ ID NO: 142069 - protein, 754 aa, Glycine max
  Coding DNA Sequence Number=SeqID_50384
  Gene Ontology: Mol. function=glycerophosphodiester phosphodiesterase activity; Cellular component=anchored to membrane; Biological process=glycerol metabolic process
  Homolog annotation: Hit_ID=A7R0P3; Match level="QueryCoverage=94%, HitCoverage=99%, E-value=0.0, Identity=53%"; Hit description =Chromosome undetermined scaffold_314, whole genome shotgun sequence
  Pfam annotation: Domain name=GDPD; Domain location=357-643; Score =71.3; E_value=3.2e-18; Accession=PF03009.8; Description =Glycerophosphoryl diester phosphodiesterase family
  Subcellular localization annotation: CTP_CleavageSite=77; ConfidenceScore=5.04e-01
MFRSLFLISLLLHTIVAQKPALPNLPTPQVPPQKWSTLSGNEPLVIARGGFSGLFPEGSPDAIGLSQGISVFLCNLQVAKDGGAFCVTGTTLDNTTTISLVDPKEKTYNVDGKDVRGHFSLDYPGLLIDQNVSMTQAIFSRPNFYDGTSPVLNLDALLSGKSPPRLWLNVQNAALYTENGVQVVDIVLELLSFYQIEFVSSTSIGFLKSISGKSNKATKVVFKLLNNNKVEPSTKKPYGSIVKDLATIKSFASGIMVPKEYIWPVKPDKYLGPPTTLVADAHKSGLEVYASGFANDFFSSYSYNYDPIAEYLQFLDRGDSVDGVVTDFPATASNAIACFAHNNTLPKKGPTLIISNNGASGVYPGSTDLAYQQAIDDGADIIDCSVQMTKDGIAFCSNSTDLTSDTTAMPKFMSRSSNVPELQPKSGIFSFDLTWSEIQTLKPQMVSKGSDFLRNPANKTSGKFVTLSAFLELAKAKAVPGILVNIQNAPYLASQKGLDIVDAVSTALSNATFDKQAKQQVLIQSDDSSVLSRFKDIPSYKRVMLLKDKMGDVPRQTVEEIKKHADAVNLPKTSIIKVSNSILVGMTNVVKELKDANLTVFVHNLKNEYTTLAFDYWSDPNVEIATYVQTAKVDGIVTDFPATASRFMRSPCSDPTHDPTILPAKPGDLLNTIPTELLPPAQAPLPPLEVADVVDPPLPAVTKNSNSTKAEPAAGPGAKPASPPASPSGARVNVANSGLSIVAILVFAMLFAAH

SEQ ID NO: 142070 - protein, 330 aa, Glycine max
  Coding DNA Sequence Number=SeqID_50385
  Gene Ontology: Mol. function=phosphopantetheinyltransferase activity; Biological process=macromolecule biosynthetic process
  Homolog annotation: Hit_ID=A7P6K4; Match level="QueryCoverage=95%, HitCoverage=100%, E-value=1e-103, Identity=60%"; Hit description =Chromosome chr9 scaffold_7, whole genome shotgun sequence
  Pfam annotation: Domain name=ACPS; Domain location=154-221; Score =52.0; E_value=2.1e-12; Accession=PF01648.11; Description=4' -phosphopantetheinyl transferase superfamily
MISLRDKARLMMNIYCFGRNLVTTAASYLPPVQLPTQREVHFWYILPDEVKSTTLLNRYLEILSPCEKENIFRMRGEQLRKGALLARALVRTTLARYQTNFQIDPKSLKFMKNNYGKPELDWQYADDWSLPHLHFNISHTSSLIACGVTVGSPIGIDVEEKQRRLKNDILAFAQRFFSPHEIEMLTHIADPELRLQEFIKLWTLKESYVKAIGRGFSASPFKTFTIRLRDHHVKGDIHAPPLITSKAPDITVVEASDDVKNPSNNWQFVLLELAGSHYAAICIEQNSVNTGNGRIPINLTLRKTIPYVEDECISATDSAVVIGGLTRLSD

SEQ ID NO: 142071 - protein, 144 aa, Glycine max
  Coding DNA Sequence Number=SeqID_50386
  Subcellular localization annotation: CTP_CleavageSite=31; ConfidenceScore=5.54e-01
MAGALSLSQFPVRGSVSLPKRRIPRRSFCIRGMSEISSTFSVSTQQEEPTSNASSVTIAPPPNFKPPEPKRFAIRPDKTSEVFGALLPLLFRFATGVFVSGVFESVCPLSMFLLSKNLSQLEEENEKTYPADSVFGFLKHLFWK

SEQ ID NO: 142072 - protein, 289 aa, Glycine max
  Coding DNA Sequence Number=SeqID_50387
  Gene Ontology: Biological process=protein modification process
  Homolog annotation: Hit_ID=A7QUN3; Match level="QueryCoverage=90%, HitCoverage=100%, E-value=7e-79, Identity=57%"; Hit description =Chromosome chr10 scaffold_179, whole genome shotgun sequence
  Pfam annotation: Domain name=ubiquitin; Domain location=123-195; Score=33.7; E_value=6.8e-07; Accession=PF00240.14; Description =Ubiquitin family
  Pfam annotation: Domain name=ubiquitin; Domain location=213-285; Score=12.3; E_value=0.016; Accession=PF00240.14; Description =Ubiquitin family
  Pfam annotation: Domain name=ubiquitin; Domain location=32-102; Score= 36.5; E_value=9.7e-08; Accession=PF00240.14; Description=Ubiquitin family
  Pfam module annotation: Pfam domain module=ubiquitin::ubiquitin::ubiqu itin; Domain location=123-195::213-285::32-102
MVIKSYLCDSDLNCVDTNSNTLANILNNMDVIFELQRGRSFSMEVGYFDTVLEIKEKVQKYQNIPVSKQTLILNGQVLHDNDDPWKVKILHNTCIQLQVTPEKEENKELITSAHTKIQLNVKITSKTHLIPLEVDVNDTVLRLKEKIHEMETLAVPVNRLLLHASSTGAELHDHQLLRDCDVSENSEIDVGFRPSPTVASPGLKRLKLMVLPKSGTKKVPVEVNASDNVGELRKELQKLHQRVQFHLPQDGYFFIYKQNVMDDDRSFRWHHVAQGDTIEIFNGSVTGGS

SEQ ID NO: 142073 - protein, 70 aa, Glycine max
  Coding DNA Sequence Number=SeqID_50388
MTISCELRNPQPETAKTGTSAYKQIAMGKGGRPLSEEGAGDDEGDVDGVAAHEDLVEAFENASSSASSRH

SEQ ID NO: 142074 - protein, 134 aa, Glycine max
  Coding DNA Sequence Number=SeqID_50389
MGECMEQMGSFWDDFDFECRSVLQIIWQGSSCVFGVKGIFRYLTCFLEQDTLASEEDGKKSGSLGDFNVVRKPVGRRWETRLWTSSKSEMENSTLLLTPWNFWRFHLQEEYICGSKVVDQLVASLTCFYSHLNG

SEQ ID NO: 142075 - protein, 489 aa, Glycine max
  Coding DNA Sequence Number=SeqID_50390
  Gene Ontology: Mol. function=hydrolase activity; Cellular component =cellulose and pectin-containing cell wall
  Homolog annotation: Hit_ID=A7PPF0; Match level="QueryCoverage=99%, HitCoverage=98%, E-value=1e-118, Identity=70%"; Hit description =Chromosome chr8 scaffold_23, whole genome shotgun sequence
  Pfam annotation: Domain name=Abhydrolase_1; Domain location=127-484; Score=31.8; E_value=2.5e-06; Accession=PF00561.11; Description =alphabeta hydrolase fold
  Subcellular localization annotation: CTP_CleavageSite=10; ConfidenceScore=5.09e-01
MATGVTRKISAASARAHTRRAKKTNSLPLPSGILGTALAVLFIGFLAWAYQVIQPPPPKICGTPDGPPITAPRIKLRDGRHLAYKEHGVPKDAAKYKIISVHGFNSCRHDAVIADTLSPDVVEELGIYIVSFDRPGYGESDPDPNRTLKSIALDIQELADQLGLGSKFYVVGVSMGGQVVWNCLKYIPHRLTGAVLVAPVVNYWWPGLPANLTTEAYDQQKLQDQWALRVAHYVPWLTYWWNTQRWFPGSSVIAHSPHIFSHQDKELLPKLLSDRKSYAELSRRNLGSISPNMPSVCLIGFEITDGDAGGWPSHGQGSSLCEGMGEGCCTQPYPCICKEAVSGFEPMTNKSPRHNFTAAPGNCTLPSPCICKEVVSRFEPMTNRSPRHNFTKAQVIQQGDYETIHRDINIGFGNWEYSPLDLENPFPNNEGSVHLWQGDEDMMVPVTLQRYIAQNLPWINYHELQGSGHIFAHADGMSDTIIKSLLRAK

SEQ ID NO: 142076 - protein, 199 aa, Glycine max
  Coding DNA Sequence Number=SeqID_50391
  Gene Ontology: Mol. function=protein dimerization activity; Cellular component=nucleus; Biological process=regulation of transcription, DNA-dependent
  Homolog annotation: Hit_ID=A7P5U7; Match level="QueryCoverage=55%, HitCoverage=45%, E-value=3e-18, Identity=45%"; Hit description =Chromosome chr4 scaffold_6, whole genome shotgun sequence
  Pfam annotation: Domain name=AUX_IAA; Domain location=2-191; Score= -30.7; E_value=3.1e-07; Accession=PF02309.7; Description=AUXIAA family
MELQLGLALSTHSRAYDQPFSHKKRTFSQLMMMEHAPPPHHVMLPTLSLLPLTPSHHVVDDHHSQCSNITKDEEEEGVVGWPPVNHWRKKLHVEEVVGNNNNIDHMVWVDHRQTHSLQGYSSNTLYVKVKMEGVGIARKVDLSMHQSFHTLKETLMDMFGKCHHQQSNNYELAYLDKEGDWLLAQDVPWRQVHPTYLSP

SEQ ID NO: 142077 - protein, 111 aa, Glycine max
  Coding DNA Sequence Number=SeqID_50392
MHIQGLTEARNQSWKPQDPVGLLWVHWVSCGRDPCKQQMMTKVMNKKLKRSKNNSSESKNISSKSRTSQEFKNQGEFKTQEESLESRIKTQDLKNQDQDSRMTKRLNQDKY

SEQ ID NO: 142078 - protein, 158 aa, Glycine max
  Coding DNA Sequence Number=SeqID_50393
  Homolog annotation: Hit_ID=Q6WAY6; Match level="QueryCoverage=77%, HitCoverage=21%, E-value=1e-15, Identity=39%"; Hit description =Putative uncharacterized protein
MVGFAPFSPREKGGANRDQLLASKEGTSVNWFPRRKEGRTEVLISCGGFPNVPLMGTRGCISYNSVLAIRQLGYPMRGAPLEDELAPVISRGFNKTNMETLQKVRKAWEVLQKKDKELRGSNNGPISGYRKWLKAHVQGLDWLPSLRNAKREEVEAEC

SEQ ID NO: 142079 - protein, 397 aa, Glycine max
  Coding DNA Sequence Number=SeqID_50394
  Homolog annotation: Hit_ID=Q6WAY4; Match level="QueryCoverage=95%, HitCoverage=67%, E-value=4e-23, Identity=26%"; Hit description =Putative uncharacterized protein
MANQEEWVLFADVLDFLIFGVVLFPNVDILVDLAAIDAFLAYHHSKEWPVVAILADLFDTFDRRCEKNSARIICCLPALCVWLVSHLFQQDIRHPCPLQSHCSCVKKRRVDWDQYLAGIGGRTINWFPRWKEGKEGVLFSCGDYPNIPLIGTRGCINYNLTLAIRQLGYPMRGASMEESLSPFLVRDFGVQSFKIVQRVHKAWESPLRKDKELRGIRNGIIDGYHEWLKVHTRGLDWLSKLKIINEENFEAPEEDEEVRALKTELGKARLAKEKFKLVATDVRKECAELREENAAIARALEQETKRARKEEHGRDKFRGALWGSNKELKLQREERDQSRVHSMVLKEELAACSRSKKSLAQHLEATEQSMLAIIGQYKEELNQSLAHEQKLVEDFTQ

SEQ ID NO: 142080 - protein, 255 aa, Glycine max
  Coding DNA Sequence Number=SeqID_50395
  Homolog annotation: Hit_ID=A5BSR3; Match level="QueryCoverage=41%, HitCoverage=36%, E-value=1e-07, Identity=32%"; Hit description =Putative uncharacterized protein
MEEAAQSGSTDTVIDPPSPIRRHVKWKIARTKKAGQMTYEAAKEIADKIVSQGSFVAHGCQDVLTVTIGRPEHPSRVRAAGAGVTIKQSFGPAPRTSCMSSSMAPKDLEQLTQQIRDQLEESITEKVTRQLMLSFSHMQIQFQSQMQSQGLALPLEPEVGPLAARVSTKECCLDPSGNDPDTGDSNKYGLYIEENPPRLVTLGIVYEGSTTVHHNRLLHDQVKVGVEEVRDADAPIPIPTEEVKLVGQTLNTFLA

SEQ ID NO: 142081 - protein, 276 aa, Glycine max
  Coding DNA Sequence Number=SeqID_50396
  Gene Ontology: Mol. function=chlorophyll binding; Cellular component =integral to membrane; Biological process=photosynthetic electron transport
  Homolog annotation: Hit_ID=Q2MI75; Match level="QueryCoverage=82%, HitCoverage=44%, E-value=1e-128, Identity=98%"; Hit description =Photosystem II P680 chlorophyll A apoprotein
  Pfam annotation: Domain name=PSII; Domain location=1-223; Score =120.2; E_value=6.3e-33; Accession=PF00421.10; Description =Photosystem II protein
GYFQQEIYRRVGAGLAENQSLSEAWSKIPEKLAFYDYIGNNPAKGGLFRAGSMDNGDGIAVGWLGHPVFRDKEGHELFVRRMPTFFETFPVVLVDGDGIVRADVPFRRAESKYSVEQVGVIVEFYGGELNGVSYSDPATVKKYARRAQLGEIFELDRATLKSDGVFRSSPRGWFTFGHASFALLFFFGHIWHGARTLFRDVFAGIDPDLDAQVEFGAFQKLGDPTTKNSCCEGCPKAIYKAYPVKLTSKPDIEMAIRVAVSIIRILKFQDHNRSIG

SEQ ID NO: 142082 - protein, 189 aa, Glycine max
  Coding DNA Sequence Number=SeqID_50397
MPISPCGSISWSVPFRHRYDRAHKTPSGPGEVQQGPGVSNSGYGPLSVLQGARSPQQGIVPARHPADPKKSNRVLGFPALITSLCQFYGVPVTPSKVIKPPINRAFIKKYCAPRQAQGETPQQPGDGRQRAINAPPPPLEPLSSSTKAGMLPTTRGRPAGDQVQSQSKSTRSVTDKSSRVQLKTLKKRY

SEQ ID NO: 142083 - protein, 90 aa, Glycine max
  Coding DNA Sequence Number=SeqID_50398
CHHQKGGDCRSKFQDDESRLIQGVLMITKMMTKSSRECVQDWVKNTSRIKRNLNSRFKNQVSRIKFQESRIKNNQVEDSRIKKRLNQDKY

SEQ ID NO: 142084 - protein, 113 aa, Glycine max
  Coding DNA Sequence Number=SeqID_50399
KVIGPPITQAFIEKYCTPRQAQGDAPQATDAPPPPHQADPAGSLGMERYLQHLVRQQAANHRGQFGAEVAWPGDWLKAQAWQAPAGSPGAEEEACMDEEMTDLLGFLGGSGAT

SEQ ID NO: 142085 - protein, 57 aa, Glycine max
  Coding DNA Sequence Number=SeqID_50400
MTFPPKDTGIANLKCVVLPPGSSNDAIPLEATVMTIPPLDRIVEDKVFQINVFPLPP

SEQ ID NO: 142086 - protein, 89 aa, Glycine max
  Coding DNA Sequence Number=SeqID_50401
MALEWWSRMKHPIPVGVLGLWDLHLPYQEKVGPQAKLPSLRTTLLIRWILGELPSVGSTAIEFIPDGYFEALLQSAESQHELGLKELQK

SEQ ID NO: 142087 - protein, 193 aa, Glycine max
  Coding DNA Sequence Number=SeqID_50402
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=8e-24, Identity=100%"; Hit description=LacZ protein
MCPPPSSLELCFMIAYVRTLKAILHSRPFFRSPMNLLPSTFHVSPTFEIGAMFHDCLSADPQGNPPFSPFFGAPPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142088 - protein, 273 aa, Glycine max
  Coding DNA Sequence Number=SeqID_50403
VDSRGSHEEGVRDMRSWVRDQWIPFDADALSQFLGDPLVLEEGQKCEFSQRRNRTDKFDEEAIAQLLCTPGQDFTWTTAGRRVRIMRTSMTTLTQMWMTLLLSNVLPSDHNSGLPLLKCQLVHPLDPDKYNRALGFPTLITGLCQSFGVPVTPSKVIRPSITQAFIEKYCTPRQAQGDTPQGVGASPPPPQAGPAGSLGMERYQQHLVRQQAANHRRQGQSSTPFVCPTPEQFAAKVAWPGDWPDAQAGEEPTGSPGRMDEPRMDEDMTDLFD

SEQ ID NO: 142089 - protein, 222 aa, Glycine max
  Coding DNA Sequence Number=SeqID_50404
MGDQEETQEQMKADMSALKEQMASMMEAMLGMKQLMEKNAATAAAVSSAAEADPTLLATTHHPPSNIVGRGRDTLGHDGSPHLGYNRAAYPYGLPPNYSPPILQEDAGHIASPVHEKEPPQQPDEVHKDPQDYARRDVEFYPPIPEGPAPGTLPQPNIAASPIVLSMEGPPPAIEERRKLDLLEERLRAVEGFGDYPFADMTDLCLVPDVVIPPKFKVPDFD

SEQ ID NO: 142090 - protein, 125 aa, Glycine max
  Coding DNA Sequence Number=SeqID_50405
MALPYGLPPNYTPLNVAYTPSENVNNSTPILIESQQPQSDHAHVSQSMGETHEIPHHNLADFEPCLGNATEGQAVGGIPLQNTLEGPQFCPQPQPFYGKMVGYTPSSFVDLVFVGERIKSGSGKR

SEQ ID NO: 142091 - protein, 71 aa, Glycine max
  Coding DNA Sequence Number=SeqID_50406
MSQPTLRREGDARANRCVFQGRKMPGVAPNVYSRKTSEKPEKTWSMNFKCERFESCIYARGRMFPMLLRIP

SEQ ID NO: 142092 - protein, 210 aa, Glycine max
  Coding DNA Sequence Number=SeqID_50407
  Pfam annotation: Domain name=G-patch; Domain location=43-82; Score =16.6; E_value=0.0019; Accession=PF01585.14; Description=G-patch domain
MPYVEAAEESLETAFQSFEVVRISSVDSFSGQACLSDAAVMMARVMLGNGYEPRMGLGKDNGGITSLINAKGNRGKYGLGYKPTQADIKRSIAGRKNGSQSSRLRQEGEGSPPCHISRSFISAGLGDEGQVVAIYEDDVPSTLDLVRPCPPDFQLGNWRVEERPDIYATSIISDDESLKGTNTGTRLSTSSKKRIKRKMKGTRMWDFPRN

SEQ ID NO: 142093 - protein, 100 aa, Glycine max
  Coding DNA Sequence Number=SeqID_50408
MPHGLFPYKSHALMPLRHFTEHLVGARLGVNSKRTGTMWHSPKRRSKYPNEKLESLGMEHLLVDDEQKRKTESKKAKKGDPRAANSSIPWGWLAQLAQAS

SEQ ID NO: 142094 - protein, 80 aa, Glycine max
  Coding DNA Sequence Number=SeqID_50409
MKDKKVAAAGVLLSETYALSEQHPLSEISARLASVENLEENLSCMHALSAPSVHPASHLSLLVITCHERLKLLLGISAEP

SEQ ID NO: 142095 - protein, 76 aa, Glycine max
  Coding DNA Sequence Number=SeqID_50410
MLMYGWLWKGLYILGYGRFLVDPNDQNLGGIDGDPVLRGTRMRATWEYVSSVEGGQLGMVDLCVICGCGESTCTIA

SEQ ID NO: 142096 - protein, 120 aa, Glycine max
  Coding DNA Sequence Number=SeqID_50411
MVMGDFISRLSFPACLHFSEENTETFSSLTSYPELRRSEFLIGGYVGARASLLSTTPPFVAMTQKLVARGDVLRLSAPLHSMTPSVIDEQRPMWPSAPFSEMSASSGGDFFKSHKLSRTT

SEQ ID NO: 142097 - protein, 182 aa, Glycine max
  Coding DNA Sequence Number=SeqID_50412
  Homolog annotation: Hit_ID=O52175; Match level="QueryCoverage=31%, HitCoverage=65%, E-value=2e-23, Identity=94%"; Hit description =Salmonella berta plasmid pBERT, complete plasmid sequence
  Subcellular localization annotation: CTP_CleavageSite=44; ConfidenceScore=5.37e-01
TTPAALNAPLQGASHSPFRLSNCWEGRSVRSLFAITPAGERGMCCKAIKLGNARVFPVTTLANWSSTAVAAALELVDPPGCRNSIAQISGGETRQDYKDTRRFPLAAPSCALLFLPFGLPVSFRCYGRVCLIPRLTLSSGPTAAPYPVTIVLSPTRKDMQKHHWQQPLVIDLEELVLKSCAG

SEQ ID NO: 142098 - protein, 164 aa, Glycine max
  Coding DNA Sequence Number=SeqID_50413
MEGLVDLAVIDAFLAFHHGKESPVVAILAKPVYPLQGHRSCVEKGKANWDQLLASMEGRLLIGSLARRKEESGFYLHAKDECHQTKASRLSSHGVSVTTTRGYSKEFARHGMRREERTESLGEATVRDNEVKTSEESDEVQALKAELERARVVQEKFKSIAIKV

SEQ ID NO: 142099 - protein, 148 aa, Glycine max
  Coding DNA Sequence Number=SeqID_50414
MAGTNSEGLCGAVTVSLSSGERKGTNHKSKRSLSQRLCETETNMLAIISKYQEELNLATAHEHKVAGEYARVCTEKEARGRVIDSLHREATMWMDRFALTLNESQELPRLLAKAKAMADAYSAPEEIHRLLNYCQHMIDLMAHIIRNR

SEQ ID NO: 142100 - protein, 75 aa, Glycine max
  Coding DNA Sequence Number=SeqID_50415
  Homolog annotation: Hit_ID=A5BEV8; Match level="QueryCoverage=69%, HitCoverage=6%, E-value=9e-07, Identity=48%"; Hit description =Putative uncharacterized protein
MLKDNNVRFRCLFMRVDALPEVIVAGRDLSLMSAVKTVFPDATNLLCRFHIDKNVKAKCKTLVAQKNAWDYVMEA

SEQ ID NO: 142101 - protein, 194 aa, Glycine max
  Coding DNA Sequence Number=SeqID_50416
MSLATLFGKLQEHEMELMRLHQHEENDIKRKRIAFRASSSFIQEESDKEDLTETKEDDDDFRLFVKRFNKFLRNKRNKRKSNINTKKKEEDSSLAPSCYESNQPWHMRSDYLVFERRIENLTRGISKKRKKRKHRSLGMKIKKKILQVIQKNKIINLGIMMKDYENGEEQKQYIDNNFSKHMACIKVYSYFSPR

SEQ ID NO: 142102 - protein, 59 aa, Glycine max
  Coding DNA Sequence Number=SeqID_50417
MGKEVLDEGLALQELNIPVLCHGAQGIDQGVPMNPKRIKVIPEWPTPPSIRKIWGFHDL

SEQ ID NO: 142103 - protein, 122 aa, Glycine max
  Coding DNA Sequence Number=SeqID_50418
  Homolog annotation: Hit_ID=A0PAV3; Match level="QueryCoverage=37%, HitCoverage=21%, E-value=5e-07, Identity=67%"; Hit description =Restriction endonuclease
  Subcellular localization annotation: CTP_CleavageSite=84; ConfidenceScore=5.09e-01
MVKVGTSYVPINVSFSPKVGPGLPGINRDTRIYLFCEHRRTSALASVAVPLRVTTTPAALNAPLQGASHSPFRLRNCWEGRSVRASSLLRQLAKGGCAARRLSWVTPVFSQSRRCKTTASEL

SEQ ID NO: 142104 - protein, 73 aa, Glycine max
  Coding DNA Sequence Number=SeqID_50419
  Subcellular localization annotation: CTP_CleavageSite=35; ConfidenceScore=5.05e-01
MLLSSNVIHIWVIVVMLVRMIRTRFFAAARVKSCPGMHRSCTIASSSGCTCIGGPPPGSGGGPRTDKRKLLAP

SEQ ID NO: 142105 - protein, 174 aa, Glycine max
  Coding DNA Sequence Number=SeqID_50420
  Pfam annotation: Domain name=G-patch; Domain location=2-43; Score =25.8; E_value=0.00015; Accession=PF01585.14; Description=G-patch domain
MMVARVMLGHGYKPGMGLGKNNGGRTGLVSTRGNRGKFGLGYKPTPADIRKNISKRKNKGQGLRSGQQAKEAPPCHISRSFVSVGLIREGQVTAICDEDSPRRSDLVQRCPHGFQLGNWRVEERPGVYTTSIISDDKSREGTNTGDPIVNFEQEASRTEDEQDEDVGLPQSWRG

SEQ ID NO: 142106 - protein, 173 aa, Glycine max
  Coding DNA Sequence Number=SeqID_50421
MMQDFEIRAYFLHHLVIMIGAIVSNDLPRESLPTNQLPLYESDHYTPRDIGVGSHFDPFGEIIYCHENEEMTVQSLGFDGSYDVYSPHGKRPRGGHDIQGMRRSIDIVHERLTFMAFPYMDAAITFHGEPVITCSQDLPGHSMPIGVRSKRTLVDFLDHVVRLFGIHASQGIL

SEQ ID NO: 142107 - protein, 77 aa, Glycine max
  Coding DNA Sequence Number=SeqID_50422
  Subcellular localization annotation: CTP_CleavageSite=16; ConfidenceScore=5.17e-01
MKGNQQGVSHVESPTVATYPSAGGRRVTRGMRVPRKEYARSRHQRLFEENVGKTGKDAIYELLSERFGSCIYARGRY

SEQ ID NO: 142108 - protein, 66 aa, Glycine max
  Coding DNA Sequence Number=SeqID_50423
MKYGSKLFGWRTHERKRNSWGSDKRREWRIALEGPHKSIMKHSSKLFGWRMHERKRNSRGSESGIL

SEQ ID NO: 142109 - protein, 180 aa, Glycine max
  Coding DNA Sequence Number=SeqID_50424
MTSQHINSGRYTIFNSKLIEHISDDTDDKLDITQGDIVTDYSLDDITEDFADTDYDGNLDAPYDNENTGFYIHCPNYVVLSFITFDNVHSLNFCIYMLVQVTRILEIQFGNASNVKRICGMMRGLTKINIQKTQSFHYVVVMEKYNGQYYMMLRNPCGNYSLTAETHKQRNSSKTYVYTT

SEQ ID NO: 142110 - protein, 51 aa, Glycine max
  Coding DNA Sequence Number=SeqID_50425
MEMFWTRYGSASENEGGACHPARPGVRGCFLQKAHPGRPKWAWLLFAPPIY

SEQ ID NO: 142111 - protein, 149 aa, Glycine max
  Coding DNA Sequence Number=SeqID_50426
  Subcellular localization annotation: CTP_CleavageSite=28; ConfidenceScore=5.24e-01
MVKVGTSYVPINVSFSQKLADSGYSRVRAAALRGVSWFLSAVLPVQLLTELVIRVTIRHTSIHAGHSAASVAGVQTLQLTHHPPVNCVPLRAAHSPFGAQLFGKGPIGAGPLAINDRQRGEGRRSLRNWVTLAECFPYWLLCWQLRGCQ

SEQ ID NO: 142112 - protein, 80 aa, Glycine max
  Coding DNA Sequence Number=SeqID_50427
MTIICLCVPSDTTVSEWQKVCEMTIICLRVPSDTTMSEWKKVCGMTIICLCVPSGPPPLDDKRVQNDHNLSLRAIGHDCV

SEQ ID NO: 142113 - protein, 272 aa, Glycine max
  Coding DNA Sequence Number=SeqID_50428
  Gene Ontology: Mol. function=unspecific monooxygenase activity
  Homolog annotation: Hit_ID=Q9AVH2; Match level="QueryCoverage=71%, HitCoverage=99%, E-value=2e-52, Identity=46%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCGNFSDTSSFKFRRTKGSIGHAFTMCRPSQTPHLTMSSARIDRPKPTLGPKKRGSAPLPIHGITPTYPTPLKSFHKVGLESSSTGSSFPADSAKPVPLAVVSLDSRQGQWES

SEQ ID NO: 142114 - protein, 78 aa, Glycine max
  Coding DNA Sequence Number=SeqID_50429
MSKSCGFGMTGPLDESISCFLIRVDLWVLVPITFRGLHVLALRGLHVFTFVGLHALTFRGLHVLANRGLHALTLRGLH

SEQ ID NO: 142115 - protein, 122 aa, Glycine max
  Coding DNA Sequence Number=SeqID_50430
MASRKRARIDDIPSSSIPGPQSAAIGPDPEAQLPLVRPNEAASPEPAPARVEPMPAESRSPVVNPPPSPELQVVPPSPPLIIISDASSDETATPPDSPAGETTDPPDSQMKELPIFLIRHLE

SEQ ID NO: 142116 - protein, 130 aa, Glycine max
  Coding DNA Sequence Number=SeqID_50431
  Subcellular localization annotation: CTP_CleavageSite=36; ConfidenceScore=5.00e-01
MVICALSGDVSLVFRWRPFQVSQVIQNSAERRIQARASLLSTTPPFVAPMIAAAEIPYETKFGHSAPMIRGDTLWLFAPFCHPEAAWPDDKQRPKTKFGHSAPMIRGDTLWLFAPFCHPEAAGPMTSRDQ

SEQ ID NO: 142117 - protein, 107 aa, Glycine max
  Coding DNA Sequence Number=SeqID_50432
MTRGNPSDLQPFDPEIDRTFHRLVRHHFIPFDHSEHSITGESVHSVIGDFEHPDLEHYNFEHSDSEHSDFAHSENMAQPPPRERTLREMAAPDFTYESLCIQYPDED

SEQ ID NO: 142118 - protein, 172 aa, Glycine max
  Coding DNA Sequence Number=SeqID_50433
MTRGDTLRLSAPLCHLEAAGPMTCGDTLRLSAPLCHPEAAGPMTRGDTLRLSAPFCHPEAAGPMTRRDKIWSFCTLVSSKGGGADDTRRYLTVIRTLVSSRGGGPDDTRRYLTVIRILVSSRGGGPDDTRRYLTVIRTLFSSRGGGPDDTQRQNLVILHPCVIQRRRARWAR

SEQ ID NO: 142119 - protein, 93 aa, Glycine max
  Coding DNA Sequence Number=SeqID_50434
  Subcellular localization annotation: CTP_CleavageSite=38; ConfidenceScore=5.06e-01
MVKVGTSYVPINVSFSPKVGPGLPAVPPVQLLTGWCVTAKAPPDISAGKCSGCATVGKGDRCGPLRYYAAGERGMCCKAIKLGNARVFPVTTL

SEQ ID NO: 142120 - protein, 149 aa, Glycine max
  Coding DNA Sequence Number=SeqID_50435
MSNHKSTELTLKNLEVQVRQLAKQIANKSSNNFVANTEQNPKEECKDVMTRSKRFVEAEDEDSVVHKKETADKKGNDCKKNEVRGESNQEKEEQIMVKNKKLKDQEKEKEVEKEIENGKNEKEEKNNRNAKKSRSEKAVDEDVEVPYPV

SEQ ID NO: 142121 - protein, 368 aa, Glycine max
  Coding DNA Sequence Number=SeqID_50436
  Homolog annotation: Hit_ID=Q6WAY4; Match level="QueryCoverage=85%, HitCoverage=57%, E-value=2e-14, Identity=26%"; Hit description =Putative uncharacterized protein
MASQENKESPVVAILADLFDTFDRRCEKNSARIVCCLPALCVWLVSHLFQQDTRHPCPLQSYRSCAEKGRVDWDQHLAGIGGSAINWFPRWKEGKEGVLFSSGDYPNVPLLGTRGCINYNPTLAIGQLGYPMRGAPTEESLSPLLVRDLGAQSLKVIHRVHKAWRSPLRKDKELRGIRNGVIGGYHGWLRVHTRGLDWLSKLKVIDEENFEAPEEDEEVRALKLELGKARLAKEKFKSAVTHIRKECTELQKENAATARALEQETKRAHKEEHGREKFRGALWGSNNELKLRREERDRSRVHGMILKEELAACARSKRSLAQHLEATEQSMLAIIGQYKGDLNQSVTHEQKLVEDFAQVYAEKEARGR

SEQ ID NO: 142122 - protein, 76 aa, Glycine max
  Coding DNA Sequence Number=SeqID_50437
MAAEWRRKRERRRHFKEKMSLEEAHHHRRPWIRAWRKKEMNEGRGREEHEILCSKRDLKSETTNPRSIPRFSTKCA

SEQ ID NO: 142123 - protein, 350 aa, Glycine max
  Coding DNA Sequence Number=SeqID_50438
  Homolog annotation: Hit_ID=Q6WAY6; Match level="QueryCoverage=93%, HitCoverage=59%, E-value=2e-39, Identity=32%"; Hit description =Putative uncharacterized protein
RLMEPLQMQAFRKTYGKILELTIAEVSIEAIASLTQYYDQPLRCFTFEDFQLVPTIEEFEEILGCPVGGRKPYLFSGCLPSLSRIATVVKDSARGLDCVKQTRNGIVGLPRKYLEDKARDMENQEDWVPFMDVLALLIFGVVLFPNVDGLVDLAAIDAFLAYRHSKESPAIAVLADLFDTFDRRCEKSSARIICCLPALCVWVGFTPVPARHEASMSAPKPSLEGKEGVLFSCGGYPNIPLIGTRGCINYNPVLAIRQLGYPMRGAPMEESMSPFLVRDFGAQNFKAIQRIHKAWETPLRKYQELRGIRNGIIGGYHEWLKVHIRGLDWLAKLKFVSEDSFEAPEEDEEV

SEQ ID NO: 142124 - protein, 210 aa, Glycine max
  Coding DNA Sequence Number=SeqID_50439
MGQACVFPLKKHLMKLITWETSLDKILMQVDFLDFNKANLTNSIINGELTLVSLTNHKSTESAIKNLEVQVGQLAKQLAEKSSSTFGANTKHNPKEECKAVMARGRKLVIEPAPELVQPFCELIEEEEEEEEDEQMRETPIILSEKEINEKEKEEENKKMRKMKKKRREKKRREKARVSVLERKRKKHLQVKGEKYHILWYLLGKTKKDI

SEQ ID NO: 142125 - protein, 43 aa, Glycine max
  Coding DNA Sequence Number=SeqID_50440
MACTHIPVEAKMLFAAKFISWLVFWFVLKVVFVIGSAIDRLCG

SEQ ID NO: 142126 - protein, 285 aa, Glycine max
  Coding DNA Sequence Number=SeqID_50441
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGIRCLRADGTLPRSFAGSEPGDRHRAERVLNSDQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142127 - protein, 145 aa, Glycine max
  Coding DNA Sequence Number=SeqID_50442
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
  Subcellular localization annotation: CTP_CleavageSite=39; ConfidenceScore=5.58e-01
MTIPGLRSSKASGKSSVSTKASNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142128 - protein, 67 aa, Glycine max
  Coding DNA Sequence Number=SeqID_50443
EEYLYLGACHSVWNSLETRVDHHGGEVAYARQGDLDTYYLVFLSESVVWTRLGYFLGDGTILHLRVE

SEQ ID NO: 142129 - protein, 89 aa, Glycine max
  Coding DNA Sequence Number=SeqID_50444
MNHFFRKVPERGFSGVFRKKGSSGRRLVTSGNFPENVLSELPEEPLTGLPEEPLTGLPEDFSVSLFRHFFRRTLVFSPLVFYPRFRLLP

SEQ ID NO: 142130 - protein, 172 aa, Glycine max
  Coding DNA Sequence Number=SeqID_50445
  Gene Ontology: Biological process=transposition, DNA-mediated
  Homolog annotation: Hit_ID=Q1J7G7; Match level="QueryCoverage=19%, HitCoverage=47%, E-value=9e-12, Identity=100%"; Hit description =Transposase
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMQRGKSFLPTRLLDSVHSGGQM

SEQ ID NO: 142131 - protein, 52 aa, Glycine max
  Coding DNA Sequence Number=SeqID_50446
MFAYRNLLNNLNIGAYQPSFECPFAKRLLLAKRIITHALSHEFKRLAHHPGT

SEQ ID NO: 142132 - protein, 133 aa, Glycine max
  Coding DNA Sequence Number=SeqID_50447
MDRARLVYGLVTNMDMNIGALISGQISSIAQSNSARLGSLALITALCRARGVTSNSLTYESLSPAINLAYIKKNCWNMDDLTVNFRGARKARVRPADVPSSSTLPAPSTSATPTPAPLGSSTQDSQRFEAMLQ

SEQ ID NO: 142133 - protein, 196 aa, Glycine max
  Coding DNA Sequence Number=SeqID_50448
MAKFDPEIVLEFYANAWPTEEGVRDMRSWVRGQWISFDADAIGQLLGYPLVLEEGQECEYGQRRNRSDGFDGEAIAHLLCISGQDFGRTAAGRRVRIMRTNMTTLTQIWMTLLLNNIQHNDHNSDLPLPKCQLVYAILTRMSIHVAQLIANAIYIFAGMAPTRHPLDPDKSNRALGFPALIPGLCQSFGVPVAPSK

SEQ ID NO: 142134 - protein, 170 aa, Glycine max
  Coding DNA Sequence Number=SeqID_50449
  Homolog annotation: Hit_ID=UPI00016621D1; Match level="QueryCoverage =85%, HitCoverage=38%, E-value=1e-09, Identity=31%"; Hit description =UPI00016621D1 related cluster
MTGPLNESISCFLIRVDPWVLEPIAFRGLHVLTFRGLHALTIRGLHVLAFRGLHALTIRGLHVLTFRGLHALTIRGLHVHANRGLHALTFRGLHVLAIKGLHVLIFRELHVLVFRGLLTLAFKGLHILAIKGRHVLNFRGLHALAFRGLCVLTFSGLHIHTLREFKVLCP

SEQ ID NO: 142135 - protein, 195 aa, Glycine max
  Coding DNA Sequence Number=SeqID_50450
  Homolog annotation: Hit_ID=A5BEV8; Match level="QueryCoverage=93%, HitCoverage=24%, E-value=2e-17, Identity=33%"; Hit description =Putative uncharacterized protein
MVSRYALNHIVVEFKCVHYAGKNPSTCGCVMRITHSLPYAWELSKYVVGCIPLDSIHMFWRRLSFSDQGLSEPEVSIKEEMETICKRFEELDVCVRRSASSSDQPNPRRIMPMLDQFQPFMQDFIDNIVDVKPDGNYGYQSVASLLGVGEDSWSLAHNHLLKELDKFSNDYIKLFGGTNKFEELRMSLLVDGLTK

SEQ ID NO: 142136 - protein, 203 aa, Glycine max
  Coding DNA Sequence Number=SeqID_50451
MTPLTQMWMTLLLSNVLPSDHNSDLPLPKRQLVYAILTRMSVHVAQLIADAIYLFAGMPPTRHPLDPDKSNRALGFPALIMGLCQSYLAADAPPLPHQVDPAGSFGMERYLQHLVCQQAANHRGQVQTHECLNQLSLSLQSQGFAPFACPTPDQFRAEVAWPGDWPEAQAGEAPAEAPGDVEEARMDEKMTDLLGFLGGSGAT

SEQ ID NO: 142137 - protein, 266 aa, Glycine max
  Coding DNA Sequence Number=SeqID_50452
STLEDPTLVRDFRAQSFKIIQRVHKAWESPLRKDKELRGIRNGIIGGYHEWLKVRTRWLDWLSKLKIINEENIEAPEEDEEVRALKTELGKARHAKEKIKLVATDVRKECVELREENAATARALEQETKRARKEEHGRDKFCGALWGSNSPKESCLSVYARQKTNMFAIVSKYQEELNLATAHEHKVADEYARVYAEKEARGRVIDSLHQEATMWMDRFALTLNGSQELPRLLAKAKAMADTYSAPEEIHRLLNYCIPIAPDPNLG

SEQ ID NO: 142138 - protein, 131 aa, Glycine max
  Coding DNA Sequence Number=SeqID_50453
  Homolog annotation: Hit_ID=UPI00016621D1; Match level="QueryCoverage =97%, HitCoverage=39%, E-value=6e-10, Identity=31%"; Hit description =UPI00016621D1 related cluster
DGPLGTSTLTFVGLHALTFKGLHALAFRGLHVLTFRGLHALVFRGLNILTFRGLHALAFRGLHILAFRALHVLAIRGLHALAFRGIHALAFRGQDVLAFRGLDVLAFRGLHTLPFRGLHFLAYRGLQALAF

SEQ ID NO: 142139 - protein, 151 aa, Glycine max
  Coding DNA Sequence Number=SeqID_50454
  Subcellular localization annotation: CTP_CleavageSite=48; ConfidenceScore=5.09e-01
MVKVGTSYVPINVSFSPKVGPGLPGELINRGAPGAPVASVSISCPSCSATEIRGGIASNSAHKLPPDIKVAKGGVYRLTMLALITQGVSVKCFMWQEKKGCTGASRICDTTHYSGLPRTELHRSVMRRAEMAYPTGAGIRPGRPKGSLQGS

SEQ ID NO: 142140 - protein, 140 aa, Glycine max
  Coding DNA Sequence Number=SeqID_50455
MTPVNRKAGTGERTREPPGGNAWGAEPMEKRLCRGPCSSLNSAPLGISHCSRASPHRRPSGSELTLSDWEHPGVISANIVIASMQHIRPLAPAGVIRERPALDRPRVGRFINAVAQPDMVSEWKARPVAQAQLSAAGVVS

SEQ ID NO: 142141 - protein, 30 aa, Glycine max
  Coding DNA Sequence Number=SeqID_50456
WHHPNLCSMYQTFRLVRFTSSGIRALALDI

SEQ ID NO: 142142 - protein, 98 aa, Glycine max
  Coding DNA Sequence Number=SeqID_50457
  Subcellular localization annotation: CTP_CleavageSite=40; ConfidenceScore=5.21e-01
MAPPLTSSPLSSAASPWWKITIKGPHGSSKIQPPQKPHKQASIKGVPTNFERIKVIPKWPTPPSVKGRSPGFQEPLDLRSNPFQGGGNDAIVPPKDIG

SEQ ID NO: 142143 - protein, 144 aa, Glycine max
  Coding DNA Sequence Number=SeqID_50458
MAAQLIHDRVVMECLEGVWETLKGNERCRFRGTIRLTATSLVHPEEPTRTLQQPVEWILPTPTPYRLVEPVQVIEVSSSKEDLEEDPEELPPELDMDALDLPEDDEDPLPDVDSPEDIMSASEADSTEESGPGGTVNSDDSSSS

SEQ ID NO: 142144 - protein, 59 aa, Glycine max
  Coding DNA Sequence Number=SeqID_50459
MEFLELKQGNMTMAEYAAKFEELVRYFPIIKGEMVKVPNKGGIFREIVHIPKRSRMVEV

SEQ ID NO: 142145 - protein, 195 aa, Glycine max
  Coding DNA Sequence Number=SeqID_50460
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=26%, HitCoverage=50%, E-value=8e-24, Identity=100%"; Hit description=LacZ protein
  Subcellular localization annotation: CTP_CleavageSite=18; ConfidenceScore=5.00e-01
MEKRLCRGPLTSLLSIFLASSRKSPPVRKPFPLAAVERPSVASHWHDRFPDWKAGSERNAINVNLVERQARSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142146 - protein, 119 aa, Glycine max
  Coding DNA Sequence Number=SeqID_50461
  Subcellular localization annotation: CTP_CleavageSite=25; ConfidenceScore=5.31e-01
MLLSSNVIYVRVVMLVRMIRTRLFAAARVKSCPSMHSSSVIASLSSCARTVGPPPISGGGPGTVKRKLLARECSPMMARTCNPLKVRTCSPLKVRACSPTKVKAHDLLTARTCSPLKLK

SEQ ID NO: 142147 - protein, 94 aa, Glycine max
  Coding DNA Sequence Number=SeqID_50462
MKADLSALKDQMTSIPEAMLKLQKTIEDNATAAASNTAREAKPVLQPAINLGRDRNVTGFNRRLHSPYRSRRFEPSPYLRGAAPSSCRLSSTRR

SEQ ID NO: 142148 - protein, 155 aa, Glycine max
  Coding DNA Sequence Number=SeqID_50463
  Gene Ontology: Mol. function=aspartic-type endopeptidase activity; Biological process=RNA-dependent DNA replication
  Homolog annotation: Hit_ID=A5C120; Match level="QueryCoverage=54%, HitCoverage=10%, E-value=3e-16, Identity=51%"; Hit description =Putative uncharacterized protein
MKVMSSKPTRTGRKWKSKLQPRGDGHFQALERINDNAYKIDIPGDDSEHLRINAFQEGGNDENPKSVQIQGPMTKSRTKQLVDTLQQMIADKLNKAQTYQGNPCGVYPDLSSFTGSGVYPDLSSFIGSGVYPDLSSFTGSGVIHTFVACIKRSAS

SEQ ID NO: 142149 - protein, 126 aa, Glycine max
  Coding DNA Sequence Number=SeqID_50464
MDPEKSNMALGFPVLITDLCQFYEVLVSPTKLIWPLINRSFIEKYYMPRQAQQLGQDQQQLAMHAYMQDLADQQAANHRGQVQLNNNFYQYTLHQQHQDPNPYPWPTPKQFGAIIAWPGDRPNFQG

SEQ ID NO: 142150 - protein, 102 aa, Glycine max
  Coding DNA Sequence Number=SeqID_50465
MVSRNALNEIAAEVERLRYLSNDPSSCGCVMSVEASFMMPKRMSSRLGQEHFKNREKDSRIKFQESRIKNNQDQDSRLKIQELRKDSLKISTKKFFKTLSST

SEQ ID NO: 142151 - protein, 178 aa, Glycine max
  Coding DNA Sequence Number=SeqID_50466
MGNHPRPKFNAGGYSGFQHGHQYNQQQGQWRTHLDNQFNKDKGGPLNKPQQQGASLYDRTTKLEKTLAQFMQVSISNQKSIESAIKNLEVQVGQLAKQLADRPSSSFGANTEKNPKEECKAVMTRSKMVSKNEGEKRIGEEKQQLVTEPEIDPGVEPLSEIEEEVEAEDDQQKEIPII

SEQ ID NO: 142152 - protein, 139 aa, Glycine max
  Coding DNA Sequence Number=SeqID_50467
  Homolog annotation: Hit_ID=Q6UUU1; Match level="QueryCoverage=43%, HitCoverage=40%, E-value=1e-18, Identity=78%"; Hit description =Putative uncharacterized protein
ETTSCPSSSGSEDEVRGEESSEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142153 - protein, 49 aa, Glycine max
  Coding DNA Sequence Number=SeqID_50468
  Subcellular localization annotation: CTP_CleavageSite=43; ConfidenceScore=5.24e-01
MAPSSNASVQPPRLTAHRRRTAGKSGCPAAAARRTGRRWRSARQAADRS

SEQ ID NO: 142154 - protein, 143 aa, Glycine max
  Coding DNA Sequence Number=SeqID_50469
  Homolog annotation: Hit_ID=Q6UUU1; Match level="QueryCoverage=59%, HitCoverage=57%, E-value=4e-24, Identity=67%"; Hit description =Putative uncharacterized protein
MLALMRVSVRCFMWHEKKGCTGASAEYVIQDIFRFLLTDSLRSVAQLRRAQMAYERGGHFLENAMKILNREVRGPRQSRFSLGSAPLTSITKSDAQISGGETRLDYKDTKRFPLAAPSCALLFLPFGLRCHSAVMAAFVSFHP

SEQ ID NO: 142155 - protein, 74 aa, Glycine max
  Coding DNA Sequence Number=SeqID_50470
MGSKIYPQIHENRRAFFSSSSPILLEPPAHGSGDWSLHREDYIKLHQGKCRSKLHDDESSMIQVVLMMTKSPKE

SEQ ID NO: 142156 - protein, 141 aa, Glycine max
  Coding DNA Sequence Number=SeqID_50471
STRVAESILWTQISDRHLLGRCRARLALLWRLNSVKEGVVAMDDQGERSEYRAHFDASVIDQHLQEVRTAVSARRDEELNTSDGRLLLSNIFPDAGRAARDVFMGSGAHAGKSPEIQPGAAPAVPTGPGKLSSAIAKAVSE

SEQ ID NO: 142157 - protein, 107 aa, Glycine max
  Coding DNA Sequence Number=SeqID_50472
PRGAQAIKIIGRSAWDVCKLLALFAPHASFGVETTDPFMMFSHDVVCLLTGFVLVWWQYPPNYEVLVWGHPVWVLLFSRHNFLSIYGGSLERLLDDSHEVLGLLGVD

SEQ ID NO: 142158 - protein, 62 aa, Glycine max
  Coding DNA Sequence Number=SeqID_50473
MGVQIATKPTWAFLNTVASGGSNLARLGELGDKLLPYFPINRGRSEGKKCLALLKIQAEALL

SEQ ID NO: 142159 - protein, 103 aa, Glycine max
  Coding DNA Sequence Number=SeqID_50474
  Subcellular localization annotation: CTP_CleavageSite=55; ConfidenceScore=5.26e-01
MSPPPIEPHNHSQTHLNLSGRLPLQAPFSTSGLDGAYAFSATLDRLARISEFRLSARLLAQRMDSSGALSGMSPHSVNTHSSSFFQILPRAQPKEWCAQRMAR

SEQ ID NO: 142160 - protein, 104 aa, Glycine max
  Coding DNA Sequence Number=SeqID_50475
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=P56778; Match level="QueryCoverage=67%, HitCoverage=15%, E-value=9e-36, Identity=100%"; Hit description =Photosystem II 44 kDa reaction center protein precursor
MRFWDLRAPWLEPLRGPNGLDLSRLKKDIQPWQERRSAEYMTHAPLGSLNSVGGVATEINAVNYVSPRSWPFMARGEELAQLPQDLKKELIEILNQFFSMTPLN

SEQ ID NO: 142161 - protein, 313 aa, Glycine max
  Coding DNA Sequence Number=SeqID_50476
  Gene Ontology: Mol. function=transporter activity; Cellular component= membrane; Biological process=transport
  Homolog annotation: Hit_ID=A3FEM5; Match level="QueryCoverage=96%, HitCoverage=57%, E-value=9e-64, Identity=44%"; Hit description=PseA
  Pfam annotation: Domain name=OEP; Domain location=109-294; Score =121.9; E_value=1.8e-33; Accession=PF02321.9; Description=Outer membrane efflux protein
LSLAAEVANNYVNYRACQASVQALKQAYDSRSETARLTGISANAGFSAPSDLALAEAATRASESTLDGQQAECDGLVKALVELTNLPEPELHNLLAKGHGMPEPAMFDVSAMPANLLTRRPDLAVDERNLAEASANIGVSKAQMYPSLTLTGSIGYRRTNFNGAVTRTDSWSYGPSLKLPIFDGGTLRADLAEARANFDSLLATYKQDVRKAVKEVEQALVNLDSATRRAQSEQASAQQYQQYFKAAEINWKSGGLDLLSLEDARRQKINAELNVITQQKNRVLQWIALYKAFGGDWQETQQTVKPPLKPMEK

SEQ ID NO: 142162 - protein, 57 aa, Glycine max
  Coding DNA Sequence Number=SeqID_50477
MGLPGLKEHSNPVTPKAYTLKSPLEPLPPDSGPTPKIILHADTAHELYNTHDLTLVF

SEQ ID NO: 142163 - protein, 97 aa, Glycine max
  Coding DNA Sequence Number=SeqID_50478
MGISLLLLVSTRSEPPIACAYGSGIIELSPSQAYLNPLARKYQICETRGHIGRACLILIKHRPWIPLVGLNSTRAALRQTYKQLGYHTPIPRDNTIN

SEQ ID NO: 142164 - protein, 83 aa, Glycine max
  Coding DNA Sequence Number=SeqID_50479
  Gene Ontology: Mol. function=RNA-directed DNA polymerase activity
  Homolog annotation: Hit_ID=Q2HSQ4; Match level="QueryCoverage=87%, HitCoverage=77%, E-value=1e-15, Identity=55%"; Hit description=RNA -directed DNA polymerase ; Zinc finger, CCHC-type; Peptidase aspartic, catalytic, putative
MARFLSGLNSDIHDVVELQEFVEMEDLLHKTIRVEQQLKRKGVAKRSSTNYGSSSWKDKSKGASTSNAAPIPSKTPPKFQEQS

SEQ ID NO: 142165 - protein, 43 aa, Glycine max
  Coding DNA Sequence Number=SeqID_50480
MGAKYLEVVKRKLHATKEWSPDKIRDCSWNFGGVFDGIGAALE

SEQ ID NO: 142166 - protein, 34 aa, Glycine max
  Coding DNA Sequence Number=SeqID_50481
MANQQATKPKAKAQDVNEALLGGNLVPFKFLLVI

SEQ ID NO: 142167 - protein, 114 aa, Glycine max
  Coding DNA Sequence Number=SeqID_50482
MDNEEGVQEQMKADMSALKDQMASITEAMLKIQKSIEDNATVAASNTAREAEPVLRPAINLGRNRNATGFNRRYSPQAYPYGLPPDFSPRTAPDDLSQAPTFEGQLPPGANYPQ

SEQ ID NO: 142168 - protein, 124 aa, Glycine max
  Coding DNA Sequence Number=SeqID_50483
TTKLEETLAQFMQVTMSNHKSTELALKNLEIHVGQLAKQLAEKSSNNFGENNEKNPKEECKVFVTRSRKLVVAEDDDVVALKEQVALKDTTVKKKNKVTDAMIQRREKQIMVEEKEIKDQEREI

SEQ ID NO: 142169 - protein, 150 aa, Glycine max
  Coding DNA Sequence Number=SeqID_50484
  Gene Ontology: Mol. function=oxidoreductase activity, acting on sulfur group of donors, disulfide as acceptor; Cellular component =cytosol; Biological process=protein metabolic process
  Homolog annotation: Hit_ID=A1G1R2; Match level="QueryCoverage=99%, HitCoverage=60%, E-value=2e-76, Identity=93%"; Hit description =Peptide methionine sulfoxide reductase precursor
  Pfam annotation: Domain name=PMSR; Domain location=1-124; Score =108.4; E_value=2.2e-29; Accession=PF01625.12; Description=Peptide methionine sulfoxide reductase
GADARYERVSSGRTGHAEAVKIDYDPRQVSYGQLMQVFFSVVHDPTQLNRQGPDHGSQYRSAIFTDDARQQAASRAYIAQLGQTGSYRAPIVTQLVSGQHFYPAESYHQNYMTNYPQAAYIRYYDAPKLAALGKQFPALYRRDAALVPMR

SEQ ID NO: 142170 - protein, 209 aa, Glycine max
  Coding DNA Sequence Number=SeqID_50485
GLHVLTFGGVLILAFRGLHVLTFRGLHALTFRGLHVLAFRGLHALALPSEDYTSSALEGYTSFLFSVPGPPFDLGGGPTVRAQPEEEAITQLLCIHGQDFTRAAAKRRQHSAHVEVSVGLCRHDIGIVPIRHPVDLEESNKTLGFPALVTGLCQSYRMLVPPSKVMPSDIGIAPARHPVDLEKSNRVLGFPALIMDLFQFYRVPVAPSK

SEQ ID NO: 142171 - protein, 319 aa, Glycine max
  Coding DNA Sequence Number=SeqID_50486
  Homolog annotation: Hit_ID=Q6WAY4; Match level="QueryCoverage=61%, HitCoverage=34%, E-value=8e-23, Identity=35%"; Hit description =Putative uncharacterized protein
MGINQNGKWFYQVKVKGLDVTSLKELGRLMGPLQRQAFRKVYGKILDLAAAEVFTEAVVSLAQYYDQPLRCFTFGDFQMVPTIEEFEEILGCPLGGRKPYLFSGFLPSLSKIAAVIGDSAKELDRMKQIRNGVVGLPRKYLEGMARDMASQEKWGPFADILALLIFGVVLFPNVDGLVDLAAIDAFLAYHHSKESPVVAILADLFDTFDWRWTRGCINYNPALAIRKLGYPMRGAPTEESLSPFLVRDLGAQGLKVIQRIHKAWRSPLKKDKELRGIRNGVIGGYHGWLRILAQGLDWLSKLKVINEENFEAPVEEEEV

SEQ ID NO: 142172 - protein, 234 aa, Glycine max
  Coding DNA Sequence Number=SeqID_50487
HALRCPYRTRARARVMGEAEEVQEKMKAEMEAVKEQMATMMEAMMSMKKIMEANAVIVAATSAVAKEVRMSGGCANSKQARLPAIWLASQTIHHPMWRTFSMKISITPLSYSLRANNLNLIMHMSLNPWRRHMELPHHNLADFEPCLGYATEGQAVGGIPLQNTLEGPQYHPQPQPSHSTVVKNPHAMAEMGKRKGSGLLKEVLDFDKYKGTTFPKNHPKMYCRKIRAYAKMRN

SEQ ID NO: 142173 - protein, 78 aa, Glycine max
  Coding DNA Sequence Number=SeqID_50488
HLLVVERAVQNEFWMFASRSQRGWWVYARIVDVENLLCTIARPPPSTTCDGVKLPAFIVDHRVVPGDMSRGSGDLGDV

SEQ ID NO: 142174 - protein, 225 aa, Glycine max
  Coding DNA Sequence Number=SeqID_50489
LGYPMRGVPSDESITPFIARGFREDNARDRELRGSRNGIIGGYHKWLRVRTQGLDWLPNLKTVRDDEVKALEESDEVQALKAELERARAEALERETKKARKEEHDQASFEGLYRAAIVSSRSEEVKGIITGQGMILKDELKVCLRSKRNLSQQLSETEGNMWAIIDECKEKLNLAATHEQRLEDEYAKISAEREARERVIDSLHQEATMRMDRFALTLNRSQELP

SEQ ID NO: 142175 - protein, 60 aa, Glycine max
  Coding DNA Sequence Number=SeqID_50490
MMQSYPAKALDRRLQEDWARDAREDPRVLISLRVDFGPIGKVRYPRNVGFFSPCILGHLD

SEQ ID NO: 142176 - protein, 144 aa, Glycine max
  Coding DNA Sequence Number=SeqID_50491
MYPPLFSLNLVDVPSTRIDPQEMYPLLFSVKPKEREESKEFSDCVVLNSLTREKGYTKEFRRLVLCSFGKGRRETQKEFRRLVLGEFFLAEGEENGKMNSTSFQGLENQKTLESFWYKEEEEVQRDSRLVKDCKRLIGKVFKII

SEQ ID NO: 142177 - protein, 79 aa, Glycine max
  Coding DNA Sequence Number=SeqID_50492
MTWIWHGELIDMQRDSQSEPVDVQMGDRLEEMIHDLGHESFHLVNVKAKYGWSDKSFTSLLQVVQDMLLEENTLPKSYC

SEQ ID NO: 142178 - protein, 45 aa, Glycine max
  Coding DNA Sequence Number=SeqID_50493
MYLILELISSNSSDTPSRERKRENLKEPKQGNSFMTMAGVCNITD

SEQ ID NO: 142179 - protein, 45 aa, Glycine max
  Coding DNA Sequence Number=SeqID_50494
MALKKLSMKRSRRDAAAKGTNAAPEFDSHRFRSAEHQQRFEAIKG

SEQ ID NO: 142180 - protein, 57 aa, Glycine max
  Coding DNA Sequence Number=SeqID_50495
MRVVLIPQGTIPTLTLNTFLAWSTHLSQPTLRREGDARLAGASSKEGKHAESPPTFI

SEQ ID NO: 142181 - protein, 165 aa, Glycine max
  Coding DNA Sequence Number=SeqID_50496
MMDQGRLEVGNEGREEQHICMQSTDERSFGRPKPLVIYFTKGAASQKPQYPSAAKPVPFPYQNSHAVPWRYTPPNKREEEATDIISLSAKVTNITGLSGVTRSGRVFALPNLPIQPANVKGNDASSIGACRPRIFFINGFLCFLEDKWQRNGEGRERGDATSRRR

SEQ ID NO: 142182 - protein, 113 aa, Glycine max
  Coding DNA Sequence Number=SeqID_50497
  Gene Ontology: Mol. function=catalytic activity; Cellular component =chromatin; Biological process=auxin mediated signaling pathway
  Homolog annotation: Hit_ID=P33080; Match level="QueryCoverage=81%, HitCoverage=100%, E-value=4e-47, Identity=100%"; Hit description =Auxin-induced protein X10A
  Pfam annotation: Domain name=Auxin_inducible; Domain location=1-90; Score=195.6; E_value=1.3e-55; Accession=PF02519.5; Description=Auxin responsive protein
MGFRLPGIRKTSIAANQASSKSVEVPKGYLVVYVGDKMRRFLIPVSYLNQPSFQDLLNQAEEEFGYDHPMGGLTIPCKEDEFLTVTSHLNDLDFYFLLKLKPVSLMRINAAQD

SEQ ID NO: 142183 - protein, 20 aa, Glycine max
  Coding DNA Sequence Number=SeqID_50498
MNSLSKNVVLSKFINTHWRT

SEQ ID NO: 142184 - protein, 24 aa, Glycine max
  Coding DNA Sequence Number=SeqID_50499
MVVRMRAHTAYLRQITKQTEKNAM

SEQ ID NO: 142185 - protein, 211 aa, Glycine max
  Coding DNA Sequence Number=SeqID_50500
MSVLELYVEKDVAGGSMFHSTNSVTSCGHNLSLNESELPRNISNLHDDEDDDDDYLASNSYVEESLNEDDSVDGIFDTDDEVTDIIEPVSIVHPTEGAQGIQNPFWNDALHYNNINWSHPEEDICGLEMPSTFNVGQELYVGMDFDSKDVVKNALKQYVMKVHQSFKVVETKSHKYIVCCPNNSAESPCPFYMREILSKKIDAWKVTQWGV

SEQ ID NO: 142186 - protein, 93 aa, Glycine max
  Coding DNA Sequence Number=SeqID_50501
MNSKRKGEKEMSEWIVIIKKGEIVEAMTSKIILTMPKNQEFSKFQRIKIQEQSSFKIQSSFKNQDSRTIKIKIQESREDSIKISTKKVFQNIE

SEQ ID NO: 142187 - protein, 192 aa, Glycine max
  Coding DNA Sequence Number=SeqID_50502
MIRGDTLRLSAPLCYLDTVVVRWHAETKFGHSAHMIRGDTLRLSAPLCYLDTVVVRWHAETKFGHSAHMIRGDTLRLSAPLCYLDTVVVRWHAETKFGHSAHMIRGDTLRLSAPLCYLDTVVVRWHAETKFGHSAHMIRGDTLRLSAPLCYLDTVVVRWHAETKFGHSAPMIRGDTLWLFAPILLLSVRQNA

SEQ ID NO: 142188 - protein, 51 aa, Glycine max
  Coding DNA Sequence Number=SeqID_50503
MFLVFNSALKGLDDTPQPKSKAVARWIVVKTIGSREIEGASHPVGTVLSKS

SEQ ID NO: 142189 - protein, 355 aa, Glycine max
  Coding DNA Sequence Number=SeqID_50504
  Homolog annotation: Hit_ID=Q6WAY6; Match level="QueryCoverage=92%, HitCoverage=64%, E-value=1e-35, Identity=29%"; Hit description =Putative uncharacterized protein
MGSSQMPSLKKRFYQVKVKSLGITSLKELGQLMGQLQRQAFRKAYGKIWDLAMIEVSTEAIASLAQYYDQPLRCFTFGDFQLSPMVEEFEEILGCPIGGRKPYLFTGFYPSLARISKIVQISAQELDHRKQVENGVVGIPRKYLEESPVVAMLADLYDTFDRRCEKSNTRIVCCTPALYVWLVSHLFRQEVRHACPLESHRSCTEKGRANWDQLLASKEGASVNWFPRWKEGRTGVLISCGGFLNVPLMGTRGCINYNPVLAIRQLGYPMKGAPLEEELAPVISRGFNKTNMETLQKVCKAWEVVQKKDNELRGSGPIGGYREWLKAHVQGLDWLPSLRTAKREEVEAAEEDEEV

SEQ ID NO: 142190 - protein, 80 aa, Glycine max
  Coding DNA Sequence Number=SeqID_50505
MPVSAETQLRLSLHEKTEPTYITYQGNPCGVYPDLSSFIGSGVYPDLSSLTGSGVYPDLSSFTGSGVIQTFVACIKRSAP

SEQ ID NO: 142191 - protein, 51 aa, Glycine max
  Coding DNA Sequence Number=SeqID_50506
  Homolog annotation: Hit_ID=A0PAV3; Match level="QueryCoverage=74%, HitCoverage=17%, E-value=5e-07, Identity=76%"; Hit description =Restriction endonuclease
MVKVGTSYVPINVSFSPKVGPGLPGINRDTRIYLFCEVIFRHRYYSAQSAS

SEQ ID NO: 142192 - protein, 142 aa, Glycine max
  Coding DNA Sequence Number=SeqID_50507
MDMNLGSFISSQITLMAQHDSLRLDFLALITALCKTQGVHSDSLTHERLSPAINLAYIKKKCWNLDDLSVTFRGSHKAKGKSAMEKEKDDWRCHYKEKMSLEEAHHHRRPWIRAWRKKKMNEGRGREKHEILCFKRTLKFEV

SEQ ID NO: 142193 - protein, 103 aa, Glycine max
  Coding DNA Sequence Number=SeqID_50508
MKQKGKRKKDREGRHVIVKKYKSFVKSKRIFWKQRTDAKSLFSGITEIRMDEFIELMKEHNLETLVMRALWSDMGVWPETDTLTPKFVLPQISRLGSHDKRPH

SEQ ID NO: 142194 - protein, 118 aa, Glycine max
  Coding DNA Sequence Number=SeqID_50509
HHFVPFDHPEHSITGESVHSVIGDFEHPDFEHYNFEHSENMAQPPPRERTLREMAAPDFTYESLCIQYPDEDVPYVLKTGLIHLLPKFHGLAGFSSFFRGSTKGLTVLPCSKVHHELG

SEQ ID NO: 142195 - protein, 70 aa, Glycine max
  Coding DNA Sequence Number=SeqID_50510
MSSSQSENCLSSWIATACTSIANLECVVLPPGNNNEAIPLEATVKTMPPLDRTTDDKVFHIKVLPVPPYP

SEQ ID NO: 142196 - protein, 123 aa, Glycine max
  Coding DNA Sequence Number=SeqID_50511
EGALDLRTNPFQEGGSDEDTTKGKNHEALEGPITRGILKRAQHSDEDTTKGKDHEALEGPMTKAFLRVPVEPNSDLSRLIPYGVTVTYLPSLEVASLSINNPVSNVAPRKIHVTLKEIGRNNT

SEQ ID NO: 142197 - protein, 249 aa, Glycine max
  Coding DNA Sequence Number=SeqID_50512
RHILPERKVEIHHTELNEFKDELERRNFHKRLTNLVGSNIDLALVKEFYANLYSSEGPSPKQVRVRGHVVKINADNLNTFMETPVVLAEGHPGKILRKDLTTLAQMDMNLGALISGQITSMAQSNSSRLGFLALIIALCKSRGVTSDSLVFERLSSVINLAYIKKNCWNPDDRTVTIRGASRARTRPAEAPSTSTAPPPARTPAAPSATAPADFQRLEAMLQSIHQGQIILLQRTQPSLHREDEGPIAQ

SEQ ID NO: 142198 - protein, 310 aa, Glycine max
  Coding DNA Sequence Number=SeqID_50513
MAKFDPEIVLEFYANAWPTEEGVRDMRSWVRGQWIPFDADAISQLLGYPMVLEEGQECEYGQRRNRSDGFDEEAIAQLLCIPGQDFARTATGRRVRIMHTNMTTLTQIWMTLLLSNILPSDHNSDLPLPKCMAPTRHPLDPDKSNRALGFPALITGLCQSFGVPVAPTKVIRPPITRAFIEKYCTQRQAQGDAPQAAGAPPPPHQAGQAGAFDMEQYLRHLVRQQAANHRAHVQTHDCLYQMSLSMQSQGFASFSCPTLDQFRAEVAWPRDWPEAQAGEAPPEAPSDGEEAHEDEEMADLLDFLGGSGDT

SEQ ID NO: 142199 - protein, 160 aa, Glycine max
  Coding DNA Sequence Number=SeqID_50514
NVLMQFMETSEANQHTIQNLEIQVGKLAKEVAKLPFLTTREENFVKVEAHEESLVEEHDSREKDVEKSEERTQQQLEKCSQVEIQQESILQVNTPSHQLIGKEERHGEHDISLSVILSLITSTSLAMIWKAFSRYISFMEFLTKRQKCKEDMFYVTFMPP

SEQ ID NO: 142200 - protein, 152 aa, Glycine max
  Coding DNA Sequence Number=SeqID_50515
FDFMVNFVKSSKLETQHDIHKIYSHFIETLPNKSETQHGVRATLRDYLFENVTIFRKDFSFVIIFVNSSKSETQHVIHKIYSHVIETPPKTIQKYNKIKNYSLAARPKGNHHRGWRAAPDIASTRPDNTRPPQGQQRRDGGRGFAVVQTKKR

SEQ ID NO: 142201 - protein, 84 aa, Glycine max
  Coding DNA Sequence Number=SeqID_50516
QKKVYTDNHSGISARQRDSNVSMTDLVSAEDDQKKVYTDNHSGIFARQRDSNVSMTDLVRVADKSKALAPTYPQMRNSNLRSSG

SEQ ID NO: 142202 - protein, 133 aa, Glycine max
  Coding DNA Sequence Number=SeqID_50517
  Homolog annotation: Hit_ID=A4DID9; Match level="QueryCoverage=47%, HitCoverage=88%, E-value=7e-19, Identity=53%"; Hit description =Putative uncharacterized protein
PSVRYHSGRARILTLCQDLRAEGQSQAEGSLTARPTRRAGTKVGLSDPTVPSGRAVAQRIKGWAVRPLKRYVSWVQNVVRQFGPYPDREGRTSGVPVIVPTVNAGASGSTAETAMGSLPQRGWSERSFENSRE

SEQ ID NO: 142203 - protein, 289 aa, Glycine max
  Coding DNA Sequence Number=SeqID_50518
  Homolog annotation: Hit_ID=Q6UUU1; Match level="QueryCoverage=20%, HitCoverage=40%, E-value=4e-18, Identity=78%"; Hit description =Putative uncharacterized protein
  Subcellular localization annotation: CTP_CleavageSite=42; ConfidenceScore=5.14e-01
GTSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLNSIDTRWTPAETDVQRGRALLLEAFNQPDNLPPAEFAKLADKSRQQIYQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142204 - protein, 109 aa, Glycine max
  Coding DNA Sequence Number=SeqID_50519
TIKRAEDDFSLWAYNGLICPWLTKGAGNHNVTPGHLTSTGNPACHLTSRVKMTKGAEDDVGLRASTGSFAPGNPACHPDFTGQDDQKVQKTMFSLRASKRARLPLELTK

SEQ ID NO: 142205 - protein, 118 aa, Glycine max
  Coding DNA Sequence Number=SeqID_50520
MVEASGNRLPDCVIDYTEEWVTGNRLPEMKSLKIPFYLHVVIVMAAQLIRDRVEMECLEGAWETLEGNTRCRFWGTIRFTATSLVHPDEHARTLQRTVEWILPTPTPYRLVEPVQVIE

SEQ ID NO: 142206 - protein, 144 aa, Glycine max
  Coding DNA Sequence Number=SeqID_50521
  Homolog annotation: Hit_ID=Q6WAY6; Match level="QueryCoverage=72%, HitCoverage=18%, E-value=2e-08, Identity=31%"; Hit description =Putative uncharacterized protein
MGTNQNGKRFYQVKVKEFEEILGCPLGGRKPYLFSEFLPSLSKIAAVVGDSAKELDRMKQTRNDVVGLPRKYLEGKARDMASQEKWVPFADILALLVFGVVLFPNIDSLVDLAAIDAFLAYHHSKESLVVAILADLFDTFDRRC

SEQ ID NO: 142207 - protein, 73 aa, Glycine max
  Coding DNA Sequence Number=SeqID_50522
MSLSLQSQGFTSFSCPTPDQFRAEVAWPGDWPEAQAGEEPAGAPAEAPDEADEAREDEEMTDLLDFLGGSGAT

SEQ ID NO: 142208 - protein, 97 aa, Glycine max
  Coding DNA Sequence Number=SeqID_50523
  Pfam annotation: Domain name=Ins_element1; Domain location=8-69; Score=-23.7; E_value=0.028; Accession=PF03811.4; Description =Insertion element protein
VLQWLLFLSAVPPCSATDGVVRNGKSTAGHQRWQAAQLLGRAIGAGLFAITPAGERGMCCKAIKLGNARVFPEFDQSVLLNLAQPGWLNRKPDPKQS

SEQ ID NO: 142209 - protein, 96 aa, Glycine max
  Coding DNA Sequence Number=SeqID_50524
MWAIIDQYKEKLSLAATHEQRLEDEYAKVSVLQAEREARERVIDSLHREAMIWMHRFIFTLNGSQELPRLLAKAKAMADVYSAPRKFMGSLIIVST

SEQ ID NO: 142210 - protein, 70 aa, Glycine max
  Coding DNA Sequence Number=SeqID_50525
MQKVIKDWSFLKERRAQLAEGEYAKFQAEVARRRWTQLTKPMAKYDPEVVMEFYANAWPTEEGVMDKCFW

SEQ ID NO: 142211 - protein, 188 aa, Glycine max
  Coding DNA Sequence Number=SeqID_50526
  Homolog annotation: Hit_ID=Q5XM22; Match level="QueryCoverage=37%, HitCoverage=40%, E-value=3e-19, Identity=63%"; Hit description =Resistance-like protein HAAS-2
  Pfam annotation: Domain name=DUF1723; Domain location=43-92; Score =42.6; E_value=1.4e-09; Accession=PF08330.1; Description=Protein of unknown function (DUF1723)
KCPELKLFSHGSKVQKFGRSAPEIEGLVAATRLSPLISCSIDTGNRGLISTFVERWHKETSSFHLLVGEVSITLDDLASLLHLPTVGAFHTFEPLHVDEVVLMLVELLEVYGEAARDETAQCHGPYIHLSWLRDIYQSRCQARHWNPAARAYVLHLLGCTLFANKSATHVHVVFLDALRDLSQSGSYA

SEQ ID NO: 142212 - protein, 68 aa, Glycine max
  Coding DNA Sequence Number=SeqID_50527
MLDLDQLIDTVRLELFPPVQLLTGNGDPSNSAHKHTSRSISAGNRNAVVPFAAFKAESPTVARRAIGA

SEQ ID NO: 142213 - protein, 53 aa, Glycine max
  Coding DNA Sequence Number=SeqID_50528
MATIEYQVDMGSSLAYDNGIWGMAFVDNWVVGKEEVCYWLSNDIVGLVGNLAV

SEQ ID NO: 142214 - protein, 193 aa, Glycine max
  Coding DNA Sequence Number=SeqID_50529
MAPRKLASKRSRKDKAAEGTSSAPEYDSHRFRSAVHQQRFQRASRGWSFLRERRVQLKDNEYTDFQEEIRAPAVASLVTPMAKFDPEIVLEFYANAWPTEEGVRDMRSWVRGMAPTRHPLDPDKSNRALGFPALITGLCQSFGVPVAPTKVIRSPITRAFIEKYCTQRQAQGDAPQAAGAPPPPHQAGQAGGI

SEQ ID NO: 142215 - protein, 138 aa, Glycine max
  Coding DNA Sequence Number=SeqID_50530
  Homolog annotation: Hit_ID=Q6UUU1; Match level="QueryCoverage=43%, HitCoverage=40%, E-value=1e-18, Identity=78%"; Hit description =Putative uncharacterized protein
MSPEPPIGFLYDVIGGREEGVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142216 - protein, 78 aa, Glycine max
  Coding DNA Sequence Number=SeqID_50531
MTSKIILMLPKNQELSKFQRIRSQKASRIKLQESSFKESRFKNNQVSRIKIQEQSRSRFKTQDSRIKRSTKLFFQNIE

SEQ ID NO: 142217 - protein, 110 aa, Glycine max
  Coding DNA Sequence Number=SeqID_50532
IRRSKSLAFVDRTAFCYHDPRAEANMVICALSGDVGIFWWRLFQVSQVIQNYVGHVTCTLVSSRGGGPDDTQRYLTVIRTLLSSRGGGPDDKQRTNLVILHPCVIQRRRA

SEQ ID NO: 142218 - protein, 158 aa, Glycine max
  Coding DNA Sequence Number=SeqID_50533
  Homolog annotation: Hit_ID=UPI00005F7DD5; Match level="QueryCoverage =72%, HitCoverage=58%, E-value=5e-33, Identity=59%"; Hit description =COG0265: Trypsin-like serine proteases, typically periplasmic, contain C-terminal PDZ domain
MTPYSIGAAAGFAAMPDEIRDVIEEQFSIARRAKSDEECMACVKNLRAETENLAEQGQMLRMNTAKLYAKVEFVRENNKIVGYVISAVHIVVSGAALFGGMIMMSTMTPLGILAGAILFVDGINGITKEASHLRYGDQSKSEGIFADSSMEAANYLEC

SEQ ID NO: 142219 - protein, 254 aa, Glycine max
  Coding DNA Sequence Number=SeqID_50534
  Homolog annotation: Hit_ID=Q6UUU1; Match level="QueryCoverage=23%, HitCoverage=40%, E-value=3e-18, Identity=78%"; Hit description =Putative uncharacterized protein
  Subcellular localization annotation: CTP_CleavageSite=42; ConfidenceScore=5.12e-01
WNSYVPINVSFSPKVGPGLPAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMSSTYSFTVVMRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142220 - protein, 276 aa, Glycine max
  Coding DNA Sequence Number=SeqID_50535
  Gene Ontology: Mol. function=1-acylglycerol-3-phosphate O -acyltransferase activity; Cellular component=membrane; Biological process=metabolic process
  Homolog annotation: Hit_ID=A9I5J8; Match level="QueryCoverage=86%, HitCoverage=97%, E-value=1e-122, Identity=86%"; Hit description =Probable 1-acyl-sn-glycerol-3-phosphate acyltransferase
  Pfam annotation: Domain name=Acyltransferase; Domain location=57-184; Score=83.6; E_value=6.2e-22; Accession=PF01553.12; Description =Acyltransferase
MARLRSLLYFLFLAITVIPYAFACVLWAPLPLHLRYKLTVGWPRLAIWGAKVFCGIHWQVKGWENLPDGPAVLLSKHQSAWETLFFPAYMPREVCFVYKKELHMVPFFGWGLALLRMIAIDRSKGRDAFEQVVKQGQVRLDEGRWPLLFPEGTRVPPGKTARFKMGGALLASRTGAVVIPVAHNAGECWRRNAFVKYPGLVTLSIGPAIESKGISPEELNQKVQDWIEGEMRRLNAERLRRVHGRVAADRVPRGAPGTRATPPAPLFPPPAPSGIV

SEQ ID NO: 142221 - protein, 171 aa, Glycine max
  Coding DNA Sequence Number=SeqID_50536
  Homolog annotation: Hit_ID=Q6UUU1; Match level="QueryCoverage=35%, HitCoverage=40%, E-value=1e-18, Identity=78%"; Hit description =Putative uncharacterized protein
MADCLEGPQLGNHETQLQTGKRRTREPKRNSWSSGKGGEWRIALRVRSGEWRIAIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142222 - protein, 209 aa, Glycine max
  Coding DNA Sequence Number=SeqID_50537
  Subcellular localization annotation: CTP_CleavageSite=51; ConfidenceScore=5.70e-01
MTTPPASPPPPLPPPPTDASASPSTLKRTRKATRLRSLATRPPGAERPLVNVDPATGKADGPHKKKLRTYLEIVTRDKVDVTYDTWKEVPAAQKDLIWEDIHTVSECWRQFKSDLTRKWTLAADKDGVDDIVCEKYGISKEKWAQFCQTRRDPSWEDVWKKAQAIQKQNTAPPPTCWSRGGYEYLEQKLMAEKTKKRLEEAAQSGSTEG

SEQ ID NO: 142223 - protein, 71 aa, Glycine max
  Coding DNA Sequence Number=SeqID_50538
MACSVSALCPYSRDLYGRELSRILVIIPKVVISLLMVSRGIIPFEGHIAAVGTTSNNMLSKRKKTLDEGSL

SEQ ID NO: 142224 - protein, 85 aa, Glycine max
  Coding DNA Sequence Number=SeqID_50539
MPFIQCNAPGTFQRKLHRGVYGCVATYPSAGGRRETRGMRVPRKEYARSRHQRLFEENVGKTGKDAIYELFSERFGSCIYARGRY

SEQ ID NO: 142225 - protein, 83 aa, Glycine max
  Coding DNA Sequence Number=SeqID_50540
MDCHHQKGGDYGSNDFLDYFDDAKQSRVKKVPKNQASRIKSQRIKIQEQLSFKIQYSRTIKIKIQEQSKSRFKTQDSRFKRRN

SEQ ID NO: 142226 - protein, 63 aa, Glycine max
  Coding DNA Sequence Number=SeqID_50541
MAQKKSTPITPTTSRRSFKVEISCSTETFPLERELGRAALDCKEIYMDLKGCWTAEALSPRDC

SEQ ID NO: 142227 - protein, 145 aa, Glycine max
  Coding DNA Sequence Number=SeqID_50542
MRGEEDTCLIHSGAAHDVEVCPVAEDLLQGIMDQGYDKEVPWKYAPQKPDGRKDEFAEDDLSSAKVTNISGISHVTCSGRIFVAPDSLVWLKDTKGKAKVGTKENDKASLILDEEIPARRFAKGEEDFGRKKISNKKENEFLRII

SEQ ID NO: 142228 - protein, 148 aa, Glycine max
  Coding DNA Sequence Number=SeqID_50543
MVIAPLVIVANNNEEAQHNNEPMIHNEPIVEEPQELALRRSQRERRPAISNGYVVEARFMMMNNAIFMMSKAQVIDSRLIQDFKIKHQESNPKFKIQEKKSRIQSKIQDSREEIKKQQVKTSYRISIKYFFKNQIAQFCFTKEFSQIF

SEQ ID NO: 142229 - protein, 216 aa, Glycine max
  Coding DNA Sequence Number=SeqID_50544
  Homolog annotation: Hit_ID=Q84VI1; Match level="QueryCoverage=100%, HitCoverage=31%, E-value=2e-77, Identity=73%"; Hit description =Envelope-like protein
MATSPKETAASGSPAVPSSPHQEQPEFNIQPIQIIPGQASVPEKLVPRRQQGVKIAENPSPATIPREVDTEMDKKIRSIVSSILKDASVPEADEDVPTSSTPNVSVPDVNKDVPTSSAPNAEALPSPSEEESTEEEDQASEETPAPRAPEPAPGDLIDLEEVESDEEPIANRLAPGIAERLQSRKGKTPLKRSGRIKTMAQKKSTPITPATSRRSK

SEQ ID NO: 142230 - protein, 110 aa, Glycine max
  Coding DNA Sequence Number=SeqID_50545
EFKDVFPKKISHGLPPSRSIDHQVQIAKKNESYVKQANKKRKEVVLEPGDDPGHLRANVFQEGGNDENPKTDQIQAKGPSGKGQSPRVEKDEGPKTETLSRLLIVAKGPD

SEQ ID NO: 142231 - protein, 103 aa, Glycine max
  Coding DNA Sequence Number=SeqID_50546
MTGPLDESISCFLIKRTTRPRQQRATRPHLGGLHVLAVKGSCAFTFVGLHALTFRGLHVFTFRGLHALTSRGLHILALKGLHALTFRGLRVLTFSGLHIPTFR

SEQ ID NO: 142232 - protein, 93 aa, Glycine max
  Coding DNA Sequence Number=SeqID_50547
MAINKRSLKKRGMAKLEFHTGSATSRAYVQSSTTHYEIFPTLFVKLAFTKSEPHMDNPSLVFRNPLQTRDPRSLRSLFRNKKKQSLFLKQSSP

SEQ ID NO: 142233 - protein, 268 aa, Glycine max
  Coding DNA Sequence Number=SeqID_50548
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTFHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142234 - protein, 237 aa, Glycine max
  Coding DNA Sequence Number=SeqID_50549
  Homolog annotation: Hit_ID=Q2HW90; Match level="QueryCoverage=74%, HitCoverage=35%, E-value=3e-17, Identity=32%"; Hit description =Putative uncharacterized protein
AADGSSPTSSLPQNIWEDLGFGYDRNSVEAITSLTQYYDQSLRCFTFGDFQLVPTIEEFEAILGCPLGGRKSYLFSGLYPSMARVSKVVKIAAQELDRVKQNINGLVEIPMKHLEGKAKALADQGEWTSFVDVLALSVFGIVLFQNVDELVDLAVTGAFLAYHHNKESLVIAVLDDAYDTFDLRCEKSSARIVCCTPALYVWLVSHIFRHESRPVCPLQGHRMCAEKGKTNWEELLA

SEQ ID NO: 142235 - protein, 197 aa, Glycine max
  Coding DNA Sequence Number=SeqID_50550
  Subcellular localization annotation: CTP_CleavageSite=45; ConfidenceScore=5.50e-01
MNLLPSAFHVSSTNESRAPRIDCLALFANSPFSTFIRSPMNSLPCAVHVSSTFETGAPRIDCLALFPSSPFSTFIQSPMNLLPSAVHVSSTFESGAPRIDCLALFANSPFSTFIRSPMNSLDSAVHVSYTIESGAPRIDCLALFANSPFSTFFRSPMNSLPSAVRQFSILHFYSEPHEFIAKRCSCILHQRVRRLAN

SEQ ID NO: 142236 - protein, 86 aa, Glycine max
  Coding DNA Sequence Number=SeqID_50551
MTPVNRKAGTGERTREPPGGNACFFSHNASDWNTLASLPNIVMPIHIPLSPAGVIAKARTHRPSRNSWPIHLNGEWRQVPTVKRRM

SEQ ID NO: 142237 - protein, 303 aa, Glycine max
  Coding DNA Sequence Number=SeqID_50552
  Gene Ontology: Mol. function=hydrolase activity; Cellular component =integral to membrane; Biological process=establishment of competence for transformation
  Homolog annotation: Hit_ID=A7MEU0; Match level="QueryCoverage=76%, HitCoverage=31%, E-value=1e-51, Identity=48%"; Hit description =Putative uncharacterized protein
  Pfam annotation: Domain name=Competence; Domain location=126-291; Score=-28.8; E_value=0.00022; Accession=PF03772.7; Description =Competence protein
MAPVAATLQITAVNPAKNQLTAHIIRTGDRYVFPPLFVTLRNVSDEVAWCAGQRWQMQLRLRAVHARLNEGEFDLQRFAIANHSALQGRIVSQQAESLRCSWRTRFIDHHLARFTGLTQPAIIQALAFGVRDAMTPAQRALLRETGTAHLMAISGMHIALAASVGWLLARVIQLVLPARQIGYLMPLLISGLTAAAYCWISGSHPPAQRAMLALTLWLATRISGWQLSNWQVELLAVGAGRGDADTVVSVVSSAATFPSAASLANAATAAPAIGHDDSDGAAADLSVPRAQPERASGQPAGGA

SEQ ID NO: 142238 - protein, 179 aa, Glycine max
  Coding DNA Sequence Number=SeqID_50553
  Gene Ontology: Mol. function=helicase activity; Biological process =viral genome replication
  Homolog annotation: Hit_ID=Q2A9E0; Match level="QueryCoverage=84%, HitCoverage=10%, E-value=2e-29, Identity=42%"; Hit description =Putative uncharacterized protein
MTTDSLEDINSESPQASDFNSLSDDENCESNSNEPAIDTEGYSDLGDQAMECRHCNAKMLYDERISKDRNTTSPKFSLCCGDGKVELSLLQSPPKYLERLMFDGKTSDSKNYQCNIQTYNMIFAFKSAGIKLDKSINESRGPPTIRIQGQPCHQIGNLLPMLGKQPKFSQLYIFDTQNE

SEQ ID NO: 142239 - protein, 150 aa, Glycine max
  Coding DNA Sequence Number=SeqID_50554
  Homolog annotation: Hit_ID=A0ST23; Match level="QueryCoverage=30%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVTTLPDVCLARHAIVGLGTELEFVIMVIAVSFGKPVVPAALMNRPTRGERRFAYWALFRFLAH

SEQ ID NO: 142240 - protein, 122 aa, Glycine max
  Coding DNA Sequence Number=SeqID_50555
MPGADKPVRARQRVLSVVGAGLTMRHQSRLLLRVHHMRCEIPHRCVRRKYRIRRHSPFSLRNCWEGRSVRASSLLRQLAKGGCAARRLSWVTPGFSQSRRCKTTASAKLACLQVDSRGSPKH

SEQ ID NO: 142241 - protein, 85 aa, Glycine max
  Coding DNA Sequence Number=SeqID_50556
MNIGNNTNGGWEWKLSWRTTLFYSEIQMADNFLGELSQQQIQPNREDRCNWKHDQTGYYSTKSGYDLIWEAQMGANQNLEAQNTN

SEQ ID NO: 142242 - protein, 141 aa, Glycine max
  Coding DNA Sequence Number=SeqID_50557
MTGPLAIRGLHILACRGLHALAFRGLRVLIVSVLHIHALREYKQHSAQRPQCQSPPADVSIGLCRHDIGIAPTRHPVDPKKSNRALGFPALVTGLCQSYRVPVPPARSCHRDIGIAPTKTPSGPGKVQQGPRVSSSGYGPL

SEQ ID NO: 142243 - protein, 60 aa, Glycine max
  Coding DNA Sequence Number=SeqID_50558
MTKARQKGVRKVNEMKIKGRSLPPSLPRRARLLPPEATAFWRNILDGPSGPGCYLHPHFY

SEQ ID NO: 142244 - protein, 130 aa, Glycine max
  Coding DNA Sequence Number=SeqID_50559
  Homolog annotation: Hit_ID=UPI00006A17C9; Match level="QueryCoverage =93%, HitCoverage=65%, E-value=3e-08, Identity=32%"; Hit description =UPI00006A17C9 related cluster
  Subcellular localization annotation: CTP_CleavageSite=74; ConfidenceScore=5.44e-01
MLVRMIHTRLFAAARVKSCPGMHSSCVIASLSSCACTVGRSPILGGGPGTVRMWSTLKMRTRSPLKVRACSPLKARMCSPLEVRACSPLKVRAYKPLLARTCSPLKVRACSPLKARMCSPLEVRACSPLK

SEQ ID NO: 142245 - protein, 183 aa, Glycine max
  Coding DNA Sequence Number=SeqID_50560
MTLLLSNIQPSDHNSDLPLPKCMVPTRHPLDLDKSNRALGFPALITGLCQSFRVPVASSKRPAQGNAPQAADAPPPHQAGPAGSFDSEQYLRHVVRQQAANHRAHVQTHDCLYQLSLNLQSQGFTSFPCPTPDQFRAEVAWPGDWPEAQAGEAPVEAPGEAGEAREDEEMTDLLDFLGGSGAT

SEQ ID NO: 142246 - protein, 151 aa, Glycine max
  Coding DNA Sequence Number=SeqID_50561
YIMNSIITVLYFNGRVYEDNDGVIFEGSKKAIQIKRGISFNALKKKIGDKSELPINISNLHDDDDDYLASNSYVEESFDEDDSDDGISDTDDEVTDIVEPVSNVHPTEGVPEIENPFWNDAMHYNNINWSHPDEEDICGLDMPTTFNVGQE

SEQ ID NO: 142247 - protein, 121 aa, Glycine max
  Coding DNA Sequence Number=SeqID_50562
  Subcellular localization annotation: CTP_CleavageSite=83; ConfidenceScore=5.36e-01
MPPKVSSSSGRGGRSSTKGKEVLLALPEPITKKATTTSSGSPTQTGSSTHKGKLEGSLTQTTTIKSESSTQESPKPTTSKQTVADYAWSIQTLLALRRYRPHQNTKISKKDLGRNGLRIRR

SEQ ID NO: 142248 - protein, 70 aa, Glycine max
  Coding DNA Sequence Number=SeqID_50563
MGPNYEGPFVVKRAFSEEPWCLPTWMGQDHLELPSGVETKLEQQKPIKVHRDGCKWGWGHDRPIVAPSLR

SEQ ID NO: 142249 - protein, 97 aa, Glycine max
  Coding DNA Sequence Number=SeqID_50564
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=72%, HitCoverage=74%, E-value=1e-26, Identity=81%"; Hit description=LacZ protein
MSKKEDQHKTTAMHASLALAVVLQRRDWENPGVTQLNRLAAHPPFASWRNSEEARTDRPSQQLRSLNGELAPDAVFSPYASVRYFTPDMVHSQYNLL

SEQ ID NO: 142250 - protein, 137 aa, Glycine max
  Coding DNA Sequence Number=SeqID_50565
CNLQWLSARKNLEEDELSSAPLQVIKCTASAHPLSKTNPRGEEDILTTCVFAAFHFVLLFVVKEVSRLWKAKSSVGSSIGNWSDSKVLDSTCHTLILSGDHLFSGCNLRLTASRYLTPIVRQTVKFRDISELKKSLV

SEQ ID NO: 142251 - protein, 184 aa, Glycine max
  Coding DNA Sequence Number=SeqID_50566
  Subcellular localization annotation: CTP_CleavageSite=53; ConfidenceScore=5.34e-01
GLHALTSRGLQVLALRGLHAFTLGTSYLHLQRTRRPRLQRVMYLQLQRTTRPRLSKGSCAFTFERTTCPHLQRTTRPHLERTTRPHHQRAACPHLQRTTCPRLERATRPHLGGLHVLTIRGLHALTSRGLHVLALRGLHALTLEGYTPSPWVLVTLTVERTTRPRLERTTCPRLERATHPHLGY

SEQ ID NO: 142252 - protein, 23 aa, Glycine max
  Coding DNA Sequence Number=SeqID_50567
MKKILGLQAPMELTSRSRSLAVN

SEQ ID NO: 142253 - protein, 123 aa, Glycine max
  Coding DNA Sequence Number=SeqID_50568
MSKSCGFGMTGPLDESISCFLIRVDPWRTPCPQLERTTCPRHQGTSCPRLERAARPHLQRTTFTLTVERTTRPCLERTTRPHHQRAARPHHQRTTCPRLERTTRPHHQRAARPHHQRTKRPRP

SEQ ID NO: 142254 - protein, 90 aa, Glycine max
  Coding DNA Sequence Number=SeqID_50569
MDPEEQVNKSNQDVHVWRMNGVWGKTEIFLTILSRIMSRIFLGDSVDGNGYMWMRTSGVEAACIKFSRILASLRTDKQQLNLPISYLLTT

SEQ ID NO: 142255 - protein, 172 aa, Glycine max
  Coding DNA Sequence Number=SeqID_50570
  Gene Ontology: Mol. function=phosphoprotein phosphatase activity
  Homolog annotation: Hit_ID=A7R8Y3; Match level="QueryCoverage=63%, HitCoverage=31%, E-value=3e-12, Identity=36%"; Hit description =Chromosome undetermined scaffold_3090, whole genome shotgun sequence
WCAVVPLICFHVVERHQSDRVLRQFGMQQPIPECPLQPLNIHGLTLKGKQDENWFQLLAPMISQWNNRPEFRVDVYPRQEGLLSFNSDYMAGVAETLQYMVSPQGRNTWTADDLVPYVEKIMILSKEQEKITEPVAHGPVLERRFPPQEFYMLQSSVETRGFGRRREVVEAE

SEQ ID NO: 142256 - protein, 125 aa, Glycine max
  Coding DNA Sequence Number=SeqID_50571
MGGDTCDCQVPPMLSILFKGLAFPFNHVLQLSPVGSHIRVVLILPKEGGNKILPSTDAGSFQISVPDDCGPSQAILEEVHQQLLIPGIRPHLATIHFEMVLRTSRPFVPIEIRYLEFRGDDDVQH

SEQ ID NO: 142257 - protein, 258 aa, Glycine max
  Coding DNA Sequence Number=SeqID_50572
MALDLTVLSFNCSRHKGLSGHTEERPTRRVDTEILTCHAILRHLEDSRSHGNEREGEQARGQGARPPPLGARPGVVVKHVQLCGPSSTDLKDQGKPEREEESGGGAGSVGSSSTLYFCSNRGLTAGDGVLSFVGGFYRPVDVEHSLEKSGSSDACCRAPASRGRTIGRSTYVWAFGHIVLASDATALFRPNDSALLGANNPCGSSVVEDESAQGAPSPNVVARSSWRRAVIPAVSARRAVGSCVTTRLARTADREEAK

SEQ ID NO: 142258 - protein, 277 aa, Glycine max
  Coding DNA Sequence Number=SeqID_50573
  Homolog annotation: Hit_ID=Q6WAY6; Match level="QueryCoverage=91%, HitCoverage=46%, E-value=2e-14, Identity=26%"; Hit description =Putative uncharacterized protein
VDWDQHLAGIGGSAINWFPRWKEGKEGVLFSCGDYPNVPLIGTRGCINYNPALAIRQLGYPMRGAPTEESLSPFLVRDLGVQGLKVIQRIHKAWRSPLRKDKELRGIRNGVIGGYHEWLRIHTRGLDWLSKARLAKEKFKSAATHIRKECTELQEENTATARALEQETKRARKEEYGREKFRGALWGSNNELKLRREERDRSRVHGMILKEELVACARSKRSLAQHLEATEQSMLAIIGQYKEELNQSMAHEQKLVEDFAQVYAEKEARGRVIDALH

SEQ ID NO: 142259 - protein, 70 aa, Glycine max
  Coding DNA Sequence Number=SeqID_50574
MTEREMIIVIMDTSSMFYYEKMVGYMPSSFANLVFVGERIEAGDPGGMTRGRRRENLILWLQFPRDQNFH

SEQ ID NO: 142260 - protein, 300 aa, Glycine max
  Coding DNA Sequence Number=SeqID_50575
  Homolog annotation: Hit_ID=A6N1F2; Match level="QueryCoverage=16%, HitCoverage=62%, E-value=2e-08, Identity=63%"; Hit description=Imp biosynthesis protein
VKEVGDLMTGEPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRERLTEDPPLSRDVIARLIERSCAEVNGAKRSAEAREGPREQCWTKRKRDVGLSNANVGVRSCLENPRVRAPVGPEGRRRSRLAERGYRFKDARCPCFFRVIRGRENASSQSSSTRRYSAEVIHAILPGKARTTFNKWVPVPETDTGVPPHKGGRSDQARATVYQKHRSRKVVDHVWGLTPCPVPE

SEQ ID NO: 142261 - protein, 128 aa, Glycine max
  Coding DNA Sequence Number=SeqID_50576
MNVLSGATLFCKITHAPNIFMICVHGDSLGSDQGVPMNPKRIKVIPKWPTPPTIRKIWGFHDLTNFYKRCWGKKPRVSRTSGFDVKFDAILPLNLKAHLEHKISCSSLPLPSFISFFLQALIHGLLWW

SEQ ID NO: 142262 - protein, 99 aa, Glycine max
  Coding DNA Sequence Number=SeqID_50577
FSGTGPGPGIICMGWILNSGCSWFDGVLVDDGDDGTEGETGDEVSFGEVAMEKQSFWSVVNVLLTFEHVQIEVIAITPLADKCPACPSVFQTDLHPMPL

SEQ ID NO: 142263 - protein, 101 aa, Glycine max
  Coding DNA Sequence Number=SeqID_50578
  Homolog annotation: Hit_ID=A6FJQ2; Match level="QueryCoverage=37%, HitCoverage=84%, E-value=7e-11, Identity=89%"; Hit description=50S ribosomal protein L5
MQLPETVHSLSVSGCREQTSPSGRRQRVLAGCRGWLNYAASEQIMRKEKIPHQAPFAIQTAQLLGRAIGAGLFAITPAGERGMCCKAIKLGNARVFPVTTL

SEQ ID NO: 142264 - protein, 169 aa, Glycine max
  Coding DNA Sequence Number=SeqID_50579
  Gene Ontology: Mol. function=transcription factor activity; Biological process=regulation of transcription, DNA-dependent
  Homolog annotation: Hit_ID=P52696; Match level="QueryCoverage=100%, HitCoverage=53%, E-value=3e-93, Identity=100%"; Hit description =Uncharacterized HTH-type transcriptional regulator ybhD
  Pfam annotation: Domain name=LysR_substrate; Domain location=1-147; Score=2.4; E_value=0.0033; Accession=PF03466.11; Description=LysR substrate binding domain
MNNVTNSSIDFTPLVNEPFVLACRRDHPLAKKQLVEWQELVGYKMIGVRSSSGNRLLIEQQLADKPWKLDWFYEVRHLSTSLGLVEAGLGISALPGLAMPHAPYSSIIGIPLVEPVIRRTLGIIRRKDAVLSPAAERFFALLINLWTDDKDNLWTNIVERQRHALQEIG

SEQ ID NO: 142265 - protein, 178 aa, Glycine max
  Coding DNA Sequence Number=SeqID_50580
IVMASQLIHDRVEMECLEGAWETLEGNTRCRFRGTIRFTTTSLVHPDEPARTHQRTVEWILPTPTPYRLLEPVQVIEVTSSEEDPEEDLEELPPEPVVDALDFLEGDEDPLPEVDSPEEVTSASEADSTEDSGLGEMAIKMKKKKKNRGIMAFRKNHLPKFSGDYDPEGARLWLAETE

SEQ ID NO: 142266 - protein, 232 aa, Glycine max
  Coding DNA Sequence Number=SeqID_50581
MSPFLVRDFGAQNFKAIQAIHKAWETPLRKDQELRGIRNGIIGGYHEWLKVHIRGLDWLAKLKVVSEESFEAPEEDEEVQALKSELRKAKLAKEKFKLAATHIRKECAGLREENATTTRALEQETKRARKEEYGRNKFCGALWGSNNELKLRREERDQSRAHSMVLKEELVACSRSKRSLSQRLCETETNMLAIIAKYQEELGLATAHEHRIAVEYAQVYAEKEARGRVIDS

SEQ ID NO: 142267 - protein, 62 aa, Glycine max
  Coding DNA Sequence Number=SeqID_50582
MTKARQKGVRKENEREACHPARPSELSSPRRARLLPPEGTTFWGNFLEGPSGRGYYFHPPVY

SEQ ID NO: 142268 - protein, 65 aa, Glycine max
  Coding DNA Sequence Number=SeqID_50583
NAFDKKVRPRKFNEGDLVLKKMSHAVKDNRGKYIGTDASRDGVTTDQSLPFPGAKRAENFAARQP

SEQ ID NO: 142269 - protein, 55 aa, Glycine max
  Coding DNA Sequence Number=SeqID_50584
MVIFHHGDAAEDKGEEVRGGAYPLGNKPWKKVASLRSFLEKTSLRSFFEKTSLRS

SEQ ID NO: 142270 - protein, 118 aa, Glycine max
  Coding DNA Sequence Number=SeqID_50585
MSRKDHIFLKAFPHFLEGVAKDWLYYLAPRAVHEVATNSSSSTETKKLEGKLDALVNLVTQLAMNQKFAPIARLYGLCSSVDHHTDLCPSVQQSEAIEQPEAYAANIYNRPPQPQQQN

SEQ ID NO: 142271 - protein, 56 aa, Glycine max
  Coding DNA Sequence Number=SeqID_50586
MGGDCGSNVFQGYFDDAKESRVKQIPKIQESSFKNQDSRIIKIEIQDSRFKNQEKT

SEQ ID NO: 142272 - protein, 213 aa, Glycine max
  Coding DNA Sequence Number=SeqID_50587
MSNVSKSSFASDKYERVGPDYFGYYSSEVVNLLSQDEDVFPVSTQTPELPETKYEEGGKKNLVNQTDNCSGPLYSNAVGAGLSEFKKDRFKSLLRQSVIALSSEVDEVVDPVFAAYHLQSKLKSKSQSLNDTATASDNVMQVPCKKLKISSSSTSARFLERTTNVNPQCSRKVYILSRIAWKGTAEKPDPVPKDALTHSHACVLDWPNNSPCS

SEQ ID NO: 142273 - protein, 331 aa, Glycine max
  Coding DNA Sequence Number=SeqID_50588
  Pfam annotation: Domain name=Transposase_23; Domain location=20-92; Score=-2.5; E_value=0.0022; Accession=PF03017.5; Description =TNP1ENSPM transposase
  Subcellular localization annotation: CTP_CleavageSite=40; ConfidenceScore=5.25e-01
MASFSHMQSQLQLQMQSQGLVVPPDPLVGPSGPRDPARLVAMGRVYEGSTVVHNTPLLPGQVKVSVEEVTDADAPVPVPTNEVFLVGQTLHTFLAWPTHLVKSLSQQVAVSLAKPPPKSDPEVDDPLYLMALTIPELFLRPYQVRWDATVFGVFNLDFPLYIKHKDLSEIAHGGQCLSISVLQLWILHLTKTCIRVGNSYIYGFLEPQSIQRSRQSQFESESYIKSWMQSSQRDVYLGAYLNGFHCSGHWQMGVILPKEHLVVWFCSLHNRPNNYLKGIINSLNQRLLLGGLSSRNNWEAYFNDPRPLEPERLKALQIQWAQFYLRVRDQA

SEQ ID NO: 142274 - protein, 202 aa, Glycine max
  Coding DNA Sequence Number=SeqID_50589
  Homolog annotation: Hit_ID=Q9LY88; Match level="QueryCoverage=15%, HitCoverage=23%, E-value=6e-07, Identity=80%"; Hit description =Putative uncharacterized protein F18O22_200
MDTLTNLTLHLIHSTASPDTLPSSNPPLRFHPVNIILHNLENQLLKKKQTLPREDKHQLAHSLSHNSLLSLVFVVLMSCFTPEKPTMSTLQMVPLGKLRYQRLRHEKGWDGERERRPRSWFRFRRVPIRRRLRLKISSLRRLWRKRARLVSSMRISYAKVLKRFKEGQVHFGDLFAGNYLFMHVNPASLKCLERDLSLSKIA

SEQ ID NO: 142275 - protein, 67 aa, Glycine max
  Coding DNA Sequence Number=SeqID_50590
  Subcellular localization annotation: CTP_CleavageSite=61; ConfidenceScore=5.09e-01
MASLFRRALGGTWTGMLVFHSTSRLLGVVHLLGLASIPWCVITKSRNLPPSTLKSMHPNLVVSRVSV

SEQ ID NO: 142276 - protein, 105 aa, Glycine max
  Coding DNA Sequence Number=SeqID_50591
HGLEIYPKAHENPRAFPWISGPIYLESSIQCPCGVGLHHVWNICKLLASSTLFGEVEGVDCECWPVVANSYHFGSNRVTLGVKAADPFMKFSHDIIYLLAVIAFE

SEQ ID NO: 142277 - protein, 52 aa, Glycine max
  Coding DNA Sequence Number=SeqID_50592
MAVRGGYWWLWVVKKKLGTLGKGGRFYRDSSDNFLEKLSREASLRSFFERLL

SEQ ID NO: 142278 - protein, 497 aa, Glycine max
  Coding DNA Sequence Number=SeqID_50593
MSSFMSNFAIDMGGNDSEGSIQQPPRTMRALCHTGGATSHLHGRARPSIASLTKELVPVMMILPPFASGEEGEVIGMLGHLLACIVAITLGHHRPYLPLLAVSGAASGSLPLFFMYKCLFEALGLVICTPTMNQHHSSALERDPYPNPPEHMSKKLFEFDSNVFRCFKDYFFKVLATNVAADGSVDPCGTAPQSIVSSVAGEGGQPTIEVGPVVSAAEIACSVHSSILTERKQAARLTPDAGRPSSLQDLPPAPSVVEAPASSIVVAATPASLPPLATPAAEVDAPATSTDLVVIPSPTITAPLLSAGVTTISAPEMPPPPSSNATDSAKVFLQRSLAILGRMDNDTKRFCTRRRPWRQSQTASCLRRLVVLLPSCYAPEWMMMSYLSTVRACSGRKLTWLARMEESELRAAKEKEANNELEEELIMYKKEAVEQHEKGFNKAIRQVGCFAKDLDLGLFDHFKNVKDGVLLDNEGIATKEKVGEEQGAEEQGHDAII

SEQ ID NO: 142279 - protein, 40 aa, Glycine max
  Coding DNA Sequence Number=SeqID_50594
MRGTMHEPQENLGADQKFSPGINETLGLIRILVMDLKRAN

SEQ ID NO: 142280 - protein, 136 aa, Glycine max
  Coding DNA Sequence Number=SeqID_50595
MEAEWRRKRERRRHFNKKMSLEEAQHHRRPWIRAWRKKEMNEGRGRKEHKILCSKRALKYEGTSFVVQVEGTSIWVVVTENKRGYISCGLVLVEGTSTRLFKENKGGYIPCGSLLVKDFTRLKRNLRNCKSLGDWM

SEQ ID NO: 142281 - protein, 198 aa, Glycine max
  Coding DNA Sequence Number=SeqID_50596
  Subcellular localization annotation: CTP_CleavageSite=53; ConfidenceScore=5.27e-01
MGPKSTLRLMRTLRHSLASLAQSSWSLLSNALSGDTSFWSLAYKDGLVGRPVFVSLVVSRGGHVIFPFKIQRRSYPETRLCMFTGHTWWTPDVPLYCHTKTVLTEARLCILNRFTWRARDFTFLTLWRLRSRAASTEVTTTRPSYIASSPTKSVPVKSRLVRAPALLLLPSAVATDKAEATFRQLVLVGGLLLRHRLS

SEQ ID NO: 142282 - protein, 144 aa, Glycine max
  Coding DNA Sequence Number=SeqID_50597
MKFLYVFRAHWQLLVMYPGDNIVLWFCSLRKKPDAAIKAAVNSAMKSLSKSEEGKPAQPVPQWIEAKSHVQMGNYECGYYVMHCAYSTKFRALLSLSPHSSPSSSKLLSMASYGEAKESIDEEDPRPTSSNGALHHVVSRVSSS

SEQ ID NO: 142283 - protein, 56 aa, Glycine max
  Coding DNA Sequence Number=SeqID_50598
MPMVHATYDTGNSINCGRNSFVAQADHQGGGELRCTTGWPQQILHGFLSEVSSGHA

SEQ ID NO: 142284 - protein, 176 aa, Glycine max
  Coding DNA Sequence Number=SeqID_50599
MEYSLPYYHNQGQMTRLMLHPSFYIDVIETKWKHYDVLHPTPSYYHFAASMSKFVIPFESHSPFTDITMFYAGSDSSSKDTNATSPSLMYPHLVLPKAWVPPGVDMVDLVWEDEGENRGRTGGGHVYEEKMSDVALCGACSMAEEWRRKKDDWRCHFKEKMSQEEAHHHRKPWIRA

SEQ ID NO: 142285 - protein, 68 aa, Glycine max
  Coding DNA Sequence Number=SeqID_50600
MALFDDKANNVVGDGRLGVKDQVAVVQRTTMIRMTLLRVFHQSSMWVNGGGHGDGGYVEVMVRIFLGI

SEQ ID NO: 142286 - protein, 146 aa, Glycine max
  Coding DNA Sequence Number=SeqID_50601
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=35%, HitCoverage=50%, E-value=4e-24, Identity=100%"; Hit description=LacZ protein
MVRTRFVSKEAGSNSIIDLKNLLVNHLPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142287 - protein, 66 aa, Glycine max
  Coding DNA Sequence Number=SeqID_50602
MYATIMGIMSFFLLSNLQLKRALRGIKLKYHGTCRESCVEPKAGQWNMIDKVNGSVIHMSDMGSVL

SEQ ID NO: 142288 - protein, 95 aa, Glycine max
  Coding DNA Sequence Number=SeqID_50603
MDYIPPSPLNMDYAPPIVQVDEFMSNETLWHASISSIFGQDVLDIVSDIVDPAASMLLATPDVLDIVSDIVNPAASILHLTFHLALCIVQPDLIL

SEQ ID NO: 142289 - protein, 109 aa, Glycine max
  Coding DNA Sequence Number=SeqID_50604
FEEVTKTHGLRKIPPFDFRHITEFSRIADRLSKANFVNSLHEKREAQIEKKIKQYARYSNKKRKKMVIKLGTFDINSRANSFQEGGYDRGLFKEEEFDIGGFNMDGPIT

SEQ ID NO: 142290 - protein, 51 aa, Glycine max
  Coding DNA Sequence Number=SeqID_50605
MEGSRPILASSTNLHAMASKKLLTKRARKDAVGEGSSATPQAEIEFDGFRF

SEQ ID NO: 142291 - protein, 59 aa, Glycine max
  Coding DNA Sequence Number=SeqID_50606
MVALMKKVEELELREKDLQSRIRDMKRKEKILGILLVVCWVCLCLLVCALCIRGTLLRL

SEQ ID NO: 142292 - protein, 101 aa, Glycine max
  Coding DNA Sequence Number=SeqID_50607
MVVEVDLGVVVILGVDVMAVQIGRGLQDLLSKKLRPLRELLCNGVELQVFVAQQKLSYQLDISHNVFKALETTSLSISTPSMVAADSSIDLDCATSICVVE

SEQ ID NO: 142293 - protein, 165 aa, Glycine max
  Coding DNA Sequence Number=SeqID_50608
MVKGLANPNQHEKLILDAIQASIMPAMTVQFSHVYRECNKVADLLAKKGLSLDEGIVYFLDILGFVVSAFHADIVSLGLPRKPSKSGESREGGAILTPSSTPSTSARSSDAAGYSHGNATASPLSGTADSNLVPGLNHGDRIVQAMNSKLNLNGSFPVTAYEALP

SEQ ID NO: 142294 - protein, 101 aa, Glycine max
  Coding DNA Sequence Number=SeqID_50609
MDNASSCSDIHEVLKGIGPPLIHLLPTYVKYRIIIGTNNTCNKARGTSFVVQVEGTSTWVVVTENKRGYISCRSVQVEGTSIWLFKENKGGYIPCESLLVK

SEQ ID NO: 142295 - protein, 77 aa, Glycine max
  Coding DNA Sequence Number=SeqID_50610
MAKGERLRSEDYLKEATKERIEEFFSIESMRCILRISLRLRGSSWCGGSAASNSGSWWPPVVVDGGGGVSRVVWMEF

SEQ ID NO: 142296 - protein, 107 aa, Glycine max
  Coding DNA Sequence Number=SeqID_50611
MDFTTIGVKQLNSVGKNPHVDKQSSPNEIRLFGILKVDEQELAQEEETKKWKSLALTVQRPKCNSASKESSPKALAINDASEEEFDDNDSDEEDDELILITRKIRKM

SEQ ID NO: 142297 - protein, 399 aa, Glycine max
  Coding DNA Sequence Number=SeqID_50612
  Homolog annotation: Hit_ID=Q6WAY6; Match level="QueryCoverage=60%, HitCoverage=42%, E-value=1e-09, Identity=24%"; Hit description =Putative uncharacterized protein
ILKRPLMGTRGCINYNPVLAIRQLGYPMRGTSSEESITPFIARGFRDPNVKILQGVRKAWGAVQRKDKKLRGSNNGIIDDYHKWLKARTQELDWLLKLKVSSEEEAETPEESEEVRKEYDKLRDINVATAEALERETKRARKEEYGRNKFRGALWGSNNELKLRRAERDQSRVEGMVLGDKLEACQRSKRSLSEQLGKTEENMWAIIDQYKEKLSLAATHEQRLEDEYAKVSVLQAEREARERVINSLHKEAIMWMDWFIFTLNRSQELPRLLAKAKAMVDVYSAPEEVHGLLDYFLCLITHCIFVLLGENAITTHALRHPYQTRSKTRVMGDVEEVQEQMKADMVALKDQMASLMEVMLSMKKLIESNTATTAAATEADPTHPSATNQAHQLAPDMAG

SEQ ID NO: 142298 - protein, 130 aa, Glycine max
  Coding DNA Sequence Number=SeqID_50613
MAEELLQGMMNRGKIKVYSAKRGEGDPFIIKSPAPFPYKSDKAVPWKYVAQGSDKRKDASVVRVKEDLPSPKDKGKEKADVGKRDKAGLTPNDEVLVGKITEEGDDFSKKEISTEEATEFLRIIQQSEFK

SEQ ID NO: 142299 - protein, 65 aa, Glycine max
  Coding DNA Sequence Number=SeqID_50614
MTTDSPPLPMFPWTRWSRQLSQPTLRREGDARLMGASSKEGKRVELPPMFIRGKRQKNQEQVYDF

SEQ ID NO: 142300 - protein, 116 aa, Glycine max
  Coding DNA Sequence Number=SeqID_50615
  Homolog annotation: Hit_ID=Q6WAY6; Match level="QueryCoverage=74%, HitCoverage=15%, E-value=4e-08, Identity=35%"; Hit description =Putative uncharacterized protein
MGTRGCINYNPVLAIRQLGYPMRGTSSEESITPFIARGFRDPNVKILQGVRKAWGAVQRKDKKLRGSNNGIIDDYHKWLKARTQELDWLLKLKVSSEEEAETPEESEEVQALKNGT

SEQ ID NO: 142301 - protein, 109 aa, Glycine max
  Coding DNA Sequence Number=SeqID_50616
MADALNTLASIEAKLHGESSVIQRCFDDNNDDKKKMMTKVMTKTSKVNQRMSSRYSRRNQEQFKTQEERLKDTSRFKRKVEFKNQDSRIKLQESRSRFKIQGSRTQEKT

SEQ ID NO: 142302 - protein, 168 aa, Glycine max
  Coding DNA Sequence Number=SeqID_50617
MVLPEQFRKNHFFRKFERSSGRALLPEELLLPESIRKRCSGRLPEEDVWLLPEEHFFQKLSGTGSSRTSGTTPNGSSGSLRRQPFSPFFSASPALVFYPKCIIKAEGRLGTPTSNGNGVQPKEAAAGLAVEEKACGRGKKRKRSRSKKKRLSDSGRGEGKLFKCFKLF

SEQ ID NO: 142303 - protein, 113 aa, Glycine max
  Coding DNA Sequence Number=SeqID_50618
MYQYPFEGHESDTSATELSGVAETYLNFSWPTMTPSQQHDAPILTPNAPLATQWNVPGTIPDMGELLGVDLRHRFSVEADQVEEGRHHGRKNLDRQAQRWERPCGTSSRHHGH

SEQ ID NO: 142304 - protein, 298 aa, Glycine max
  Coding DNA Sequence Number=SeqID_50619
  Pfam annotation: Domain name=Transposase_23; Domain location=97-163; Score=-13.7; E_value=0.038; Accession=PF03017.5; Description =TNP1ENSPM transposase
MDEKKKKQLEEASQSRSTDTMIDPPSPIKRHVKWKMARTKKTRQMTSKATKEIVGKIIRFVGGAGLTRFLCRPWALGCTDCCHWATRTPWSWNDPDMSDSKKCGLYVEENPSCLVALGRLYEGSTTVHNMPLRHDQLKVDVEEVKDIFVPTQEVQLVGQTLNTFVTWPIHLVKRLLEQVMWDATMFGKFNDDFHLYIKHEDLSEIAHGGRCLNISVIQLLIFAHWQMVVILPKENVVIWFCSFHNRPDNYLKGIINSALKGLDDTPQSKSKTATKWIVVKDKKEALNVGITSCTGCQL

SEQ ID NO: 142305 - protein, 185 aa, Glycine max
  Coding DNA Sequence Number=SeqID_50620
  Homolog annotation: Hit_ID=A5B731; Match level="QueryCoverage=81%, HitCoverage=27%, E-value=3e-13, Identity=38%"; Hit description =Putative uncharacterized protein
MIRNDQAEATEEEQVTCSINDQTEKREKEEQEEVKLISNIINQTDDFEDDILPEFEKLLFEEIDFLSLDEKTDEDKKWRVYAIEMANSASELEWLHNQVKELEEREVKLDGSGRRLCGVTKAVEIGKKLKALNDLEVEVVELKRENKELQHKKREMTLNSMLLNLKLQNSPMSQRSQSLSRSIFL

SEQ ID NO: 142306 - protein, 148 aa, Glycine max
  Coding DNA Sequence Number=SeqID_50621
MRVRARLWGLRRGFEPREGWWLRGVDAEEVDDGEDYQRKVDLFQASLAKIEYEDGNRLKLKLRGHWDGVEYEGLHRICSTYGCYGHLTRYCKIQTIVAFSKSMSVQKGANMEPSTMAQRVSTNIKKVAKMIDEGTAMEVTTELSSSVI

SEQ ID NO: 142307 - protein, 305 aa, Glycine max
  Coding DNA Sequence Number=SeqID_50622
MVLGKVIDNCQSAFLGERKLLYRVRVANAFTWTSVLVNGSPSQEFKCHKGLRQGYPLAPFLFLVVTEEGSLWSEVLIPKYDGWKGLVREGELLRESLWWKDLKRICGGNSREKWFDEGIEWKTGQEDVVCEMGCWRLDRWVWKLNWRRETFEWELLEQLQILLNSVQILSNELDSWVWQNCNSGKYSTNWAYKLLLEDDDSSTYLSDMPYDLAAMASMPFLDASFNVNNTFSIFGEPFQSVFGFGKCGEARGDNGVSPSLALSTNRATILGRCCDRMVSATRWKGLGVHNYVLRKEMQEPKNGVP

SEQ ID NO: 142308 - protein, 30 aa, Glycine max
  Coding DNA Sequence Number=SeqID_50623
MEESQELARDAAIAVGRQMCIEMSVLSCEL

SEQ ID NO: 142309 - protein, 88 aa, Glycine max
  Coding DNA Sequence Number=SeqID_50624
MDDSISNPLCDVNDDEIEVEDVEKEYKFVEPDKKKTKSTTFDCWKFFTKIGVALHRPSAPLGKVKVMQKNGGISGALEAYLIGGIRVI

SEQ ID NO: 142310 - protein, 116 aa, Glycine max
  Coding DNA Sequence Number=SeqID_50625
MWMYYEDHIVPAGHALDPLPHGHAPQSRVVPQAPQTDIPRVPEPGASSTSAEEPKHAVEVCDDIAERLERHLSLGVVTPGSSTHEVVEECLRLARSVIQDHLVYVRCRRRRRTDQA

SEQ ID NO: 142311 - protein, 82 aa, Glycine max
  Coding DNA Sequence Number=SeqID_50626
MALANQGEWASFFDILALLIFGVILFPNVKGLVDLAAIDAFLAFHHGKESPVVAILADMYDTFDWRCEKSSTRNCLLYTGSL

SEQ ID NO: 142312 - protein, 35 aa, Glycine max
  Coding DNA Sequence Number=SeqID_50627
MARTCNPLKVRACPTKARTCSPLKVKVTSTQGEGV

SEQ ID NO: 142313 - protein, 53 aa, Glycine max
  Coding DNA Sequence Number=SeqID_50628
MVKARQKGGKRGRWLPPSSPRRAGLLPPEGTTFCWNTLEGPSGLGCYLHIPFY

SEQ ID NO: 142314 - protein, 168 aa, Glycine max
  Coding DNA Sequence Number=SeqID_50629
  Homolog annotation: Hit_ID=A6FJQ2; Match level="QueryCoverage=22%, HitCoverage=84%, E-value=3e-11, Identity=92%"; Hit description=50S ribosomal protein L5
MRKEKIPHQAPFAIQAAQLLGRAIGAGLFAITPAGERGMCCKAIKLGNARDSTSDSPQISASPYQLGLAPYASEPYNAQWNAPGLLRDKHTSRSSRILGETEVDEPWLGLWLPLNYQVDMGSSLAYDNGIWGEPYRLFAAKFLFVGVFFLFVLKVVFVIGSAVDRLCG

SEQ ID NO: 142315 - protein, 71 aa, Glycine max
  Coding DNA Sequence Number=SeqID_50630
MRGVATNVYSWKTSGKPKETGQNENSKFGSCDLYLRLRKVDKSGAFAPTYPPLERKSDLRSSSLRVNQVTL

SEQ ID NO: 142316 - protein, 117 aa, Glycine max
  Coding DNA Sequence Number=SeqID_50631
  Homolog annotation: Hit_ID=A0ST23; Match level="QueryCoverage=27%, HitCoverage=65%, E-value=2e-11, Identity=100%"; Hit description =Putative reverse transcriptase
DAGSRQARQGASAGVGGCRGWLNYAASEQIVLRVHHMRAIGAGLFAITPAGERGMCCKAIKLGNARVFPVTTLYIDGQCQACMPAVGKPVVPAALMNRPTRGERRFAYWALFRFLAH

SEQ ID NO: 142317 - protein, 75 aa, Glycine max
  Coding DNA Sequence Number=SeqID_50632
  Subcellular localization annotation: CTP_CleavageSite=31; ConfidenceScore=5.18e-01
MSVSACYQAFCLTDSKRMFIRITTPVFPPVSVTQKSGCGMTIICLRMSSGPPPLDDKRVQNDHNLSLRAIGHDCV

SEQ ID NO: 142318 - protein, 116 aa, Glycine max
  Coding DNA Sequence Number=SeqID_50633
MSGFTRDSPQISASPHQLDLAPYASGPYNAQWNAPGLLHDKHTFRSSRILGEMEVDEPWLGLWLPLNYQIDMGAMRTIDFVVILGMAFVDNWAVGKEKVGYWLSNDIVGLMGNLAV

SEQ ID NO: 142319 - protein, 125 aa, Glycine max
  Coding DNA Sequence Number=SeqID_50634
LRNGGNEIELFLHLFERFKNHSRSGRGGFVDPFAARTTNPRAGTERGGSAFGLKRERDEAEAAAVRRSMVSGSGFPRSGDLKERKTNRGKRNGTVTVCYCERVDRDVGLGAWRARGLAVLVPSNI

SEQ ID NO: 142320 - protein, 131 aa, Glycine max
  Coding DNA Sequence Number=SeqID_50635
AYAALISWNICLFAKACLRFSGENTETFSSLTSYPELRRSEFLIRGYVGARASLLSTTPPFVAMTQELVARGDTLRLSAPRHSVTPSVIDEQRPMWSSAPFSEMSAFSDEDFSSLTSYPELRRSEFLIGGY

SEQ ID NO: 142321 - protein, 289 aa, Glycine max
  Coding DNA Sequence Number=SeqID_50636
  Gene Ontology: Mol. function=glucosamine-1-phosphate N-acetyltransfera se activity; Cellular component=cytoplasm; Biological process =lipopolysaccharide biosynthetic process
  Homolog annotation: Hit_ID=Q5PKV8; Match level="QueryCoverage=100%, HitCoverage=63%, E-value=1e-133, Identity=83%"; Hit description =Bifunctional protein glmU [Includes: UDP-N-acetylglucosamine pyrophosphorylase (EC ...
  Homolog annotation: Hit description=2.7.7.23) (N-acetylglucosamine-1 -phosphate uridyltransferase); Glucosamine-1-phosphate N -acetyltransferase (EC 2.3.1.157)]
  Pfam annotation: Domain name=Hexapep; Domain location=271-288; Score =16.6; E_value=0.092; Accession=PF00132.15; Description=Bacterial transferase hexapeptide (three rep
  Pfam annotation: Domain name=NTP_transferase; Domain location=7-227; Score=-29.3; E_value=1.3e-05; Accession=PF00483.14; Description =Nucleotidyl transferase
  Pfam module annotation: Pfam domain module=Hexapep::NTP_transferase; Domain location=271-288::7-227
MSTSAMSVVILAAGKGTRMYSDLPKVLHSLAGKPMVQHVIDAATGLGAQHVHLVYGHGGELLQEKLAHNPLNWVLQAEQLGTGHAMQQAAPFFADDEDILMLYGDVPLIAEETLQRLRDAKPAGGIGLLTVVLDNPTGYGRIVRENGTITGIVEQKDASAEQLKIQEINTGILIANGADLKRWLAQLNNHNAQGEFYITDIIAMAHQEGRVINAVHPARISETDGVNNRLQLSTLERTYQREQAEKLLLAGVMLRDPARFDLRGTLQHGRDVEIDTNVIIEGNVTLGHR

SEQ ID NO: 142322 - protein, 156 aa, Glycine max
  Coding DNA Sequence Number=SeqID_50637
MTQLISDVIYCLLGSRPQDTQWTRRSQTGPWGFQLWLGASVSPTGCSFPQQGMAPTKTPNGPGEVQQGPGVSSSGIAPARHPVDPKKSNRVLELSSSNYGSLSVLRSTCHLPARASGPLLIELSSRSTAPPGKRRAKHHSSLGMAGSGQQTHRHHL

SEQ ID NO: 142323 - protein, 375 aa, Glycine max
  Coding DNA Sequence Number=SeqID_50638
  Gene Ontology: Mol. function=helicase activity; Cellular component =chromatin; Biological process=protein amino acid phosphorylation
  Homolog annotation: Hit_ID=A2Q378; Match level="QueryCoverage=96%, HitCoverage=23%, E-value=1e-111, Identity=52%"; Hit description =Putative uncharacterized protein
  Pfam annotation: Domain name=DUF889; Domain location=128-374; Score =406.0; E_value=5.5e-119; Accession=PF05970.5; Description=Eukaryotic protein of unknown function (DUF889)
  Subcellular localization annotation: CTP_CleavageSite=40; ConfidenceScore=5.16e-01
MSVVNTQSAAVYFLYGYGGTGKTFVWTTLSSGIRSNGGIVCTIASSGIASLLLPGGRTAHSKFAIPVPATENSTCNIHQGSELAELLKVTKLIVWDEAPMCHKFAFEALDKSLKDMQNNLPFGGKIMVFGGDFRQILPIVPKGNRSDIVHATINASYIWDHCQILKLTKNMRLLSNAPEQPNNEELKQFSHWLLDIRDGKIGQYNDEFSEITIPDEFLIKNYDDPIHAIVEATYPSLIDNYSDINYLQKRVVLASKKEIVDKINDYVLSLIPNHEKEYCSADSIDKSDELLNPAFALLPPEFLYSLQTSGIPNHKLKLKVGTPIMLLRNLDQTDGLCNGTRLIITKLGSNVIEAEVITGPNSGNRTYIPRINVSF

SEQ ID NO: 142324 - protein, 250 aa, Glycine max
  Coding DNA Sequence Number=SeqID_50639
  Homolog annotation: Hit_ID=Q84VI1; Match level="QueryCoverage=99%, HitCoverage=47%, E-value=5e-75, Identity=52%"; Hit description =Envelope-like protein
  Subcellular localization annotation: CTP_CleavageSite=42; ConfidenceScore=5.02e-01
MKDVPTSSNPNVSVPDVKKDVPTSPLQMLKHSLHPVKRDQLRKMIKPQRRLCTKGTRTAPGNLIDLEEVESDEEPIANRLAPGIAERLQSRKGKTPLKRSGRIKTMAQKKSTPITPATSRRSKTSKKAKTSGKKVPGNVPDAPLDNISFHSIGNAERWKFVYQRRLALERELGRAALDCKEIMDLIKAAGLLKTVSKPTDGVIDIDVSEHQIAKEITAKRVQHWPRKGKLSAGKLSVKYAILHRIGAANW

SEQ ID NO: 142325 - protein, 115 aa, Glycine max; identical to SEQ ID NO: 121005
  Coding DNA Sequence Number=SeqID_50640
  Homolog annotation: Hit_ID=A5BP71; Match level="QueryCoverage=65%, HitCoverage=19%, E-value=1e-11, Identity=46%"; Hit description =Putative uncharacterized protein
  Pfam annotation: Domain name=zf-CCHC; Domain location=88-105; Score =17.9; E_value=0.003; Accession=PF00098.14; Description=Zinc knuckle

SEQ ID NO: 142326 - protein, 40 aa, Glycine max
  Coding DNA Sequence Number=SeqID_50641
MKILSSGVEFTFEEGEELATQLAQATSARPGEQGCFLQKQ

SEQ ID NO: 142327 - protein, 132 aa, Glycine max
  Coding DNA Sequence Number=SeqID_50642
  Pfam annotation: Domain name=Transposase_23; Domain location=37-107; Score=-11.5; E_value=0.021; Accession=PF03017.5; Description =TNP1ENSPM transposase
MQSQRLALPPEPEVGPSAACVNTKGSCVDPSAVDPDTGDSDKYGLYIKENPPHLVALGRVYEGSTIVQTIPLLHDQVKVGVEEVKDADALVPVPTDEAILVGQALNTFLAWPTHLIKRLSEHGVVSPAKPCR

SEQ ID NO: 142328 - protein, 151 aa, Glycine max
  Coding DNA Sequence Number=SeqID_50643
MTFLGETSSQTIVNSTLAFIFSNGSIVHKDNGAYFQTSTPVPFRVPNVCDFQTLKTIIHNTFQLTNEQYLDEIYYRQPFTNTATMTPTHDALLYYNGRWNMPHQNEFVGYSFTGKNPKKFDIPSGCTMDELKDLIKQVASHEIPPYGVSAF

SEQ ID NO: 142329 - protein, 99 aa, Glycine max
  Coding DNA Sequence Number=SeqID_50644
MGDQEEIQEQMKADMSALKEQMASMMDAMLGMRQLMENNAATAAAVSSAAEADPTLPTTSPSQKSKSLPRGEGITGLCMCQSNAWTTSWPKYTSITAPV

SEQ ID NO: 142330 - protein, 52 aa, Glycine max
  Coding DNA Sequence Number=SeqID_50645
MAFIQQLEAVGTFLLPFFSHPASSEGLHVWFFFMEGRLLLGRIIERKNFFYE

SEQ ID NO: 142331 - protein, 78 aa, Glycine max
  Coding DNA Sequence Number=SeqID_50646
  Subcellular localization annotation: CTP_CleavageSite=31; ConfidenceScore=5.04e-01
MKKILGLQAPMELASSLPPSSPRRARLLPPEATAFWRKNLEGPNCVTMFSFDFRHVSKLHVWCDKGCQVPRSGHTGIL

SEQ ID NO: 142332 - protein, 266 aa, Glycine max
  Coding DNA Sequence Number=SeqID_50647
  Gene Ontology: Mol. function=two-component response regulator activity; Cellular component=cytoplasm; Biological process=two -component signal transduction system (phosphorelay)
  Homolog annotation: Hit_ID=A2WK68; Match level="QueryCoverage=77%, HitCoverage=24%, E-value=4e-64, Identity=65%"; Hit description =Putative uncharacterized protein
  Pfam annotation: Domain name=CreA; Domain location=8-151; Score =224.9; E_value=1.9e-64; Accession=PF05981.3; Description=CreA protein
  Pfam annotation: Domain name=Response_reg; Domain location=130-242; Score=122.9; E_value=9.1e-34; Accession=PF00072.15; Description =Response regulator receiver domain
  Pfam module annotation: Pfam domain module=CreA::Response_reg; Domain location=8-151::130-242
MKYKKLVAGLFLLAAGQLAHAEQIGSVDTVFKWLGPDHKIVVEAFDDPDVQNVTCYISRAKTGGIKGGLGLAEDTSDAAISCQQVGPIELTDKIKNGKSQGDVVFQKRTSLVFKKLQVVRFYDAKRNALPRIWLVEDEQSIADTLVYMLQQEGFDVTVFGRGLPALDAALHQIPDLAILDVGLPDISGFELCRRLLARHPALPLLFLTARSEEVDKLLGLEIGADDYIAKPFSPREVCARVRTVLRRLQKFSAPSPGGARWRVRAG

SEQ ID NO: 142333 - protein, 97 aa, Glycine max
  Coding DNA Sequence Number=SeqID_50648
MSGFTRDSPQISANLHQLDLAPYASGPYNAQWNAPGLFHDKHHVAFESYSRRNGGMAFVDNWVVGKEEPYRNGSHSMGFSLFLTLFICPVFSVVLVG

SEQ ID NO: 142334 - protein, 254 aa, Glycine max
  Coding DNA Sequence Number=SeqID_50649
  Gene Ontology: Mol. function=nucleoside-triphosphatase activity; Cellular component=chloroplast
  Homolog annotation: Hit_ID=Q2PMM5; Match level="QueryCoverage=100%, HitCoverage=15%, E-value=6e-57, Identity=81%"; Hit description =Protein ycf2
MIELRKLLDRYPTSELNSFWLKNLFLVALEQLGDSLEEIRSFAFGGNMLWGGGPTYGVKSIRSKKKYLNLIDLISIIPNPINRIAFSRNTRHLSHPKRRIFLANYQTITYSQPLRGANSFHFPSHGKPFSLRLALPPPSRGILVIGSIGTGRSYLVKYLATNSYVPFITVFLNKFLDNKPKGFLIDDSDDIDDSYDSDDIDRDLDMELELLTMMNTLTMDMMPEIDRFYITFQFELAKAMSPCIIWIPNIHDLD

SEQ ID NO: 142335 - protein, 442 aa, Glycine max
  Coding DNA Sequence Number=SeqID_50650
  Gene Ontology: Mol. function=DNA-directed DNA polymerase activity; Cellular component=nucleus; Biological process=nucleobase, nucleoside, nucleotide and nucleic acid metabolic process
  Homolog annotation: Hit_ID=A6T4J8; Match level="QueryCoverage=100%, HitCoverage=56%, E-value=0.0, Identity=95%"; Hit description=DNA polymerase
MKPHPDYRPPLKWVSLDIETSRHGELYCIGLEGCGQRVVYMLGPEPATPPDVGFSLVYVASRPLLLEKLNAWFAEHDPDVLIGWNVVQFDLRVLQKHAERYRIPLLLGRGNSELEWREHGFKNGVFFAQANGRLIIDGIEALKSAFWNFSSFSLEVVARELLGEGKAIDNPWDRMDEIDRRFHEDKPALATYNLQDCELVTRIFHKTEIMPFLLERATVNGLPADRHGGSVAAFSHLYFPRMHRLGYVAPNLGEIPPQASPGGYVMDSRPGLYDSVLVLDYKSLYPSIIRTFLIDPVGLVEGLAQPDDRHSTEGFLGARFSREKHCLPGIVGQIWHGRDEAKRQHNKPLSQALKIIMNAFYGVLGTSACRFFDPRLASSITMRGHAIMRQTKALIEAQGYDVIYGDTDSTFVWLKRPHSEAQAAEIGRKLVAYVNDWWAQEL

SEQ ID NO: 142336 - protein, 68 aa, Glycine max
  Coding DNA Sequence Number=SeqID_50651
  Homolog annotation: Hit_ID=UPI0000ECBAF8; Match level="QueryCoverage =60%, HitCoverage=48%, E-value=1e-16, Identity=100%"; Hit description= UPI0000ECBAF8 related cluster
MTEGCGEGFCLANLPGMQAWHWPSFYNVVTGKTLALPNLIALQHIPLSPAGVIAKRPAPIALPNSCAA

SEQ ID NO: 142337 - protein, 256 aa, Glycine max
  Coding DNA Sequence Number=SeqID_50652
KWPRGNLPQRDPGRIKRPKELVPLPSMIVTALGRAEHQQRFEAIKGWSFLRERRVQLRDDEYTDFQEGIVRRRWASLVTSMAKGQWIPFDADAIDQLLGYPLVLEEGQECEYGQRRNRRRVRIMRTNMTTLTQIWMTLLLSNIQPSDHNSDLPLPKCQLVYAILTRMSIHVAQLIADAIYIFEGMAPTRHPLDPDKSNRALGFSALITGLCQSFGVPVAPSKVIQPPITRDFIEKYCMQRQVQGDAPQAVDAPPPH

SEQ ID NO: 142338 - protein, 65 aa, Glycine max
  Coding DNA Sequence Number=SeqID_50653
MEKSINDLSTSEEIEIEEAKEHHLDEDALIPHVAPGRACRPWIFFINGVLCFLKINVSRMEKEER

SEQ ID NO: 142339 - protein, 119 aa, Glycine max
  Coding DNA Sequence Number=SeqID_50654
MATDEALERETKKARKEEHDQNKVEKKFVPTVKVRLKGICGPSSMSAKRSLNLAATHEQRLEDEYAKISAESEARERESRTSPIASQGQSNGGHLLRPQEDPRTSQLLSTYDRLNGPYD

SEQ ID NO: 142340 - protein, 193 aa, Glycine max
  Coding DNA Sequence Number=SeqID_50655
  Subcellular localization annotation: CTP_CleavageSite=38; ConfidenceScore=5.02e-01
MPISPCESIGWSVPSRHRGSAHKTPGGPRGTQQGPGVSSSGYEPLSVLQGACPPQQESHPQRHLVDPEKSNRALGFPARVTGLFQFYGALVPPASSCHCDIGIVPARHPVDPKKSNRVLELPALITGLCQFYGVLVAPSKVIRPPTNRAFIKKYCVPRQAQGETPQQPRDGRQRATNALPPPLEFTSADPQKG

SEQ ID NO: 142341 - protein, 104 aa, Glycine max
  Coding DNA Sequence Number=SeqID_50656
  Subcellular localization annotation: CTP_CleavageSite=52; ConfidenceScore=5.03e-01
MFLQKEVASGGSNLARLGGKLLPYFPINRGRSEGERGSALLIFNRSSSFVIRSSSFFGLQPVATLGKFGSDDFHPLAKLICWLSEPSAERNIPRLSARKNLEEG

SEQ ID NO: 142342 - protein, 137 aa, Glycine max
  Coding DNA Sequence Number=SeqID_50657
  Homolog annotation: Hit_ID=Q8H6W2; Match level="QueryCoverage=48%, HitCoverage=71%, E-value=2e-07, Identity=41%"; Hit description=Gag -protease polyprotein-like protein
MASSNSLFPEGNSIHWPPIFNGEGYHYWKTHMQFFIQAIDLNIWEAIEIGPYIPIVVDASTSTTTQKPRCRSKLHDVESRFIQGVLMITKMMTKTLREYKRMISRTRFKNQEKFDFKIQEKMNSRFKKRNQEDFTRE

SEQ ID NO: 142343 - protein, 152 aa, Glycine max
  Coding DNA Sequence Number=SeqID_50658
  Gene Ontology: Mol. function=chitin binding; Cellular component =extracellular region; Biological process=chitin metabolic process
  Homolog annotation: Hit_ID=UPI00006A17C9; Match level="QueryCoverage =84%, HitCoverage=100%, E-value=5e-10, Identity=28%"; Hit description= UPI00006A17C9 related cluster
  Subcellular localization annotation: CTP_CleavageSite=54; ConfidenceScore=5.37e-01
MLVRMIRTRLFAVARVKSCLGMHSSCVIASLSGCARTIGRPSISGGRRTLSSLKVRMRSPLKVRTRSPLKARACSPLKFRTCRPLKARVCSPLKEKVCSPLKVRTCSPLKARMCSPLKWRTCSPLKARTCSPQKVRARTCCPLKARTCSPLK

SEQ ID NO: 142344 - protein, 149 aa, Glycine max
  Coding DNA Sequence Number=SeqID_50659
MPERGEAEETLLVPSEVSLRIAGARGRVLSGRCGCSVEPRHGIESSKWAIFGKQNWRCGMNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 142345 - protein, 114 aa, Glycine max
  Coding DNA Sequence Number=SeqID_50660
GENVNPYPRKQKKKRRKISNQRKREGKFPIKGKKKGKKIPNQRVGESEKKGNKIPSQRKKSGRKRKERKENSKSKKKEWEKVKKKKAPGQRNQKKCAERSLDRTMSEQYRIVTK

SEQ ID NO: 142346 - protein, 250 aa, Glycine max
  Coding DNA Sequence Number=SeqID_50661
MAEKTKKKLEEAAQTRSTAAVIDPPSPIRQHVKWKMARTKKTGQMTSEAAKEIAEKIASQGSFVPHGRQDVLTAAIGRPKHPGRVRAVGAGVTIKKYFGLASQTSRTSSSMAPKELEQLTQQIWDQLEESITEKVTQQLMLSFSQMQSQLQSQMQSQGLALPPEPEVGPSTARVSTKDSCVDPSGNDPDTGDSDKCGLYIKENPPCLVALGRVYEGSIIVHNIPLLHDQVKVDVEEVKDADAPVPVPTDK

SEQ ID NO: 142347 - protein, 16 aa, Glycine max
  Coding DNA Sequence Number=SeqID_50662
MRPAQDVKEALLGGNP

SEQ ID NO: 142348 - protein, 72 aa, Glycine max
  Coding DNA Sequence Number=SeqID_50663
MLTDKSKEDRLRHWTLSQCALLRVSEARLTGVLSKGGKMRGVGTNVYLWKTSEKPKETGQNENSKFGSCIYA

SEQ ID NO: 142349 - protein, 215 aa, Glycine max
  Coding DNA Sequence Number=SeqID_50664
  Homolog annotation: Hit_ID=A5B0Q3; Match level="QueryCoverage=79%, HitCoverage=8%, E-value=8e-08, Identity=28%"; Hit description =Putative uncharacterized protein
  Pfam annotation: Domain name=G-patch; Domain location=127-156; Score =5.8; E_value=0.037; Accession=PF01585.14; Description=G-patch domain
  Subcellular localization annotation: CTP_CleavageSite=30; ConfidenceScore=5.36e-01
VLINNGSNLNVMPKSTLEKLPFNASYLKPSSMVVRAFDGARRELPVGTPMDPFSGSRSLYTPSEIEVRSGRAFGHRIGRGRHLGELPMPILYAIYGGRRGVVRNRLPIFRGGKHFLRGLLLWATLPPGMGLGKDNGGITSLISAKGNHGKFGLGYKPTQAYIRKSIAGRKNGGQGSRLRQEAKGSPPCHISRSFISTGLGDEGQVVAICEDDAPV

SEQ ID NO: 142350 - protein, 80 aa, Glycine max
  Coding DNA Sequence Number=SeqID_50665
MVRNHLLKELANFSEDYIKLFGGTEIFEELRMSLLVDGLIKVTTDEWMDITDMGHVYLKERCPLPSASLLWSSNCHPHAK

SEQ ID NO: 142351 - protein, 158 aa, Glycine max
  Coding DNA Sequence Number=SeqID_50666
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=32%, HitCoverage=50%, E-value=5e-24, Identity=100%"; Hit description=LacZ protein
MEDCKSVSTPMNQKEKFSKEEDVDNIDEGYCGSLIECLIPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142352 - protein, 208 aa, Glycine max
  Coding DNA Sequence Number=SeqID_50667
MGEVEEVQEKMKADMEAMKEQMATMMEAMMSMKKIMEANAVIVAATSAVAKVNPMLPSGLKQMNHPTSNMVGKDLGSTDDPMMCKFKTSTPSRHMACLPNYTPPNVAYIPNEDVNNSTPILIKSQQPQSDHAHVSRPMLETHGMPHHNLADFEPCLGYATEGQAVGGIPLKNTLEGPQCHPQPQPSHSIVVKNPHAMAEMGKRKGSGP

SEQ ID NO: 142353 - protein, 46 aa, Glycine max
  Coding DNA Sequence Number=SeqID_50668
MDTRFREIGDPINGVQRGWGQEPVFKDSPSECGGGTATVRYGLISK

SEQ ID NO: 142354 - protein, 57 aa, Glycine max
  Coding DNA Sequence Number=SeqID_50669
MISFRTYETFMKFQEGNDKGKSMKILQKKSNPMILPREWKASKREIIPDRQHYWLSR

SEQ ID NO: 142355 - protein, 118 aa, Glycine max
  Coding DNA Sequence Number=SeqID_50670
  Gene Ontology: Biological process=transposition, DNA-mediated
  Homolog annotation: Hit_ID=Q1J7G7; Match level="QueryCoverage=37%, HitCoverage=75%, E-value=3e-14, Identity=75%"; Hit description =Transposase
MGVFEVLQWLLFLSAVPPVQLLTGWCVTAKAPPDISAGKCSGRVPFAIQAAQLLGRAIGAGLFAITPAGERGMCCKAIKLGNARVFPVTTLHILHKYANEDVSLGLDVDHIMMEDSIV

SEQ ID NO: 142356 - protein, 75 aa, Glycine max
  Coding DNA Sequence Number=SeqID_50671
MEREERERVIESLHAEAMKWMDRFAFTLNGSQELPRLLARAKAMADVYSAPDEVHGLFDYCQHMVKLMSHTIRSR

SEQ ID NO: 142357 - protein, 91 aa, Glycine max
  Coding DNA Sequence Number=SeqID_50672
VDSRGSHLNDQAEETLGPTKIGENHSKCINLTQDFFLGMKVASAQDFVGNQRERTTLGCGRGLTFSPWVKVYDKLGFWLKACRTAGHDICQ

SEQ ID NO: 142358 - protein, 161 aa, Glycine max
  Coding DNA Sequence Number=SeqID_50673
MAPTRHPLAPDKSNRALGFPALITGLCQSFGVPVAPTKVIRPPITRAFIEKYCTQRQAQGDAPQAAGAPPPPHQAGQAGAFDMEQYLRHLYQMSLSMQSQGFASFSCPTPDQFRAEVAWPGDWPEAQAGEAPPEAPGDGEEAHEDEEMADLLDFLGGSGDT

SEQ ID NO: 142359 - protein, 445 aa, Glycine max
  Coding DNA Sequence Number=SeqID_50674
  Homolog annotation: Hit_ID=Q2HW90; Match level="QueryCoverage=48%, HitCoverage=41%, E-value=3e-24, Identity=34%"; Hit description =Putative uncharacterized protein
MDVLALLIFGVVLFPNVDGLVDLAAIDAFLAYHHSKESPVVAVLADLFDTFDRRCEKSSARIICCLPALCVWLVSHLFQQDTRHPCPLLSHRSCTEKRRIDWDQLLAGIGGRTISWFPRWKEGKEGVLFSCGRYPNIPLVGTRGCINYNPALAIRQLGYPMRGAPTEESMSPFLVRDFGAQNSKTIQRIHKVWETPLKKDQELRGIRNGIIGGYHEWLKVHIRGLDWLAKLKVVSKESFESTGRGRGSPSSQKRKECAGLREENETTARALEQETKKARKEEYGRNKFRGALWGSNNELKLRREERDQSRAHSMVLKEELVACSRSKRSLSQHLCETETNMLAIIAKYQEELGLATAHEHRIADEYAQVYTEKEARGRVIDSLHQEATMWMDQFALTLNGSQELPRLLAKAKAMANTYSTPEEIHGLLGYCQHMIDLMAHIIRNR

SEQ ID NO: 142360 - protein, 174 aa, Glycine max
  Coding DNA Sequence Number=SeqID_50675
  Subcellular localization annotation: CTP_CleavageSite=57; ConfidenceScore=5.41e-01
MPKVKLFRNPKKSAPQPQCHGPLTQAPTHFVPAINPKISSPPSDSTQAPEVLTGNVPLSHVSTSEVPQEDETTRRHVGRESTQCWTVEAIDSEETIKKIKVKVRGVNSLPRELRIIVNFDDQGQAIGEAQALLAGFLGTLAADCKLFPMDYDRWSGPSGVPKAYFDDCFETILK

SEQ ID NO: 142361 - protein, 277 aa, Glycine max
  Coding DNA Sequence Number=SeqID_50676
  Gene Ontology: Mol. function=DNA-directed RNA polymerase activity; Cellular component=chloroplast; Biological process=transcription, DNA-dependent
  Homolog annotation: Hit_ID=Q09X27; Match level="QueryCoverage=94%, HitCoverage=24%, E-value=1e-104, Identity=62%"; Hit description=DNA -directed RNA polymerase subunit beta''
  Pfam annotation: Domain name=RNA_pol_Rpb1_4; Domain location=95-166; Score=5.2; E_value=0.0031; Accession=PF05000.8; Description=RNA polymerase Rpb1, domain 4
MEVLMAERANLVFHNKVIGGTAIKRLISRLIDHFGMAYTSHILDQVKTLGFRQATDTSISLGIDDLLTIPSKGWLVQDAEQQSFILEQHHHYGNVHAVEKLRQSIEIWYATSEYFRQEMNPNFRMTDPFNPVHIMSFSGARGNASQILLYEHQMLDILHADLLKLVQHIVYVERIVTIYTEVHDAFAVRNQDIGIGLINRFKTLQTQPISIRTPFTCRNTSWICRLCYGQSPTHGHLVELGEAVGIIAGQSIGEPGTQLTLRTFHTGGVFTGGTAEQ

SEQ ID NO: 142362 - protein, 178 aa, Glycine max
  Coding DNA Sequence Number=SeqID_50677
MSHHSSNVNGEGTSHKDPLSRILDELSSLKLWKEKQERKEKAKKRVEEISQDERKKIREEERRKIMKEMKREKHASYSSHNSCKSVSEEHVTITKEGICHILDLTPIEEKRKESLKRLTLTGSYFHGKDNVEANLDWEIRVEQQLKKKSTSKSYGSHSYPKKDQGQGILGVTPSKPKR

SEQ ID NO: 142363 - protein, 100 aa, Glycine max
  Coding DNA Sequence Number=SeqID_50678
MWSSAPFPEMSSSSDGDFSSLTSYLELRRGGRPDDTRRYLTVIRTLLSSRGGGPDDSRDTNLVFCTLVSSRGGGPDDTRSHLRYPQFCHPATLVNREERN

SEQ ID NO: 142364 - protein, 45 aa, Glycine max
  Coding DNA Sequence Number=SeqID_50679
LYGLRNNVLSTPNMSRNFTDCLTMSVKDLEVIKRGSHPNKQMVPE

SEQ ID NO: 142365 - protein, 189 aa, Glycine max
  Coding DNA Sequence Number=SeqID_50680
MSHHSSSVNGKGTSHKDPLSRILDELSSLKLWKEKQERKEKGKKRVEEISQDERKKIREEERRKIMKEMKREKHAYYSSHNSCKSLSEELRDYYEGRHRSHLRPHSHRREKERKPQEANIKLSYFHGKDNVEANLDWEIRVEQQLKKKSTSKSYGSHSYPKKDQGQDILGVTPSKPKDDKGKTIEKQAL

SEQ ID NO: 142366 - protein, 122 aa, Glycine max
  Coding DNA Sequence Number=SeqID_50681
  Subcellular localization annotation: CTP_CleavageSite=71; ConfidenceScore=5.22e-01
MAEQAKQVFDVEDPCDQRCQMGTQPNSPPPPPPSTGVASHSSSPPLKRTRKASCLRSLATRPIGAEGPLVHVDPVTGKVDVLHNKKFRTYLGIVARDKVDVTYENWKHVPITQKDLIWEDIQ

SEQ ID NO: 142367 - protein, 86 aa, Glycine max
  Coding DNA Sequence Number=SeqID_50682
MTIICLRRSSGSPPMEDKKAQNDHNLSLRAIGHDRLRMAKRCRITIICLRMSSGLPPLDDKMRTITIICLCVPSDLIVSGWRKGAE

SEQ ID NO: 142368 - protein, 69 aa, Glycine max
  Coding DNA Sequence Number=SeqID_50683
MGEVEEVQGKMKADMEAMKEKMATMMAMMSMRKIMEANAVTFAATSTVAKVNPITPSGLNQMNHPTLDM

SEQ ID NO: 142369 - protein, 139 aa, Glycine max
  Coding DNA Sequence Number=SeqID_50684
MGSYGGHSSTGEGATTVWLHLEHPSAAYDRWMHFADHVLAVGELCLVPGQVSADYMEWFFRISHPFVIPTQAGDQPRDAPAADPEEYMQPPSPQVPVAFDPPPHAVDDYDGYEAIAQRLERVLNLRIVTAGTELYDIIH

SEQ ID NO: 142370 - protein, 148 aa, Glycine max
  Coding DNA Sequence Number=SeqID_50685
  Gene Ontology: Mol. function=aminoacyl-tRNA hydrolase activity
  Homolog annotation: Hit_ID=P0AAW3; Match level="QueryCoverage=91%, HitCoverage=61%, E-value=2e-68, Identity=83%"; Hit description =Uncharacterized protein ybhP
MPYTRKGITATPFLLSRYPIEHYENRGGGVDGAEKRGVLYCRIVPPMTGKAIHVMCVHLGLREAHRQAQLAMLAEWVNELPDGEPAGLDEIFTRAHGRPARTFPVQFPLLRLDRIYVKNASASAPTALPLRTWRHLSDHAPLSAEIHL

SEQ ID NO: 142371 - protein, 119 aa, Glycine max
  Coding DNA Sequence Number=SeqID_50686
MPPKDLEQLTQQIRDQLEESITEKVTRKMMASFSQMQSQFQFQMQSQGLALPPEPECNRQKGITECGYYVMHWMSTIILGSFRNNWETYFNEVRPLEAARFKALRIQWAQYYLKVRNQT

SEQ ID NO: 142372 - protein, 23 aa, Glycine max
  Coding DNA Sequence Number=SeqID_50687
MKMSRKFSKKFSSKFKVFKPWWS

SEQ ID NO: 142373 - protein, 146 aa, Glycine max
  Coding DNA Sequence Number=SeqID_50688
  Gene Ontology: Cellular component=integral to membrane
  Homolog annotation: Hit_ID=A4WEI7; Match level="QueryCoverage=100%, HitCoverage=70%, E-value=5e-65, Identity=84%"; Hit description=SH3 domain protein domain protein precursor
TNAETNYGQVRDSSGRTSWIPLKELSTVPSLRTRVPDLENQVKTLTDKLNNIDGTWNQRTAEMQQKVAQSDGVINGLKEENQKLKNELIVAQKKVNAANLQLDDKQRTIIMQWFMYGGGVLGVGLVLGLVLPHLIPSRKRKDRWMN

SEQ ID NO: 142374 - protein, 72 aa, Glycine max
  Coding DNA Sequence Number=SeqID_50689
MALGVATKVYSRKTSEKSERCGLRTLSVKGSGVVFTHGEGIGTPRVRHKRRLFRNLHLTNKSGKDHFKALDL

SEQ ID NO: 142375 - protein, 38 aa, Glycine max
  Coding DNA Sequence Number=SeqID_50690
MEVDEPWLGLWLTLNYQVDMGASGVRHWKCDRQALWLI

SEQ ID NO: 142376 - protein, 341 aa, Glycine max
  Coding DNA Sequence Number=SeqID_50691
  Gene Ontology: Mol. function=adenylate cyclase activity; Biological process=response to stress
  Homolog annotation: Hit_ID=A8G800; Match level="QueryCoverage=41%, HitCoverage=100%, E-value=2e-73, Identity=99%"; Hit description=OsmC family protein
  Pfam annotation: Domain name=OsmC; Domain location=22-139; Score =119.7; E_value=8.4e-33; Accession=PF02566.10; Description=OsmC-like protein
MSIEKVVYRAHATATGGRDGRATSSDGVLDVKLGVPREMGGAGGEVTNPEQLFAAGYSACFLGALKFVAAKEKVKIPAEAKIDGTVGIGEIPNGFGIEVQLDISLPGIERSVAEDLVKKAHVVCPYSNATRGNIDVTLNVKTATPSPEPPRYMNKVKSLSQQNLSLLLAIYIGIFLNLHRYRPVHVLHHAAGIARRPAVLSHRRFAAGVDFGCRQLLHDVFQRGDRLRHRGFGDDHRHRSVERGGRPALRAVDGGAQRLAAAADLEKQPALHPDRTAENPRSSHQAAAGLAGGGGAGLAAAAHAGRRAERAREALQRRSAELRRRGGALVSAVQLAVGAGA

SEQ ID NO: 142377 - protein, 16 aa, Glycine max
  Coding DNA Sequence Number=SeqID_50692
APVSLALARPRRARCD

SEQ ID NO: 142378 - protein, 341 aa, Glycine max
  Coding DNA Sequence Number=SeqID_50693
MVTPMAKFDPEIVLEFYANAWPTKEGVRDMRSWGRGQWIPFDADALSQFLGDPLVLEEGQLCEFNQRRNRADGFDEEAIAHLSCTPGQDFAWTTTGRRVRIMRTSMTTLTQTWMTLLLSNVLPSDHNSNLPLPKCQLVYAILTRMSVLVTQVIVDAIYLFADMAPTRHPLDPDKSNRALGFPALITGLCQSYGVPVTPSKVIRLPITRAFIEKYCTPRQTQGDAHQAADAPPPPRQADPAGSLGMERYLQHLVRQQAANHHGQVQIHECLYRFSLSQQGQGSTPFLCPTLEQFGAEVAWPGDWPDAQSGEEPAGSPGEAKESRMDEDMTDLLDFLGGSGAM

SEQ ID NO: 142379 - protein, 190 aa, Glycine max
  Coding DNA Sequence Number=SeqID_50694
MAAHKVKLSGKPGPLCPVQYKRLEKEFHFANQWTPIWCGDNMGLRCEVHMWGNKVESKDHNIGPRHSIHNPVPPHKRVQRGRPKKNRRRSVDEDNVTGHKLKRKLVEFTCGRCGQTNHNIRNEQALNEAEEVAAHVQQDPVEINLSQPHLSQDSDMELMVPATIVPPIARNKLTITRAKQRKVADKDDAV

SEQ ID NO: 142380 - protein, 121 aa, Glycine max
  Coding DNA Sequence Number=SeqID_50695
  Subcellular localization annotation: CTP_CleavageSite=29; ConfidenceScore=5.42e-01
VSSLVTDVWGANTFPARKYNSRTFHLKVRRSRLFRFIRRFPQINVGGDSARIPFMEHASRESRVALPPKGRSSIILGDGQIPSQIQRQRQIEGWTRVEARPMIDGSSSHVKLRTSGKCCWE

SEQ ID NO: 142381 - protein, 51 aa, Glycine max
  Coding DNA Sequence Number=SeqID_50696
MTKLGLCLSSGPPPLDDKRGQYAFIGPAPDKSKALAPTYPPMRNSDLRSSR

SEQ ID NO: 142382 - protein, 89 aa, Glycine max
  Coding DNA Sequence Number=SeqID_50697
MEVEVFDCWGIDFMGPFPSSDVVATPRNDAKIVRKAKEKRRGEAPSTREYAKEEGASPPRIALDKKLEEDALMEEKKERRGEHEIEGIK

SEQ ID NO: 142383 - protein, 130 aa, Glycine max
  Coding DNA Sequence Number=SeqID_50698
ISERKNRGQGSRLGQQAEGAPPCHISRSFISAGLRYDGQVATICEDDSPRRSDLVRSCPPGFGLGNWRVEERPDFYATSIISDDKSLEGTNTRDPAVDFEQEAGRMKSEEDEDVGLPPKLERIIAQEDRK

SEQ ID NO: 142384 - protein, 133 aa, Glycine max
  Coding DNA Sequence Number=SeqID_50699
MLATRTRGLRSLRDLTQHLTDELTTAMPAFPGIPLSFSLRGFAACHPGKDYWGIYPFAPQLVSQCKSAHRVLSPWCSFHLYAFTAPNRKTGNSLCPPVLQLEFSTACHRVEPWDLTANLKKPPTDALRPIIPG

SEQ ID NO: 142385 - protein, 89 aa, Glycine max
  Coding DNA Sequence Number=SeqID_50700
MKHSSRLESGGHIVATYPSAGGRRVTRGMPVPRKEYVRSRRQRLFEENVGKTGKDAIYELLSERLGSCIYAPGRVFPFAPTYSSIVMRK

SEQ ID NO: 142386 - protein, 138 aa, Glycine max
  Coding DNA Sequence Number=SeqID_50701
QPTYLALLILLPVAAASGDKSCLTGATLPEGRKADRYPVSGRVGTGERTRELPGGNACLWKNASNAAFLRFLAFCWPFAHMFFPALSPDSVDNRITAFEKRKSAQYANRLSPRVGRFINAAGTTGFPTGKRAVSATQL

SEQ ID NO: 142387 - protein, 61 aa, Glycine max
  Coding DNA Sequence Number=SeqID_50702
  Subcellular localization annotation: CTP_CleavageSite=29; ConfidenceScore=5.12e-01
MVVEVLAIKISIPANIGSNQAQSFKKMILSSQGQSMEVTSLRKLGQKMDQVFISSLTTANT

SEQ ID NO: 142388 - protein, 111 aa, Glycine max
  Coding DNA Sequence Number=SeqID_50703
PFVQVKRSFAIGAGAVTSFGYRKDRNGQWLKKDALPPQDERTPSPPPQREDSALLNEVLTELRGLRSYVGEHFDSLDTRFAGMDIRLTQVEEDVSFIRTCFDPPPPPPSSS

SEQ ID NO: 142389 - protein, 52 aa, Glycine max
  Coding DNA Sequence Number=SeqID_50704
MSRNFTDCVTMGVKYLEVVKQGSHPNKQMIPGRNYGMTIAPLYLSFIGDKQE

SEQ ID NO: 142390 - protein, 66 aa, Glycine max
  Coding DNA Sequence Number=SeqID_50705
MASYGVASPFIFLLLHSAAIRPQEAKKSIDEEDPRPTRFTWSYIRSHLAALEQIPRKIPMKNAKLL

SEQ ID NO: 142391 - protein, 92 aa, Glycine max
  Coding DNA Sequence Number=SeqID_50706
MVEEEPQLFVVLVVTAVVVLEEEHMACLDQQHSKKEGQAVVVVEDLSISDLDDSSNLDCIYCLKGHNYSVVVDFAVEEVYYKCLQHKLQIAH

SEQ ID NO: 142392 - protein, 69 aa, Glycine max
  Coding DNA Sequence Number=SeqID_50707
MKNKKVDVAGVSLSEALSALSELGESGGESVKHLHVWRIISLLSESFVFSRAKRAHWKITYSCLVRKWR

SEQ ID NO: 142393 - protein, 98 aa, Glycine max
  Coding DNA Sequence Number=SeqID_50708
MVHDIFVKVKLEVTGTSAALNVFGSRRSNDMVTSILQLDSMNLFVKARAWFNPITQGMEILIANTSSTFHRDERLGNTHAVHGKCNYEIEMPEETSLS

SEQ ID NO: 142394 - protein, 155 aa, Glycine max
  Coding DNA Sequence Number=SeqID_50709
  Homolog annotation: Hit_ID=Q2HW90; Match level="QueryCoverage=91%, HitCoverage=33%, E-value=5e-15, Identity=32%"; Hit description =Putative uncharacterized protein
MGQLQRQAFRKAYGKIWDLAMVEVSTEAIASLAQYYDQPLRCFIFGDFQLSPMVEEFEEILGCPLGGRKPYLFSGFYPSLARIFKIVQISAHELDPKASRKWGDILALLIFGGVLFPNVDGLVDLVAIDAFLAYHNHKESPVVAMLADLYDTFDR

SEQ ID NO: 142395 - protein, 69 aa, Glycine max
  Coding DNA Sequence Number=SeqID_50710
EKMKNKKVVVAGVSLSEACALSENHPLSEALSPLSKLGESAKHLRAQRIISSLSKSFVFSRAKRAQLAQ

SEQ ID NO: 142396 - protein, 247 aa, Glycine max
  Coding DNA Sequence Number=SeqID_50711
MGDQEETQEQMKADVSALKEQMASMMEAMLGMRQLMEKNVATAAAVSSAAEADPTLLVTAHHPPPNAVGRGRSTLGHNNNPHLGYNRAAYPCRLPPNYTPPIMHDDADHREYAQGDVDFYPPIPVKGPAPNTLPHPNLTAQPIFLSTEGPPPTAEEKRKLDLLEERLRAFEGFGDYPFVDMTDLCLVSDVVIPPKFKVPIFDNLARVAVVWYTNLEASRILTWKDLITAFLRQYQYNSDMAPDRTQL

SEQ ID NO: 142397 - protein, 212 aa, Glycine max
  Coding DNA Sequence Number=SeqID_50712
  Gene Ontology: Mol. function=transferase activity; Cellular component= cytoplasm; Biological process=cell redox homeostasis
  Homolog annotation: Hit_ID=P0ACA5; Match level="QueryCoverage=99%, HitCoverage=99%, E-value=1e-109, Identity=93%"; Hit description =Stringent starvation protein A
  Pfam annotation: Domain name=GST_C; Domain location=101-194; Score =63.4; E_value=7.6e-16; Accession=PF00043.16; Description=Glutathione S-transferase, C-terminal domain
  Pfam annotation: Domain name=GST_N; Domain location=9-81; Score=89.4; E_value=1.2e-23; Accession=PF02798.11; Description=Glutathione S -transferase, N-terminal domain
  Pfam module annotation: Pfam domain module=GST_C::GST_N; Domain location=101-194::9-81
MAVAANKRSVMTLFSGPTDIYSHQVRIVLAEKGVSFEIEHVEKDNPPQDLIDLNPNQSVPTLVDRELTLWESRIIMEYLDERFPHPPLMPVYPVARGESRLYMQRIEKDWYSLMNTIQTGTAAQADAARKQLREELQAIAPVFTQKPYFLSDEFSLVDCYLAPLLWRLPVLGVELVGAGAKELKGYMTRVFERDSFLASLTEAEREMRLGRG

SEQ ID NO: 142398 - protein, 172 aa, Glycine max
  Coding DNA Sequence Number=SeqID_50713
MGEVEEVQKQMKADMEAMKKQMATMMEAMMSMKKIMEANAVAIAATSAVAKVKPMPPSGLNQMNHPTSAMVGKDLGSTSGPYYVQIQNKHAFPPYGLPPNYTPPQCGIYSQYAIEGQAVGGIPLQNTLEGPQYHPQPHNSHSTTVKNPHAMAEMGKLDHLEERLRAIKEGED

SEQ ID NO: 142399 - protein, 222 aa, Glycine max
  Coding DNA Sequence Number=SeqID_50714
MPTIIISSRYNGGAPPGNQFNRDQGGPFIRPQQQVPSLYDRTTKLEETLAQFMQVSMSNQKSKESAIKNLEVQVGQLANQLADRSSSSFTANAEKNPKEECKAVMTRSRMAIQGDDSEARKKMEEHKQQLAPKPALEPISDFVELEEINEETEDDKEEETPIKVEEKERIKEEEKEKEKKLKNEKQKWKVVDDEMRKGRSEANTDKKKDTTPNEGKEVPYPL

SEQ ID NO: 142400 - protein, 314 aa, Glycine max
  Coding DNA Sequence Number=SeqID_50715
  Gene Ontology: Mol. function=motor activity; Cellular component=cell projection
  Homolog annotation: Hit_ID=UPI00016621D1; Match level="QueryCoverage =98%, HitCoverage=41%, E-value=4e-17, Identity=31%"; Hit description =UPI00016621D1 related cluster
DYTSLTLRGLHALAFRGLHFHAFRGLHVFTIRGLHVLAIRRLHALAVRGLHILTIRGLHVLAFRGLHVLAFKGLHVLVFIELHVLAFRGTHILVIRGLHDYTSSSLEVLHALAFRGLHVHAITKLHVLAIRGLHGVAFRGKHVLTIIGLHVLAFTGLHVLAFRGLHILVIRRLHVLAIRGLHVLTFIGLHVLTYTRLHTLAFKGLHVLAFRGLHVLAFRGLHVLTFRGLHLLILRGLHLPTFRGLHALAIRGLHALAIRGQHALTFRGLHVLTFRGLHVLAFRGLPVHTFRGLHVIPFRGLHVLAFRGLHVLTF

SEQ ID NO: 142401 - protein, 98 aa, Glycine max
  Coding DNA Sequence Number=SeqID_50716
MGSTAADTGRWCAIKGLDDAPQPKSKASARWIVVKCNRQKGSTECGYYVMHWMSTIILGTFKNNWEAYFNDPRPLETERLKALRIQWAQFYLRVRVQA

SEQ ID NO: 142402 - protein, 217 aa, Glycine max
  Coding DNA Sequence Number=SeqID_50717
  Homolog annotation: Hit_ID=Q6WAY6; Match level="QueryCoverage=93%, HitCoverage=34%, E-value=7e-10, Identity=26%"; Hit description =Putative uncharacterized protein
MGTRGCINYSPVLAIRQLGYPMRGAPLDESIAPFIARGFSDHNARVLQGVHKAWDAALRKDRELRGSSNGIIGGYHKWLRVRTQGLDWLPNLKTVRDDEVKASEESDEVQALKAELERARVVEEKFKSIAIKGSSSKLKLRRGFFYSSRVKGMILKDELKAYLRSKRNLSQQLSETEGNMWAIIDECKEKLNLAATHEQRLEDEYAKISAESEARER

SEQ ID NO: 142403 - protein, 140 aa, Glycine max
  Coding DNA Sequence Number=SeqID_50718
MVGYIPSSFADLVFSGGRIEVGLRRGKFDYPALMNRKPGANGDKKDGGTHVVTVVPTWPNFPTAQQYQYSANINPSHYPPPYQPRTPNHPQRPPLNQPQNLPAAHSIPNTTLNMNQKHQPGKEFSKKEACIIHPNSGVVC

SEQ ID NO: 142404 - protein, 56 aa, Glycine max
  Coding DNA Sequence Number=SeqID_50719
MVDEEDIKDPSLDPDILDSDQGEEVIDFQLSPQLRTNVLYAVATMDSKVWILYSRD

SEQ ID NO: 142405 - protein, 280 aa, Glycine max
  Coding DNA Sequence Number=SeqID_50720
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLANWSSTAVAAALELVDPPGCRNSMVTSYPEIKVPSSIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142406 - protein, 253 aa, Glycine max
  Coding DNA Sequence Number=SeqID_50721
  Gene Ontology: Mol. function=oxidoreductase activity, acting on NADH or NADPH; Cellular component=mitochondrion; Biological process =electron transport
  Homolog annotation: Hit_ID=A7QCZ6; Match level="QueryCoverage=35%, HitCoverage=81%, E-value=4e-43, Identity=97%"; Hit description =Chromosome undetermined scaffold_79, whole genome shotgun sequence
  Pfam annotation: Domain name=Complex1_49kDa; Domain location=75-253; Score=-17.4; E_value=1.7e-11; Accession=PF00346.10; Description =Respiratory-chain NADH dehydrogenase,
SNPEYYVAHDGSKQEVSLLPIPADGATLKTCPSERIDLGLEESFRKKGCFVRIFKPNPAKASVNQQPVIPELEPPLLDDNTRRAELAVRLRANWWGIAYNERILDSFVRSQLAIERHIEAALVADGYSPQVVFERRHMIRGFLFYPEGHALSENAYAAGKMTTGSSVYSTSIHHFELYTEGFSVPAPSTYTAVEAPKGEFGVFLVSNGSNRPYRRKIRAPGSAHSQGLDSMSKHHMPADVVTIIGTQDIVSGE

SEQ ID NO: 142407 - protein, 518 aa, Glycine max
  Coding DNA Sequence Number=SeqID_50722
  Gene Ontology: Mol. function=aminoacyl-tRNA ligase activity; Cellular component=cytoplasm; Biological process=tRNA aminoacylation for protein translation
  Homolog annotation: Hit_ID=A8GIB4; Match level="QueryCoverage=100%, HitCoverage=90%, E-value=0.0, Identity=92%"; Hit description=Prolyl -tRNA synthetase
  Pfam annotation: Domain name=YbaK; Domain location=247-387; Score =34.8; E_value=5.1e-08; Accession=PF04073.6; Description=YbaK  prolyl- tRNA synthetases associated domain
  Pfam annotation: Domain name=tRNA-synt_2b; Domain location=49-219; Score=231.3; E_value=2.3e-66; Accession=PF00587.16; Description=tRNA synthetase class II core domain (G, H, P, S and T)
  Pfam module annotation: Pfam domain module=YbaK::tRNA-synt_2b; Domain location=247-387::49-219
MRTSQYLLSTLKETPADAEVISHQLMLRAGMIRKLASGLYTWLPTGLRVLKKVENIVREEMNNANAIEVSMPVVQPADLWQESGRWEQYGPELLRFVDRGDRPFVLGPTHEEVITDLIRNEISSYKQLPLNFFQIQTKFRDEVRPRFGVMRSREFLMKDAYSFHTSQESLQETYDAMYEAYSKIFSRMGLDFRPVQADTGSIGGSASHEFQVLADSGEDDIVFSTGSDFAANIELAEAVAPAAPRAAAGEELRLVDTPNAKTIVELVDQFQLPVEKTVKTLMVRATEESGHKLVALLVRGDHELNEVKAEKLAQVATPLTFATEEEIRAIVGAGPGSLGPVNLPMPVVADRSVAAMSDFGAGANVDGKHYFGINWERDLPLPQVADIRNVVDGDASPDGQGTLLIKRGIEVGHIFQLGTKYSEAMKATVQGEDGRNQVLTMGCYGIGVTRVVAAAIEQNHDERGIIWPDAIAPFQVAILPMNMHKSFRVQALAEELYNTLRSHGIDVILDDRKERPGV

SEQ ID NO: 142408 - protein, 77 aa, Glycine max
  Coding DNA Sequence Number=SeqID_50723
MSELREIPFALYLSLFPQNPEREQKESHGDSTSGDFNLFSVSLTFVNSIRAVGGKNEGILGNRKRCRCRCRKTPEFA

SEQ ID NO: 142409 - protein, 72 aa, Glycine max
  Coding DNA Sequence Number=SeqID_50724
MYIKYGPKYIMKHSQQNKLSNETKTPHTYSQNNSKAPKFLKDMIKPRLLCKQSMGQNTPNDYDDGWLKFSQR

SEQ ID NO: 142410 - protein, 265 aa, Glycine max
  Coding DNA Sequence Number=SeqID_50725
  Gene Ontology: Biological process=transposition, DNA-mediated
  Homolog annotation: Hit_ID=Q6UUU1; Match level="QueryCoverage=22%, HitCoverage=40%, E-value=3e-18, Identity=78%"; Hit description =Putative uncharacterized protein
GHQDLFILRSDLPSQWLLFLSAVPPVQLLTGWCVTAKAPPDISAGKCSGHAARRVPFAIQAAQLLGRAIGAGLFAITPAGERGMCCKAIKLGNARVFPVTTLNSINVPMSISVITLVLKKFGILEHIKFGIFRLGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142411 - protein, 55 aa, Glycine max
  Coding DNA Sequence Number=SeqID_50726
MKIKGMQIVEQKACQTKIHDNAAIYANAMHEYDAGVICPLRCHEDMHDIVKEYAR

SEQ ID NO: 142412 - protein, 78 aa, Glycine max
  Coding DNA Sequence Number=SeqID_50727
MGEVEEVQEQMKADMEALKEKMATMMEAMMSIKEIMEVSVAYRTRARARVMGAVEEVQEQMKANMEAMKEKMATMVEA

SEQ ID NO: 142413 - protein, 59 aa, Glycine max
  Coding DNA Sequence Number=SeqID_50728
WDRSFTETVLGFYGKRKSYDAKDDPTVNESEIIIAGKREGFGMRRRENEIERKRRSRKY

SEQ ID NO: 142414 - protein, 67 aa, Glycine max
  Coding DNA Sequence Number=SeqID_50729
  Homolog annotation: Hit_ID=A0LY18; Match level="QueryCoverage=76%, HitCoverage=30%, E-value=8e-08, Identity=49%"; Hit description =Uncharacterized stress protein
MEGWFEKGKEDPNIRLLQVTPKDAHYWDSNSNMIVNLFKMLKATVTGETEDIDETNMEAVSIYSSVQ

SEQ ID NO: 142415 - protein, 121 aa, Glycine max
  Coding DNA Sequence Number=SeqID_50730
MFEHIYTTVMDVVSFWMNGAQIWVMLPCMDSLSHNRYTMQRTDVLNVSITYKRGSRNLNERGHWQLVVLCPATNVVAWFCLLRKKPDTHIKTAINNAMKTANTIADGTNNQATPKWIEVTM

SEQ ID NO: 142416 - protein, 38 aa, Glycine max
  Coding DNA Sequence Number=SeqID_50731
PISLKIVEATRSNRSLACKGFYKVERNLKNHCLLWDWM

SEQ ID NO: 142417 - protein, 19 aa, Glycine max
  Coding DNA Sequence Number=SeqID_50732
DRARKTPSGLEEVQQGLQR

SEQ ID NO: 142418 - protein, 109 aa, Glycine max
  Coding DNA Sequence Number=SeqID_50733
  Homolog annotation: Hit_ID=A0PAV3; Match level="QueryCoverage=34%, HitCoverage=17%, E-value=5e-07, Identity=76%"; Hit description =Restriction endonuclease
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIQGAAGRVREGP

SEQ ID NO: 142419 - protein, 103 aa, Glycine max
  Coding DNA Sequence Number=SeqID_50734
MSDGFCGTHLQIMVTDRGVGRGDRDDSDDAPQRRRPTASARRQRVAVTVDHVDEPIIHAPDVHDDPMEAPATVEDIPADTGTEAAEDEHQGFLGGPSDPSVLT

SEQ ID NO: 142420 - protein, 215 aa, Glycine max
  Coding DNA Sequence Number=SeqID_50735
IARPEVQAANISYPHSLIQLIQGNLFHGLPSEDPYERQNDGCIPLKLNIFIDGLRPQSKQLLDASAGGKIKPKTPEEAMELIENMAASDQAILCGRTYVPTKRSLLEISTATTREIHPDSIKGQQDSIMGHRDLIKEETSRKAQDGGIREINIRSKGTNHHTSHHTNTLVKEKGKVEEEDRPEEERIETQEEERTEEEEKVASPPKNKSQRAREA

SEQ ID NO: 142421 - protein, 136 aa, Glycine max
  Coding DNA Sequence Number=SeqID_50736
  Subcellular localization annotation: CTP_CleavageSite=41; ConfidenceScore=5.07e-01
VLGFPALITSLCQFYRVSITPSKVIRPPTNRAFIKKYCAPRQAQGETPQQPRDGRQRATDAPPPPPEPLSSSTKAGALPMTRGQLASDQVQSQRKGDAILPRKGPITRTMSKRLQEDWARAAEEGPRVLMNLRVDF

SEQ ID NO: 142422 - protein, 141 aa, Glycine max
  Coding DNA Sequence Number=SeqID_50737
  Subcellular localization annotation: CTP_CleavageSite=86; ConfidenceScore=5.30e-01
GLHALTFRWLHAFTFIGLHALNFSGLQVLALRTTCRHLQTTTCPHTQKATRPHLQRTTRPHLEEYTSTPSESCTLSPSEGFTPSPSEDYMSSPSEDCTSSPSEDYTSSPSEDYRSSQLEDYTSSPSEGYTSLPSETTRPHH

SEQ ID NO: 142423 - protein, 190 aa, Glycine max
  Coding DNA Sequence Number=SeqID_50738
  Gene Ontology: Mol. function=transcription regulator activity; Cellular component=intracellular; Biological process=regulation of transcription, DNA-dependent
  Homolog annotation: Hit_ID=A9CEY8; Match level="QueryCoverage=100%, HitCoverage=81%, E-value=3e-99, Identity=95%"; Hit description =Transcriptional regulator, GntR family
  Pfam annotation: Domain name=GntR; Domain location=10-73; Score=46.4; E_value=1e-10; Accession=PF00392.12; Description=Bacterial regulatory proteins, gntR fam
  Pfam annotation: Domain name=UTRA; Domain location=92-190; Score= -4.1; E_value=0.0074; Accession=PF07702.4; Description=UTRA domain
  Pfam module annotation: Pfam domain module=GntR::UTRA; Domain location=10-73::92-190
MRHTGGSLPMYLQIAEMLVREVSAGRLIDGEKLAPERGMAADLGIAVGTLRKALAELQERGLLERVQGSGNYIRAVSDPQSVYAFFRLELIEGGGLPTAEVLDVTRLAKPADLPSFGTSSEGHRIRRLRRIAGKPAAIEEIWLDGSYVDTITIENMSESLYLYYRTRLNLWISKAEDRIDLGDVPEWTPE

SEQ ID NO: 142424 - protein, 143 aa, Glycine max
  Coding DNA Sequence Number=SeqID_50739
  Gene Ontology: Mol. function=structural constituent of ribosome; Cellular component=ribonucleoprotein complex; Biological process =translation
  Homolog annotation: Hit_ID=Q2PMT2; Match level="QueryCoverage=72%, HitCoverage=43%, E-value=2e-52, Identity=100%"; Hit description =Chloroplast 30S ribosomal protein S2
  Pfam annotation: Domain name=Ribosomal_S2; Domain location=1-107; Score=67.2; E_value=5.6e-17; Accession=PF00318.11; Description =Ribosomal protein S2
MQQKTGRLNSFPKRDAAILKRHLAHLETYLGGIKYMTGLPDIVIIVDQQEEYTALRECITLEIPTICLIDTNCDPDLADISIPANDDAIASIRLILNKLVFAILPLVVPIPVMFLGLFTSGIQALIFATLAAAYIGESMEGHH

SEQ ID NO: 142425 - protein, 108 aa, Glycine max
  Coding DNA Sequence Number=SeqID_50740
  Subcellular localization annotation: CTP_CleavageSite=62; ConfidenceScore=5.23e-01
ARNPELETPGPCWTSSGPLGVFWARSLGRLALWSLGRMLLNSNVIHVRVVMLVRMVRTRLFAAARGKSCPGMHSRCVIASLSGCAHTVGCPPISGGSSGTDKRKLLAP

SEQ ID NO: 142426 - protein, 169 aa, Glycine max
  Coding DNA Sequence Number=SeqID_50741
  Gene Ontology: Mol. function=protein binding; Cellular component =extracellular region; Biological process=cellulose and pectin -containing cell wall organization and biogenesis
  Homolog annotation: Hit_ID=Q86AI8; Match level="QueryCoverage=88%, HitCoverage=38%, E-value=1e-16, Identity=33%"; Hit description =Similar to Homo sapiens (Human). Mucin 2
MTDPLNESISCFLIRVDPWVLVPSPSEGYTPSPSEDYTSSPLEDYTSSPSEGNTPSPSEDYTTSPSEDYTSSPSEDYTSSPSKGCTPSPSEDYTSSPLEGYTPSPSEDYTSPPSEDCTSSPSKDYTPSPLEDYMSSPSKGYTPSPSEDYTSTFGRILLKDSCPPFAHVL

SEQ ID NO: 142427 - protein, 178 aa, Glycine max
  Coding DNA Sequence Number=SeqID_50742
  Subcellular localization annotation: CTP_CleavageSite=67; ConfidenceScore=5.06e-01
MTPGGGAYGKTALPRPSHFPVKYLPGIFQEISAPFVSHFRSPQSNVPSVASQPERGSGIYPVASTILLTHRWASLCSRAACHTRGSSNFMTPSSVSLLQFTTHPPFASVGRFINSERPAPTGPSRTVAQPNGEGAACSASAIKRGGCGELAAALVHPRLYTCHADASGWYACVPIVSG

SEQ ID NO: 142428 - protein, 112 aa, Glycine max
  Coding DNA Sequence Number=SeqID_50743
MPISPCRCIGIAPQDASGPEEVQQGPGVSSSGYGPLSVLQGAHPPNEGSHPQRHPVDPEKSNRALGFPALVTGLCRPTGCPFPPARSRHHDIGKDRAYKTPSGLEEVQQGLG

SEQ ID NO: 142429 - protein, 152 aa, Glycine max
  Coding DNA Sequence Number=SeqID_50744
MGLISDIRVKSYCRLNRLIGSTFNFERLDILWDSIRHPKVQHSISSVSIYYGTQSNIREKGYCRLNWLSDSTFNFESPDILLWDSIRNPSKKLLSFELPHRFNIQFQASRYIAGTQSNIREKGYCRLNLDSQLQHSRSRRLGYMTELNQTSE

SEQ ID NO: 142430 - protein, 215 aa, Glycine max
  Coding DNA Sequence Number=SeqID_50745
MRSWVRGQWIPFDADALSQFLGYPLVLEEGQECEYGQRRNRADGFDEEAIAQLLCIPGQDFARTAAGRQVRIMRTNMTTLTQIWMTLLLSNIQPSDHNSDLPLPKCMPPTRHPLDPDKSNRALGFPALITGLCQSFGVPVAPSKVIRPPITRAFIEKYCTARQAQGGDPQAPDAQPPPPQVDLVGSFDTERYLRHLVRQQAANHRAHVQTHDSLY

SEQ ID NO: 142431 - protein, 161 aa, Glycine max
  Coding DNA Sequence Number=SeqID_50746
MKNVEERLKPCEIPHGKRYGNVSEQNRGGGCRPARPGEQGCFLQKQPPSGGIFQRPIGLGAICPPFLLSTPPSAVFWLRFFFRKVRETLRDFALTITCFLSVMLGTLGIGINDLLGWSTLLTLRILECYGTSPYDSYAMMLPFDLLNGVSLGVQRSFYLRN

SEQ ID NO: 142432 - protein, 138 aa, Glycine max
  Coding DNA Sequence Number=SeqID_50747
MSTLECQNCTNAKDMWDTLQLTHEGTTDVKREWQPKVTAISESKDLSSKSLATLFGKLQEHKMELQRLNQNEENEKKKRSIALKASSSIQEENEEEDSNDEDFSFFVKKFQKFIKKRRIDRRQNFNNGRKSQDDSQVL

SEQ ID NO: 142433 - protein, 143 aa, Glycine max
  Coding DNA Sequence Number=SeqID_50748
  Subcellular localization annotation: CTP_CleavageSite=52; ConfidenceScore=5.11e-01
VNVMVLSASKAWRTQRGGKREVGRTRGEVVRVRKVSMNPMEPKQARINSTTSTSMKSYAEVVKHDHKMKEKEITMPLMGKKGPEVPDVSVVIQTGKDKTSWLDNLWVGRLKNRGMFEKAVDEVQEMVGMDVKVSYWGDDTIIL

SEQ ID NO: 142434 - protein, 274 aa, Glycine max
  Coding DNA Sequence Number=SeqID_50749
  Homolog annotation: Hit_ID=A0TVN8; Match level="QueryCoverage=89%, HitCoverage=16%, E-value=6e-21, Identity=32%"; Hit description =Putative uncharacterized protein
ARQRLDAALGRHRRVHQHQRAGAVVQARGVAGRDGAVFFLEHRLERGQALGRDVAAHVLVGIEHHFTLARLLHDRHDLVAEMAGLDGVGGAAVRLGRQRVLVLAADAELGGDVLGGHAHVHAAERIGQGAGHHGRAAHALGARADGDVGIAQQNGLRRRHDGLQAGAAQAVDVEGRGFLGDAGVDGGHARQVHVARLGVDDVADGDVADFVALDAGAFQRGLDDGRAQVAGRHVLERAAEIADSGTDGGCDDDFLLDGFPPGDPFIILAPPRCP

SEQ ID NO: 142435 - protein, 280 aa, Glycine max
  Coding DNA Sequence Number=SeqID_50750
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSIRLQLWDTAGQERFRSLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142436 - protein, 58 aa, Glycine max
  Coding DNA Sequence Number=SeqID_50751
HPGRVRAAGVGVTIKQYFGSAPQSSCSSSSMPPEELEQLTQQIRDQLEESIIEKGLGN

SEQ ID NO: 142437 - protein, 150 aa, Glycine max
  Coding DNA Sequence Number=SeqID_50752
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=2e-24, Identity=55%"; Hit description =Putative uncharacterized protein
  Subcellular localization annotation: CTP_CleavageSite=44; ConfidenceScore=5.06e-01
MTMITPSSKLTLTKGNKSWLNLIKDGSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142438 - protein, 88 aa, Glycine max
  Coding DNA Sequence Number=SeqID_50753
MERSMIDAASDGALGDMTLAEARNLIEKMASNSQLFSARNDAIVLRGVHEVAKNSSSSIENKRLEGKLDALVNLITIQISVLLCSNLE

SEQ ID NO: 142439 - protein, 147 aa, Glycine max
  Coding DNA Sequence Number=SeqID_50754
HLGRVRAVRAGVTIKQYFGPAPRTSRTSSSLPPEELEQLTQQIRDQLEESITEKGLALPLEPEVGPSTTRVSTRKSCVDPSGNDPDTGDSDKYELYREENPPRLVSLGKVYEGSTTVHTIPLLHDQVKVGVEEVRDADAPILVPTKE

SEQ ID NO: 142440 - protein, 257 aa, Glycine max
  Coding DNA Sequence Number=SeqID_50755
MSHHSSSVNGEGTSHKDPLSRILDELSSLKLWIEKQERKEKGKKRVEEISQDERKKIREEERRKIMKEMKREKHVSYSSHNSCKSLSEELRDYYEGRHRSHLIPHSHRREKERKPQEANINLPYFHGKDNVEANLVWEIRVEQQLKKKSTSKSYGSHSYPKKDRGRGILGVTPSKPKDDKGKTIEKQAPKAKDTLLLNAPTIKTMIMRGQDIYISQDKATTSPSSSESEEAKGEESSEEIYPQEEGQPLVVKEKCKE

SEQ ID NO: 142441 - protein, 120 aa, Glycine max
  Coding DNA Sequence Number=SeqID_50756
GKAINSWGSRYDGGGCMNSARQSIHGAPDSMAINSSGSGLDGGGCMNSARQSIHGAPDLMVEDARTAQGNQFMGIRTQWWRMHEQRLAINSWGSRLDGGGCMNSARQSIHGAPDLMVENA

SEQ ID NO: 142442 - protein, 84 aa, Glycine max
  Coding DNA Sequence Number=SeqID_50757
MEQYLRHLVASRRPTTGHILQSQGFTSFPCQFRAEVAWPGDWLEAQAGEAPAEALAEAPDEADEAREDEEMADLLDFLGGSRAT

SEQ ID NO: 142443 - protein, 169 aa, Glycine max
  Coding DNA Sequence Number=SeqID_50758
MGPGVECSLWLQPGPYISYIRSYYGQSQVDLWPGLSYGHEHRLTFECLSPAINLANIRKNCWNIDDLTISFRGARRARARLANIPSTSAALAPTPASTFAAPSIPAHVDSLRFETMLQSIPQGQILLLQSLQVVAPLGTILSVEQFLERVAWPGAQPSLDREGEGPVSR

SEQ ID NO: 142444 - protein, 231 aa, Glycine max
  Coding DNA Sequence Number=SeqID_50759
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=54%, E-value=1e-113, Identity=76%"; Hit description =Photosystem II P680 chlorophyll A apoprotein
  Pfam annotation: Domain name=PSII; Domain location=1-225; Score =132.6; E_value=1.1e-36; Accession=PF00421.10; Description =Photosystem II protein
LRMGNIETVLSSSIAAVFFAAFVVAGTMWYGSATTPIELFGPTRYQWDQGYFQQEIYRRVGAGLAENQSSMDNGDGIAVGWLGHPVFRDKEGHELFVRRMPTFFETFPVVLVDGDGIVRADVPFRRAESKYSVEQVGVIVEFYGGELNGVSYSDPRYYRATLKSDGVFRSSPRGWFTFGHASFALLFFFGHIWHGARTLFRDVFAGIDPDLDAQVEFGAFQKLGDPTTKKQ

SEQ ID NO: 142445 - protein, 274 aa, Glycine max
  Coding DNA Sequence Number=SeqID_50760
MDNILGRHILPESKVEIYHTELDEFKAELERCNFHKRLTNLVDSSIDLALVKEFYANLYSSEDPSPKEVRVRGPLGYPRKILKKDLMTLARVWSVLSYSNLAPTSHTSDLTIDRARLIFGLVSQMDMNVGALISGQITSIAQSNSSRLGFPALITTLCKARGVNSDSLVFECLSPVINLAYIRKNYWNPDDLVVSIKGARQAKMRLTEPPSTSTAPIPACTSAAPSVPAFTGFQHLEAMLQSVHRGQIILLQSLQVVAPPGSIPSVEQFTEMAV

SEQ ID NO: 142446 - protein, 47 aa, Glycine max
  Coding DNA Sequence Number=SeqID_50761
MTADVGHGKMTDRGLKKKLHRMTPIEHFLIGHNPIVIQGLNRINNGR

SEQ ID NO: 142447 - protein, 44 aa, Glycine max
  Coding DNA Sequence Number=SeqID_50762
MAHAPMEMAPKKLSAKRSRRDAAAKGTSAAPEFDSHRFRSAVHQ

SEQ ID NO: 142448 - protein, 91 aa, Glycine max
  Coding DNA Sequence Number=SeqID_50763
MRHQIPMIGDMMHVLSGATLFCKITHASNIFMIHIHRDSLGIINIKIQRKVKKRLSHEVLKVTVELSLSVGLSTRLRKGGAKRKIMGSEPI

SEQ ID NO: 142449 - protein, 255 aa, Glycine max
  Coding DNA Sequence Number=SeqID_50764
  Gene Ontology: Biological process=transposition, DNA-mediated
  Homolog annotation: Hit_ID=Q6UUU1; Match level="QueryCoverage=23%, HitCoverage=40%, E-value=3e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPGLGAVAHACNPNTLGGQGRIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142450 - protein, 103 aa, Glycine max
  Coding DNA Sequence Number=SeqID_50765
MTSRDQVWSFCTLVSSRGGGPDDTRRYLMVIRTLLSSRGGGPDDKQRRKFGHSAPLYHPEAAGPMIRGDTYGYSHPFVIQRPIRHHNFRAFLMTSRDQVLWSL

SEQ ID NO: 142451 - protein, 46 aa, Glycine max
  Coding DNA Sequence Number=SeqID_50766
MNLEERSRIFTKIGEKLAAQLAQASKVASSRRNSLLEESFGGPKWA

SEQ ID NO: 142452 - protein, 105 aa, Glycine max
  Coding DNA Sequence Number=SeqID_50767
MAPAAVEDIVADIPADTGAEAAEDEHEGFPGGPSDPFVLTQYADHERPELKLSSHGRKVHSLGRSVPAIERLIASTGLSSLIACSVDTGDRDFCPHLWSVAPGDV

SEQ ID NO: 142453 - protein, 114 aa, Glycine max
  Coding DNA Sequence Number=SeqID_50768
MAIQGDDSEDGKKIEEHKQQLAPKPALEHVYDFVELEEINEETKDDKEEETSIKEKEKERIKEEEKEKEKKLKKNEKQKEKVVDDEMKKGKSEANSDKKKDTTPNEGKEVPYPL

SEQ ID NO: 142454 - protein, 64 aa, Glycine max
  Coding DNA Sequence Number=SeqID_50769
MESIISRGFLNTREGLSLCGSDFVNGVLQREWKISSGLLEDWTLDVGAGSGRTSINQVCIPLFL

SEQ ID NO: 142455 - protein, 131 aa, Glycine max
  Coding DNA Sequence Number=SeqID_50770
MNDNITLILHHGGRFTPRASDGKVEYIGGEFDVWEDISADYMNTFILYDLVKAYFNHGLRSCTTDGNILYLVRDALENENEINVYFHHEVDPILEEVPQMLYLECHPIPEAVENEDDLHDVPIVGLEEGKF

SEQ ID NO: 142456 - protein, 115 aa, Glycine max
  Coding DNA Sequence Number=SeqID_50771
MLVSPAEVSVGLCHRDIGIAPTRHPVDPEESNRVLGFPAQITGLCQFYRVPITPSKVIRPLTNRAFIKKYCVPRQAQGDTPQQPGDGRQRATDAPPPPPEPLSSSTKAGALPTAS

SEQ ID NO: 142457 - protein, 58 aa, Glycine max
  Coding DNA Sequence Number=SeqID_50772
MGRGQVVRQRVLVPLFGDPILLKLQYHRKLTAACQTKAKRKKSKGITGIISTIGFKKA

SEQ ID NO: 142458 - protein, 191 aa, Glycine max
  Coding DNA Sequence Number=SeqID_50773
  Gene Ontology: Mol. function=chitin binding; Cellular component =extracellular region; Biological process=chitin metabolic process
  Homolog annotation: Hit_ID=UPI00006A17C9; Match level="QueryCoverage =82%, HitCoverage=100%, E-value=3e-16, Identity=35%"; Hit description= UPI00006A17C9 related cluster
  Subcellular localization annotation: CTP_CleavageSite=13; ConfidenceScore=5.03e-01
MLLSSNVIYICVRVVMLARMIRTRLFAAARMKSCPGMDSSCVTASLSGCARTVGPPPISEGGLGTMWSTLKMRTRSPLKVRACNPLKTRMCSPLEVRACSPLMARTCSPLKVRACSPLLAKTCSPLKVRACSPLLVRTCSPLKVRACSPLLAKTCSPLKVRACSPLLARTCSPLKVRACSPTKVRTCSPLK

SEQ ID NO: 142459 - protein, 299 aa, Glycine max
  Coding DNA Sequence Number=SeqID_50774
  Homolog annotation: Hit_ID=Q6WAY6; Match level="QueryCoverage=99%, HitCoverage=50%, E-value=1e-26, Identity=30%"; Hit description =Putative uncharacterized protein
MVEEFEEILGCSLGGKRPYLFSGFYPSLARISKIVQISAQELDHRKQVENGVVGILRKYLEAKARILAGKGEWALFIDILALLIFGGVLFLNVDGLVDLAAIDAFLAYHNHKEIPVVAMLADLYDTFDRRCEKSSTRIVCCTPALYVWLVSHLFRQEVRHACLLESHHSCTEKGGENWDQLLASKEGASVNWFPQWKEGRIGVLISCGGFPNVPLLGTRGCISYNPVLAIKQLGYPMRGAPLEEEFAPVISRGFHKTNMETLQKVRKAWEVVQKKDKELRGSNNGSIGGYRKWLRAYVQ

SEQ ID NO: 142460 - protein, 359 aa, Glycine max
  Coding DNA Sequence Number=SeqID_50775
  Gene Ontology: Cellular component=mitochondrion
  Homolog annotation: Hit_ID=Q6CQE5; Match level="QueryCoverage=21%, HitCoverage=71%, E-value=7e-10, Identity=48%"; Hit description =Protein TAR1
MAHLELSIPWRGSTEQPHRPTYLNYPEGNFGGNQLLDGSISLSPLYPSQTNDLHVCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPIALLTTIQALFDSLSKSFSSFPRGTCSLSVSRQYLALDGNYRPIGAAFPNNPTRRQRLVVRQGPGTTGLSPSPGAPSRGLGPGPATEDASPDYNSDPEGDRFSWWAFPGSLAVTKGIPRVAPPDLRSRWERACTQRVVDGSRTDRLARDWSRAWLIHHFITAKSAMNPDFNQPRGGCSRE

SEQ ID NO: 142461 - protein, 187 aa, Glycine max
  Coding DNA Sequence Number=SeqID_50776
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=45%, HitCoverage=71%, E-value=2e-24, Identity=69%"; Hit description=LacZ protein
MLPEYEIDDLSTEADSVAGDRLFPHDFEEASHKTAMFPSNHHTRLMHPPLINELGVATINEKTSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142462 - protein, 131 aa, Glycine max
  Coding DNA Sequence Number=SeqID_50777
MIMRSQDIYSSQDEATTSPSSSESEEAKGEESSEEIYHQEEGQPLMVKEECKEVSVSSKRPCILAILNGGKLPLKDLIEAQRSSLHRSPTSKLPSASSMLCSMASKCWAKLLLDLEQAANSSFKTMPCTRD

SEQ ID NO: 142463 - protein, 183 aa, Glycine max
  Coding DNA Sequence Number=SeqID_50778
MRGAPTEESLSPLLVRDLGAQSLKVIQRVHKAWRSPLRKDKELRGIRNGVISGYHGWLRVHTRGLDWLSKLKVIDEENFEAPEEDEEVQALKLELGKARLAKEKFKSAATHIRKECIELQEENAATARALEQETKRARKEEHGRDKFRGALWGSNNELKLQREERDRSWVHGMILKEELVACA

SEQ ID NO: 142464 - protein, 144 aa, Glycine max
  Coding DNA Sequence Number=SeqID_50779
  Homolog annotation: Hit_ID=A9PEJ7; Match level="QueryCoverage=72%, HitCoverage=39%, E-value=2e-08, Identity=38%"; Hit description =Putative uncharacterized protein
MTNLTNDDEEFGSSNNRRGEAKRGPVTKRLRTNWAPRVTIDENGDKEGFRDFEHEHEQSPVQSMKENGVDYWHVDRNEDPRVRVLENDGVESESQEWRKSDGVRSWLYELGKSGLPESAPDRQVFKIKTDESKYRTQGTSLRQG

SEQ ID NO: 142465 - protein, 102 aa, Glycine max
  Coding DNA Sequence Number=SeqID_50780
MRDDKRSSYVIGSGVNYGIGLRGKFLIALETTPKWALPVGQVMVGAGAWGASLWMGAGALGRTEVYGGLTRAGAKVTTWVSPSFLFAPVAPTLLTLVLVEET

SEQ ID NO: 142466 - protein, 150 aa, Glycine max
  Coding DNA Sequence Number=SeqID_50781
  Homolog annotation: Hit_ID=Q6UUU1; Match level="QueryCoverage=40%, HitCoverage=40%, E-value=9e-19, Identity=78%"; Hit description =Putative uncharacterized protein
VYPKPGSRMGWLIDWLIDRWVGFTIGLGETPELIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142467 - protein, 93 aa, Glycine max
  Coding DNA Sequence Number=SeqID_50782
MMLVSARQRARLLLVDRKVRVTIRTTKGAEDDVNLRAPIGLVCPWLTKGAGNHKVTPHVTLTSRGQDDKRCTRTMLVSARQRARFPLVDERCG

SEQ ID NO: 142468 - protein, 157 aa, Glycine max
  Coding DNA Sequence Number=SeqID_50783
MLNRHMADKLIRQYRAPRVLQWRNHGFYQLFPPVQLLKSGWYASNSAKAYRPDISAGKCKAGVPMTAAVFPVRPVGCALLNDGKPGDRVRAFAYYELALKGGCVHTGDYYVGTDNAGCPSHEVRSCGRRKKAAPGSERAAAKPFFHRLRPPDKHHEI

SEQ ID NO: 142469 - protein, 328 aa, Glycine max
  Coding DNA Sequence Number=SeqID_50784
  Homolog annotation: Hit_ID=Q84VH5; Match level="QueryCoverage=100%, HitCoverage=52%, E-value=1e-138, Identity=74%"; Hit description =Envelope-like protein
MDKKIRSIVSSILKDASVPDAEKDVPTSSTPNVFVPDADKDVPTSSAPNAEALPSPSEEESTEEEDQATEETPAPRAPEPAPGDLIDLEEVESDEEPIANKLAPGIAERLQSRKGKTPIKRSGRIKTMAQKKSTPITPTTFRRSKVAIPSKKRKEISSSDSDDDVELDVPDIKRAKTSGKKTCCERELGRAALDCKEIMDLITTAGLLKTVTKLGDCYESLVREFIVNIPSDITNRKSDEYQRVFVRGKCVRFSPAVINKYLGRPTDGVVDITVSEHQIAKEITAKQVQHWPKKGKLSAGKLSVKYAILHRIGAANWVPTNHTSTVAT

SEQ ID NO: 142470 - protein, 160 aa, Glycine max
  Coding DNA Sequence Number=SeqID_50785
  Homolog annotation: Hit_ID=A5BTM1; Match level="QueryCoverage=66%, HitCoverage=4%, E-value=1e-10, Identity=35%"; Hit description =Putative uncharacterized protein
MTRGNPSDLQPFDPEIDKTFHRLVRHHFIPFDHSEHSITGESVHSVIGDFEHPDLEHSDFAHSENMAQPPPRERTLREMVAPDFTYESLCIQYPDEDVPYVLKTGLIHLLPKFHGLAGEDPHKHLKEFHIVCSTMKPPDVQEDHIFLKAFPHSLEGVAKD

SEQ ID NO: 142471 - protein, 67 aa, Glycine max
  Coding DNA Sequence Number=SeqID_50786
MWRKSKRGVFAQSVSFRDFFERPTWAFQKAVASGGSNLARLGELGGKHLPYFAINRGGSEEEKGSAP

SEQ ID NO: 142472 - protein, 77 aa, Glycine max
  Coding DNA Sequence Number=SeqID_50787
MNLIIVIKRKEHALRRPYRTRARARVMGEVKEVQKQMKVDMEAMKEQMATMMEAMMSMEKIMEANAIAVAATSAVAK

SEQ ID NO: 142473 - protein, 123 aa, Glycine max
  Coding DNA Sequence Number=SeqID_50788
MKKRLEEISLDEKEKIREEERRKILKELRKEKHASYSSHNSCKSLCEELRDYYEGRHRAHPRPHSQWREKERKPQEANINFLYFHGKDNVEANLDWEIRVEQQLKRNSTSKYYGSHYYLKKDQ

SEQ ID NO: 142474 - protein, 251 aa, Glycine max
  Coding DNA Sequence Number=SeqID_50789
  Homolog annotation: Hit_ID=Q6WAY6; Match level="QueryCoverage=42%, HitCoverage=19%, E-value=8e-11, Identity=36%"; Hit description =Putative uncharacterized protein
LAAIDAFLAYHHSKESPVVAILADLFDTFDRRGSAINWFPRWKEGKEGVLFSCGDYPNVPLIGTRGCINYNPTLSIRQLWYPMRGAPTEESLSPCLVRDLGVQGLTVIQRIHKAWRNPLKKDKELRGIRNGVIGGYHGWLRIHVRGLDWLSKLKVIDEENFEASEEDEEVRALKLDLGKARLAKEKFKSAATHIRKECTELQEENAATAKALEQETKRARKEEYGREKFRGALWGSNNELKLQREERDRSR

SEQ ID NO: 142475 - protein, 73 aa, Glycine max
  Coding DNA Sequence Number=SeqID_50790
MGRDPKKFLQLLNDISVINPSWPEKNEKKSYKERRSKKAYMAWDDNDSSDGLEKEINLLSKDYESDENISQEV

SEQ ID NO: 142476 - protein, 179 aa, Glycine max
  Coding DNA Sequence Number=SeqID_50791
MVLFEVLQWRICCLSAVPSCSATETGLGCHDADANSPLNPPCALCAAIPVGTLSCHSLHSGMNRQLLREGRSSAGLLRYYGPARRKMCCILAITMLGTLMPGCPSQTVLLWQEKKGCTGASVRICEYRTHYRANSGASRGGGTDSRTTLGLPGTAASRKWLTNGAETFSWKMPGRYLTG

SEQ ID NO: 142477 - protein, 190 aa, Glycine max
  Coding DNA Sequence Number=SeqID_50792
  Gene Ontology: Mol. function=motor activity; Cellular component=cell projection
  Homolog annotation: Hit_ID=UPI00016621D1; Match level="QueryCoverage =96%, HitCoverage=40%, E-value=8e-18, Identity=36%"; Hit description =UPI00016621D1 related cluster
PRSLAFAFRGLQVLTFRGLHVLAFRGLRVLIFRGLHVLTFRGLHTLTFRGLHVITFRGLHVLAIRGLHVLAIRGLHVLAIRGLHALAFVGLHALTFRGLHVLTFRGLHILAFRGQHVLAFAFVGLHALIFRGLHVFTFRGLHVLAFRGQHVFAFAFVGLDALTFRGLHVLAFRGLHVLTFRGLHVLTFRR

SEQ ID NO: 142478 - protein, 118 aa, Glycine max
  Coding DNA Sequence Number=SeqID_50793
MGGISSADSPSPHVCIFGENTETFSSLTSYPELRRSEFLIGGYVGARASLLSTTPLFVTMTQELVAHRDALRLSAPRHSMTPSVIDEQRPMWSSAPFPEMSASSGGDFFKSHKLSRTT

SEQ ID NO: 142479 - protein, 183 aa, Glycine max
  Coding DNA Sequence Number=SeqID_50794
  Gene Ontology: Mol. function=chloramphenicol O-acetyltransferase activity; Biological process=response to antibiotic
  Homolog annotation: Hit_ID=P62577; Match level="QueryCoverage=97%, HitCoverage=94%, E-value=3e-95, Identity=81%"; Hit description =Chloramphenicol acetyltransferase
  Pfam annotation: Domain name=CAT; Domain location=6-179; Score=359.7; E_value=4.9e-105; Accession=PF00302.9; Description=Chloramphenicol acetyltransferase
MEKKITGYTTVDISQWHRKEHFEAFQSVAQCTYNQTVQAHPEFRMAMKDGELVIWDSVHPCYTVFHEQTETFSSLWSEYHDDFRQFLHIYSQDVACYGENLAYFPKGFIENMFFVSANPWVSFSSFDFYVDNMDNFFAPVFTMGKYYTQDDKELMPLAIQVHHDVCDGFHVGRMLNDITTLLR

SEQ ID NO: 142480 - protein, 180 aa, Glycine max
  Coding DNA Sequence Number=SeqID_50795
  Homolog annotation: Hit_ID=A5AWY3; Match level="QueryCoverage=86%, HitCoverage=26%, E-value=7e-10, Identity=29%"; Hit description =Putative uncharacterized protein
MRAEFSILKRENQRSLALIAINWPTRSPEKQEPVCALLEKHQENISSNILKRSLENSSTKPTTIQDLQTEINNLKREVKELRQQQEIHQIILSQLEEDSDSESANNSEENQPENLEDDMFMELINKIKIQKFYINLKIIINDFILEIMALFDTGADSNCILEGLIPTNSWRNLRKIKYGK

SEQ ID NO: 142481 - protein, 286 aa, Glycine max
  Coding DNA Sequence Number=SeqID_50796
  Gene Ontology: Biological process=transposition, DNA-mediated
  Homolog annotation: Hit_ID=Q6UUU1; Match level="QueryCoverage=20%, HitCoverage=40%, E-value=4e-18, Identity=78%"; Hit description =Putative uncharacterized protein
MVKVGTSYVPINVSFSPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPVTTLNSILAAFDPTVYVEATIGEPDTLDPHLAYDTSSGEVLYNVYEIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142482 - protein, 94 aa, Glycine max
  Coding DNA Sequence Number=SeqID_50797
MKDKRDEEEKLEKQKKKKDSKALSSKAKGKKRKRIPQRRLLRRKIILQQKVISKGHSFLNNPCTFSYQGKHPLARPYLLSLSDQGVPTDPKRIK

SEQ ID NO: 142483 - protein, 211 aa, Glycine max
  Coding DNA Sequence Number=SeqID_50798
  Gene Ontology: Mol. function=hydrolase activity, acting on glycosyl bonds; Biological process=peptidoglycan catabolic process
  Homolog annotation: Hit_ID=A2UEY8; Match level="QueryCoverage=28%, HitCoverage=35%, E-value=1e-17, Identity=76%"; Hit description =Glycoside hydrolase, family 24 precursor
  Pfam annotation: Domain name=Phage_lysozyme; Domain location=1-93; Score=32.2; E_value=1.8e-06; Accession=PF00959.10; Description=Phage lysozyme
WTDGIGNTVGVIPGKTITERQAAGNFITNVLRVEAALARCVAVSMPQQVYDALVSLAFNVAPAIRLRLNHGDVAKKGKWPRRGAEQMSKRNHRRLVAVGALASLTLVHEPVRTAPSSLSETSITDRFYTANPGWRHGPSCRTWAGVELFRATARTRAGRPKALAELFDKQAVPKYGGLGCMKLLKIAYVRLAVLSAAEGDHAGLQHITAGR

SEQ ID NO: 142484 - protein, 409 aa, Glycine max
  Coding DNA Sequence Number=SeqID_50799
  Gene Ontology: Mol. function=binding
  Homolog annotation: Hit_ID=A7PLL7; Match level="QueryCoverage=99%, HitCoverage=74%, E-value=1e-141, Identity=56%"; Hit description =Chromosome chr7 scaffold_20, whole genome shotgun sequence
MPLTDDQEHILALSGLWKIAITNPNDPEFPSLGIFRCMVKLIQKGVNHKDWLLRCQNMYTPYYAAHIIGSYTMNKPKFADKVALRALGHLASHEATFEAVAEHEAEVVEAAIDIASTCLKEVYEKFVGLKESERLEYHRNLLTRGHGDLELANIKAEEWASQLQCWSLYLLDCFACRERSLGLICKKKFLKDLCGMWGDLEEVVVNLCNVSRSSDDTQHMAIDSLLQLLRDPVRRYKVIDKAAPVLADLVEIRSLGRKPKVGQAITQTLLQDYHKVKFGELKSERTKRTLGELWDLKVERVKKESLMSEQEIREKQVLAGILKKEGNREFGSREIEKAVVKYTEALSLCPLKSKKERIVIHSNRVQCHLLLRDPEAALSDTTRALCLSNVASVACLHSKSLWRRSEAWT

SEQ ID NO: 142485 - protein, 754 aa, Glycine max
  Coding DNA Sequence Number=SeqID_50800
  Gene Ontology: Mol. function=protein binding; Cellular component =chloroplast; Biological process=guanosine tetraphosphate metabolic process
  Homolog annotation: Hit_ID=Q05753; Match level="QueryCoverage=80%, HitCoverage=83%, E-value=1e-106, Identity=53%"; Hit description =Ankyrin repeat domain-containing protein, chloroplast precursor
  Pfam annotation: Domain name=Ank; Domain location=406-438; Score =21.2; E_value=0.0039; Accession=PF00023.21; Description=Ankyrin repeat
  Pfam annotation: Domain name=Ank; Domain location=439-471; Score =27.9; E_value=3.6e-05; Accession=PF00023.21; Description=Ankyrin repeat
  Pfam annotation: Domain name=Ank; Domain location=472-504; Score =27.5; E_value=5e-05; Accession=PF00023.21; Description=Ankyrin repeat
  Pfam annotation: Domain name=Ank; Domain location=505-537; Score =37.8; E_value=3.8e-08; Accession=PF00023.21; Description=Ankyrin repeat
  Pfam annotation: Domain name=Ank; Domain location=640-672; Score=7.2; E_value=3; Accession=PF00023.21; Description=Ankyrin repeat
  Pfam annotation: Domain name=Ank; Domain location=673-704; Score =10.7; E_value=0.93; Accession=PF00023.21; Description=Ankyrin repeat
  Pfam annotation: Domain name=Ank; Domain location=705-737; Score =24.0; E_value=0.00057; Accession=PF00023.21; Description=Ankyrin repeat
  Pfam module annotation: Pfam domain module=Ank::Ank::Ank::Ank::Ank::An k::Ank; Domain location=406-438::439-471::472-504::505-537::640 -672::673-704::705-737
MDCERLFYFSHEESGQELLHLDTILALKVLETMGIVVTMEGIEEVDLVMMIMDIVVTVEGLQGTHHHIEVVEIIHRGTHPHLMVEDLGGTGPGHFLILHMVAQIGGAAATMFHVSTVALNPQPHTFLFPLPFFTSRNLQLSQTLQFPRNWNLRSISPSLHPTPQYDDSEDHVIGDCVVFEDGVFDEPLFHNHHHNPDNLTVDKPKPKPRPSWRKKVEETLGENLVPDKWREVQAEINITKREMRKIAREVEFNSKVEKKRRGLIPLRDMNLDDYKAYKEAKLAQMKLLDYSSSFPVDENVPEPQLNRGEKFEAEAELDGGERVAPKNPRWAVYGRGLEDVTEFFNSDNYDPTAKTPGGRRKLFNKEEKVLLNKRIPDLAAATSTGYSVHGHLVAFLCACVRMMIKDKWLPLHTLAACGEFHLLDSLLKHNVDINAVDKDGLTALHRATIGKKQAIINYLLRNSANPFVQDNEGATLMHYAVLTASTQTIKILLLYNVDINLQDNYGWTPLHLAVQAQRTDLVRLLLIKGADKTLKNESETKITINERRKNNKKKRRGLLPLRDAKKIELEKKGNGRGLSPYKDNPSTFHVKAKLPEPDFNGERVEPKDPRGFLHGKGLEDVMQFFIVGAITLVLRPLIKGKWLPQHTVAACGELYLLDSLLKHNAVINSVDKDGLTALHKAIGKKQVITNFLLKNSANAFVRDKEGATLMHYAVQTASTETIELLLLYIVEINLQDNDGWTPLNLAVQTQTKFS

SEQ ID NO: 142486 - protein, 233 aa, Glycine max
  Coding DNA Sequence Number=SeqID_50801
  Gene Ontology: Cellular component=integral to membrane; Biological process=nitrogen fixation
  Homolog annotation: Hit_ID=A7Q6X5; Match level="QueryCoverage=91%, HitCoverage=73%, E-value=2e-46, Identity=49%"; Hit description =Chromosome chr12 scaffold_57, whole genome shotgun sequence
  Pfam annotation: Domain name=DUF125; Domain location=49-218; Score =196.2; E_value=8.2e-56; Accession=PF01988.10; Description=Integral membrane protein DUF125
MASLDDHKTNEEISINHVEIPIHAIGVEPKPNQEVKERRNIDYSQRAQWLRAAVLGANDGLVSVASLLMGVGAVKENITAMLLAGFAGLIAGACSMAIGEFVSVYTQYDIEIAQIKRDKENNNIGEEAQREKLPNPFQAALASALAFSVGAVIPLLAAAFIRNYKIRLVVVAVVASLTLLLFGGVGAVLGKTPVRKSCIRVLLGGWMAMTITFGHQVIWHCWAFNVIHYFGLF

SEQ ID NO: 142487 - protein, 356 aa, Glycine max
  Coding DNA Sequence Number=SeqID_50802
  Gene Ontology: Mol. function=chitinase activity; Cellular component =extracellular region; Biological process=cell wall catabolic process
  Homolog annotation: Hit_ID=Q8H0C9; Match level="QueryCoverage=99%, HitCoverage=99%, E-value=1e-105, Identity=67%"; Hit description =Cotyledoneous yieldin-like protein
  Pfam annotation: Domain name=Glyco_hydro_19; Domain location=114-347; Score=510.5; E_value=1.9e-150; Accession=PF00182.10; Description =Chitinase class I
MNLDTIFAFTLAYILLVITSSEFPSVAGDDGFYSFNAFLTAARSFGGFGTTGDFNTRKREVAAFLALTSHETTTNRVPGYGVITNIINGGIECGNGPTLGSEFPSVAADDVSSIISASQFEQLLKHRNDQICEGKNGFYSYNAFVTAARTFDGFGTTGDVNTRKREVAAFLAQTSHETTGGGGWPNAPDGPYAWGYCFVTERDKSNNYCEISKAPCASGKSYYGRGPLQLTHNYNYDLAGKAIHSDLINNPDLVAQDPVVSFQTAIWFWMTSQANKPSCHDVITNRWTPSSVDMAANRAPGYGVITNIINGRIECGNGPSPASNDRIGFYKKYCEIFGLSDATNLDCSSQKSFDQD

SEQ ID NO: 142488 - protein, 520 aa, Glycine max
  Coding DNA Sequence Number=SeqID_50803
  Gene Ontology: Mol. function=nucleotidyltransferase activity; Biological process=RNA processing
  Homolog annotation: Hit_ID=A7R126; Match level="QueryCoverage=37%, HitCoverage=18%, E-value=4e-32, Identity=58%"; Hit description =Chromosome undetermined scaffold_334, whole genome shotgun sequence
  Pfam annotation: Domain name=PolyA_pol; Domain location=89-177; Score= -4.3; E_value=4.7e-06; Accession=PF01743.11; Description=Poly A polymerase family
MNHNKRGVLTRLKTLVNSHSQGFHSPAPKRPKQDPSSTENDLDYSVCRGRIDVSKWKTLDAEELGITSSMISYPSQFVLKLLRRKGFESYLVGGCVRDLLLNRTPKDFDVITTAKLMEVRAQFRGLARAEVVGRRFPICLVHIKGSVVELETVIPAQMSFKEDPARLGLSLSRETEAAMWKYSSLVKSLDKNKIMIELNYMLSYGAAEPSLHLLWKFKLLEFLLPVHAAYLDEQAIKEDAPASNMLMAPIQLNLFGFQIFVPKKAGKLASAIFKMLASDVEFYKTERRKNSKINYGMLGKGHLSEIAFVLGKIVLETMSSGTVGDGEDSEAGQCHLKTEGTKEIAQSQLPDLVNHEVAAMNGEGHLLSIPNSECRQGKSKKRKLVKNRCIAKKKMSSGNQELSEKFEYKENKEEQQKLVKLSQKVDMSTEDSLPKKKNDHRKQLISDRKKITSANKSFLHQAKHMKTDEDSTCMPSQSTVSENHQVIANSNIDVNAKTTNESNLKKKKKGLSLVEMFKGK

SEQ ID NO: 142489 - protein, 192 aa, Glycine max
  Coding DNA Sequence Number=SeqID_50804
  Gene Ontology: Mol. function=protein serine/threonine kinase activity; Cellular component=chloroplast; Biological process=protein amino acid phosphorylation
  Homolog annotation: Hit_ID=A7QWP1; Match level="QueryCoverage=62%, HitCoverage=46%, E-value=5e-20, Identity=42%"; Hit description =Chromosome chr4 scaffold_205, whole genome shotgun sequence
MGGSCVGRVHLGEGGIMIAPTAERTRKTSHVRRMKRTGITESTSVNGGISSINSNNMVFPRVETGNLKEFNFADQKAATKSFKSDALLGEGGFGKDYNAKISDFGLAKLGPSGEDSHVSTSIMGTYGYAAPEYIATGLRALDKNRIIEQQNLIEWAKSSLSDKRKLKSIMDERIEDVLDTLERIEAIKDTTK

SEQ ID NO: 142490 - protein, 322 aa, Glycine max
  Coding DNA Sequence Number=SeqID_50805
  Gene Ontology: Mol. function=zinc ion binding; Cellular component =intracellular; Biological process=regulation of transcription
  Homolog annotation: Hit_ID=O81793; Match level="QueryCoverage=40%, HitCoverage=42%, E-value=2e-10, Identity=31%"; Hit description =Putative uncharacterized protein F8D20.120
MQNQNPSEDDSTKKSPSSPSDDTSHPTNNNNNPQGESLVMKTVWQVLEELGGSGDDSDGDSGFGDGAPVAVAVGGGGDDNGDGDGSVGGGATVAMEKSDDDSDNNGDNSGSNLAVAVVVGGGDGSGSSGVGATVTVSVAVSGGGGNHGGGSSGGGGGGPVAVSVAVGGGSTVVESVVVSTEGVQGRKRKTSIVRDPPTGRPTCPLCQKEFPTWKGAFGHMRAHPDRDYRGFFKPPVFGSPSSTQDQPPRDDKGDDSAKKSSGEVNNGEKGSASSHVRVPMFDLNEPIEEEGSSHAAEPAEDMSSEEGKGFGFDLNEMPPAED

SEQ ID NO: 142491 - protein, 155 aa, Glycine max
  Coding DNA Sequence Number=SeqID_50806
MKLTKYRLKTQVEKDEDLSGEGQSPRVEKDEGSEAKTLSRLLITYQGNPCGVYPDLSSFTGSGVYPDLSSFIGSGVYPDLSSFTGSGVYPDLSSFTGSGVYPDLSSFIGCGIYPDLSSFTGSGVIQIFVACIKRSAPTQVHIIWAFKLVWAFSNN

SEQ ID NO: 142492 - protein, 102 aa, Glycine max
  Coding DNA Sequence Number=SeqID_50807
  Gene Ontology: Mol. function=protein serine/threonine kinase activity; Cellular component=chloroplast; Biological process=protein amino acid phosphorylation
  Homolog annotation: Hit_ID=A7QWP1; Match level="QueryCoverage=96%, HitCoverage=32%, E-value=2e-36, Identity=74%"; Hit description =Chromosome chr4 scaffold_205, whole genome shotgun sequence
MGTYGYAAPEYVATGHLHVKSDVYGFGVVLLEMLTGMRAFDRNRPIEQQNLVEWAKPSRSDKSKLKSIMDERIEGQYSTKAALKAAQITLKCLERNPKKVLI

SEQ ID NO: 142493 - protein, 106 aa, Glycine max
  Coding DNA Sequence Number=SeqID_50808
MVSKNNTVTLCVVKGWGRGSRCVPFEYISTTTMIVVKPLETGNLVMKSMDKSSQIVEGMGKGCNKPAGAEAAVSLSLDHVLSEHQPLSETSARLTSKGNLGDNMPR

SEQ ID NO: 142494 - protein, 391 aa, Glycine max
  Coding DNA Sequence Number=SeqID_50809
  Homolog annotation: Hit_ID=A2Q4W7; Match level="QueryCoverage=45%, HitCoverage=98%, E-value=2e-62, Identity=68%"; Hit description =Putative uncharacterized protein
MNCKIKPNQARPFTVDTKIYGLPRKTSMIVAVKKLGKRKQHFRYATSKREMQCGGMCDLQEVGHVERGDTYPQAQTSVISFTGTLNLKLPGVRSATAEKIATRKHARLHDPAIQRDWLSHCAPSRYSDYVANVVKWWQHGGFLPNRHRRFMKGGRLWWRPRLQWHVYMMEFWPSAVDNTVWGLAVPRGCLELITMGASIRKMMLFFSRMVIFSISNARYTYVHDQKYPSEDVDIHHVVSRRSNAKYLFVHASALLVLACALYLYVLKEKAISLVYYSLLFDIFLVNLLLGKPVKKESVVIMPAFGVQLETHYVSGKVIRYFVPIDKILKPVLIECVTPVTCYWTLSLIIRGESEMVLVFKNLRPPVKMLAYVWKALCAATDSKEETCTHAE

SEQ ID NO: 142495 - protein, 502 aa, Glycine max
  Coding DNA Sequence Number=SeqID_50810
  Gene Ontology: Mol. function=protein serine/threonine kinase activity; Cellular component=barrier septum; Biological process =protein amino acid phosphorylation
  Homolog annotation: Hit_ID=A7PKW0; Match level="QueryCoverage=96%, HitCoverage=95%, E-value=0.0, Identity=67%"; Hit description =Chromosome chr7 scaffold_20, whole genome shotgun sequence
  Pfam annotation: Domain name=Pkinase; Domain location=38-470; Score =164.9; E_value=2.2e-46; Accession=PF00069.16; Description=Protein kinase domain
  Pfam annotation: Domain name=Pkinase_Tyr; Domain location=83-468; Score=-115.8; E_value=2.6e-05; Accession=PF07714.8; Description =Protein tyrosine kinase
  Pfam module annotation: Pfam domain module=Pkinase::Pkinase_Tyr; Domain location=38-470::83-468
MSCSSSSGSEEGDEGFDSYRKGGYHAVRVADQFAAGRYIAQRKLGWGQFSTVWLAYDTKTEIIWLLDVDCHYGSMNLRFLILLSMCHKMKSMHVGVAENGEWSSQNVTTWFHMDDDLSSYVALKIQKSAAQFAQAALHEIELLSSIADHNPTNSKFVIQLIDHFKHTGPNGQHLCMVLEFLGDSLLRLIRYNRYKGLPLNKVREICKCVLTGLDYLHTDRGMIHTDLKPENILLCSTIDPAKDPLRSGLSPILERPEGNTNGGVTSLIEKRLRRRARTAVAKISGRRASMGGIGDAAKTGRNIDGIDVRCKIVDFGNACWADKQFAEEIQTRQYRAPEVILKAGYSFSVDMWSLACIAFELATGDMLFTPKGGQGFSEDEDHLALMMELLGKMPRKIATGGAQSKDFFDRHGDLKRIRRLKFCPLDKLLTDKYKFSVNDAQEFSEFLLPLFDFAPEKRPTARQCLQHPWLNYMESPPNEMRNESAVEKVDVGMSNLKIRVEK

SEQ ID NO: 142496 - protein, 129 aa, Glycine max
  Coding DNA Sequence Number=SeqID_50811
  Gene Ontology: Mol. function=nucleoside-triphosphatase activity; Biological process=proteolysis
  Homolog annotation: Hit_ID=A7QWN2; Match level="QueryCoverage=92%, HitCoverage=62%, E-value=1e-51, Identity=84%"; Hit description =Chromosome chr4 scaffold_205, whole genome shotgun sequence
  Pfam annotation: Domain name=DUF265; Domain location=2-124; Score =49.7; E_value=1e-11; Accession=PF03266.6; Description=Protein of unknown function, DUF265
MVSFDCIDFGSPESLRWPNVGKYKVDVASFESLALPELQVKEDTDLFIIDEVGKMELFSSSFFPAVLRVLESNIPVLASIPVPKFGRDIPEVARLRNHAGATCFTLSVSNRDAVREQIRSQLEDMLTKH

SEQ ID NO: 142497 - protein, 233 aa, Glycine max
  Coding DNA Sequence Number=SeqID_50812
  Gene Ontology: Cellular component=integral to membrane; Biological process=vesicle-mediated transport
  Homolog annotation: Hit_ID=A7QWN1; Match level="QueryCoverage=86%, HitCoverage=18%, E-value=9e-54, Identity=60%"; Hit description =Chromosome chr4 scaffold_205, whole genome shotgun sequence
MLVSLYVMLDFVLDFWTLLAASTGRKGMPSQEELVRGPVIHKEKKKAFQGLFSSVIKDFTSSKEKHVPLMEKEDPKESIWKLSAVFSHANFVCNDNVDKLTMDENQLELNIDDIGPEDHGEKRKEQTILGFLNKNKLPGTFQSLKGRLKEMKGNNQKTSDKERQQDEKDGALDQIKKKYGFSSSSYESTAAKRARIKLHENTKKLGGINLRATEMQDTAKSFSSLAKQVLQRS

SEQ ID NO: 142498 - protein, 899 aa, Glycine max
  Coding DNA Sequence Number=SeqID_50813
  Gene Ontology: Mol. function=endoribonuclease activity, producing 5' -phosphomonoesters; Cellular component=endoplasmic reticulum membrane; Biological process=protein amino acid phosphorylation
  Homolog annotation: Hit_ID=A7QPE4; Match level="QueryCoverage=92%, HitCoverage=88%, E-value=1e-152, Identity=56%"; Hit description =Chromosome chr18 scaffold_137, whole genome shotgun sequence
  Pfam annotation: Domain name=Pkinase; Domain location=474-790; Score =136.8; E_value=6.2e-38; Accession=PF00069.16; Description=Protein kinase domain
  Pfam annotation: Domain name=Pkinase_Tyr; Domain location=474-790; Score=-31.1; E_value=1.7e-10; Accession=PF07714.8; Description =Protein tyrosine kinase
  Pfam annotation: Domain name=Ribonuc_2-5A; Domain location=795-889; Score=100.2; E_value=6.5e-27; Accession=PF06479.3; Description =Ribonuclease 2-5A
  Pfam module annotation: Pfam domain module=Pkinase::Pkinase _Tyr::Ribonuc_2-5A; Domain location=474-790::474-790::795-889
  Subcellular localization annotation: CTP_CleavageSite=51; ConfidenceScore=5.46e-01
MKCRVSIFLLSLILLFFFFFFFFFSLSASQSQQLSLPSLPAPSLKPATALVAALDGTMYLVDSVSGRVFWSFSTGSPIYHHSYRAPINDPEDNNVTGLIECGDDWELIVHDARFGKTRLSESIANYVALTPTETKEGASIFGSKKDTMFEVDAKTGALVRTHYDLDNASNVVLSGDDRLQRVTTTKNNELVDPAQLDSPEFLLKITRSDYVLKSLGKAGIVLWTMNVAEFKARLICQHNENPSGRDSFDAEDGYVVDRGLDFAMPYACWDMKLNEVYRQRKNFLLHPADPGRLSGIYQENIMLPFHTSELMLPSQPDMDGFILGQGGNMMLPLPISNSLPSLQQKLDFCESNDNVAMLPWPLMEISTQEEVDPKKVIEWSTTLPLILFTIFLGFFVFYHYLVVTNKDQNRELNSRSLPPKKKKARKSVKNNITIDNRQDKPMSSAEEDKLARKETNTDTYTQMQVDGRRIGKLFVSNKEIAKGSNGTIVFEGTYEGRVVAVKRLVKAHHDVAHKEIQNLIASDRHPNIVRWYGVECDHDFVYLALERCTCNLDDLIHMYSDISENPTICEDQYSNFFKNARIDTRNDMRYLWKANGFPSPLLLKLMSISIIGERRKGSIVNVVLDLRWYRLTAPIKKRDVVSGLVHLHELGIIHRDLKPQNVLILKEKSLCAKLSDMGISKRLLEDMSSLGHTVTGCGSSGWQAPEQLVQGRQTRAVDLFSLGCVLFFCMTGGRHPFGERLERDFNIVKNQKDLFLVEFIPEADDLISCLLNPNPDLRLTAIEVLHHPLFWSSEMRLSFLRDVSDRVELEDREIDSDLLKALESIAPLALGAKWDEKLDPDFITNIGRYRRYKYDSVRHLLRVMRNKLNHYRELPQEIQPSTSTLTADNDGDNVDDWLP

SEQ ID NO: 142499 - protein, 321 aa, Glycine max
  Coding DNA Sequence Number=SeqID_50814
MGGSWCGSAKMPTKVSRRERMTDGVFRSVVGDWVEDSWAGLGMGVMWYKAEMLVRGNGAQQFQPLHPQDNIGTTEKGATITHHDLKGLCRCGWKVEETSDAGLDEVVGAPSINQDNHVMIGDGAIETKCLWSRGERGSGGGLVSNWSRVGGSTSGSTIMRAMSSGNNLLKGSLGAEGLAGNGGKTGETSWHNSSKRPDTKQLSRNGGSEAYDPFCEALIFSEIVIHRSSLLQLKQGALWIIVEGWGDLGEEDEGHKVFKDGVNFRVEGGLGLGKGGLCLGEVGVALGKAGDRLLEAVSGGSTRVMLRHDRQQVEPVVTAIN

SEQ ID NO: 142500 - protein, 722 aa, Glycine max
  Coding DNA Sequence Number=SeqID_50815
  Gene Ontology: Mol. function=sugar:hydrogen symporter activity; Cellular component=integral to membrane; Biological process =carbohydrate transport
  Homolog annotation: Hit_ID=A7PKU6; Match level="QueryCoverage=99%, HitCoverage=99%, E-value=0.0, Identity=50%"; Hit description =Chromosome chr7 scaffold_20, whole genome shotgun sequence
  Pfam annotation: Domain name=MFS_1; Domain location=11-656; Score =97.3; E_value=4.7e-26; Accession=PF07690.7; Description=Major Facilitator Superfamily
  Pfam annotation: Domain name=Sugar_tr; Domain location=6-705; Score =179.3; E_value=9.6e-51; Accession=PF00083.15; Description=Sugar (and other) transporter
  Pfam module annotation: Pfam domain module=MFS_1::Sugar_tr; Domain location=11-656::6-705
MMEVVIVAIAATLGNLLMGWDSSTIAAGMTYIKKEFVLDATLEGLIVSMSFIIGTVVTIFSGTVCDLVGRRPMLITSSIMFFLSGLVMLWAPNVVIVLLARIIDGVAIALAVTLTPLYISEVAPADIRGQLNTLTQFACSGGMFLAYILVFSMSLSDSPSWRLMLGVIFIPAVAYFLLAVFYLPESPRWLVSKGRLLEAERVLKRLRGIEDVSGELALLAEGLSPGGEATSIEEYVVAPASELLVNQEAEKDYIKLYGPNDEGVTMVAQPVNGQGSMISRSMLSQQGSFGTLTGGGLKDPIVTLFGSLHENTLPESGGSRSMLLHNANSIFSIGETSSPFGTSDNLHAPLMSFQGGAGEKDRAYGSKDILGMRSNSSLRSNSSLVHGNAVDAPKNTNIGGGWQLVYKSADGAGGGKREGLQRVYLHADTAALSHSQHVSFVSTSGYDIPIDGGEAYQAAALVSQSVLGTHDMLHLTEVAAKGPKWRALLEPGVKRALIVGVGLQILQQAAGINGFLYYAPQILEKAGVGDLLSNLGLSSASASFLVNIITTFCMLPCIAIAIRLMDISGRRSIMLYTVPILIVCLLILVIKQFFQINSVVDAAITAISVVVYESVFCMGFGVIPNIICAEIFPTSVRGICISLTSLTYWGCTLIVTLIFPYLLQLLGLTGVFGLFVVGCIISWIFVYLKVPETKGMPLEVIIEFFAIGAKPGTDPAALGIKG

SEQ ID NO: 142501 - protein, 749 aa, Glycine max
  Coding DNA Sequence Number=SeqID_50816
  Gene Ontology: Mol. function=serine-type endopeptidase activity; Cellular component=extracellular region; Biological process=negative regulation of catalytic activity
  Homolog annotation: Hit_ID=A9XG40; Match level="QueryCoverage=97%, HitCoverage=96%, E-value=0.0, Identity=62%"; Hit description =Subtilisin-like protease
  Pfam annotation: Domain name=PA; Domain location=344-443; Score=80.9; E_value=4.2e-21; Accession=PF02225.13; Description=PA domain
  Pfam annotation: Domain name=Peptidase_S8; Domain location=99-584; Score=56.4; E_value=1e-13; Accession=PF00082.13; Description =Subtilase family
  Pfam annotation: Domain name=Subtilisin_N; Domain location=11-87; Score=67.5; E_value=4.6e-17; Accession=PF05922.7; Description =Subtilisin N-terminal Region
  Pfam module annotation: Pfam domain module=PA::Peptidase _S8::Subtilisin_N; Domain location=344-443::99-584::11-87
MENKSAENPKGTYIVHLAKSEMPSSFNQHSIWYKSVLKSASNSAEMLYTYDNVIHGFSTRLTHEEAWLLRSQAGILKVQPEKIYKPHTTRTPHFLGLDKIADMVPESNEGSDIIIGLLDTGVWPESKSFDDTGLGPIPNTWKGKCESSVDFNASSCNKKLIGARSYSKGYEAMMGTIIGITKSPRDIDGHGSHTASTAAGSVVKGASLFGYASGTARGMASRARVAVYKVCWKDSCVVSDILAAMDAAISDNVNVLSISLGGGGSKYYDDDGVAIGAFAAMEKGILVSCSAGNDGPDPSSLGSNTAPWVITVGAGTIDRDFPAYVSLGNGKNYSGVSLFSGNSLPDNNSLFPITYAGIASFDPLGNECLFGSLDPKKVKGKIVLCDLGNIPMAEKGFAVKSAGGVGLVLGTVENDGEEQATEPTNLPTIVVGIEATKAIKKYLLYDPKSMATIVSQGTKVGIEPSPVVAEFSSRGPNLLTPQVMKPDLIAPGVDILGAWTRHKGPTDYKEDHRRVDFNIISGTSMSCPHVSGIAAIIKSVNPNWSPAAIRSALMTTAYSTYTNGKSLIDSATNKSSTPFDIGAGHVNPVLALNPGLVYDLTTTDDYLHFLCALNYTPKRIESVARRKYKCDPHKHYNVADLNYPSFSVVYKTNNPTIVKHTRTLTNVGVAGTYNVSVTLDIPSVKIVVEPNVLSFNQNENKSYTVTFTPSGPSPSTGFGFGRLEWSNGKNIVGSPISIYFEPPGVIGNS

SEQ ID NO: 142502 - protein, 60 aa, Glycine max
  Coding DNA Sequence Number=SeqID_50817
MGEKTSRRYKYVGSKWKYKVYKGRHLMLQGQKNKGGELRSFKPKDKVYAHWKLNFFITKI

SEQ ID NO: 142503 - protein, 104 aa, Glycine max
  Coding DNA Sequence Number=SeqID_50818
MARVVTDGIATGGANGGRWLELEALFLLCGGGGGGFEGSGQRPFAELEALSLLCGGGGGGFEGSGQRALWIVNLLGASMNTTLKPKALVSSCSCKLCFEKPRLR

SEQ ID NO: 142504 - protein, 1221 aa, Glycine max
  Coding DNA Sequence Number=SeqID_50819
  Gene Ontology: Mol. function=microtubule motor activity; Cellular component=microtubule associated complex; Biological process =microtubule-based movement
  Homolog annotation: Hit_ID=O24147; Match level="QueryCoverage=100%, HitCoverage=99%, E-value=0.0, Identity=67%"; Hit description=Kinesin- like protein
  Pfam annotation: Domain name=FERM_M; Domain location=354-457; Score =61.4; E_value=3.1e-15; Accession=PF00373.9; Description=FERM central domain
  Pfam annotation: Domain name=FERM_N; Domain location=287-352; Score =15.2; E_value=0.00053; Accession=PF09379.1; Description=FERM N -terminal domain
  Pfam annotation: Domain name=Kinesin; Domain location=853-1168; Score= 510.1; E_value=2.5e-150; Accession=PF00225.14; Description=Kinesin motor domain
  Pfam annotation: Domain name=MyTH4; Domain location=164-278; Score =155.8; E_value=1.2e-43; Accession=PF00784.8; Description=MyTH4 domain
  Pfam module annotation: Pfam domain module=FERM_M::FERM _N::Kinesin::MyTH4; Domain location=354-457::287-352::853-1168::164 -278
  Subcellular localization annotation: CTP_CleavageSite=58; ConfidenceScore=5.12e-01
MTIDVPPSGAQSVRTNRPSFSSSNGIEATPVHNYASVSNGDGYDSDGSNFAPLTPTTLSMAIPSELAGAVPLIDKFQVEGFLKLMHKQIQSAGKRGFFSKRSVGPQVREKFTFEDMLCFQKDPIPTSMLKLNGDLASRATKLFQIILKYIGVDLSDRVTPISLEEQVELVGKLYKQSLKRSELRDELFVQLSKQTRNSPEREYLIKAWELMYLCASSMPPSKDIGAYLSEYVHNVAYGVTADPEIRALALNTLNALKHSVKAGPRHIIPGPVEIEALLTGKKLTTIVFFLDETFEEITYDMSTTVADAVEEYIGLDDNKYIGDLLAEFKAVKDRSKGDILHCKLIFKKKLFRESDEAVTDPMFLQLSYVQLQHDYILGNYPIGRDDAAQLSALQILAEIGFVRRPESCAQIAMTRARREWELDILSCYHSLAHVTKEDARQQFLHILRTLPYGFSVFFNVRKIDDPIGLLPGRIILGINKRGVHFFRPIPKEYMHSAELRDIMQFGSSNTAVFFKMRVAGVLHIFQFETKQGEEICVALQTHINDVMLRRYSKARSAAGGPLNEDISNDFKPSNLELYEKRVQELSKLVEESQRNADQLLDNLREKQKQEEEMLQELEGLKRSLTAGKQSLAEVTNDRDKLRSLCDEKDKALQAEILEKRSMEAKMAELSNLVTKNTTKKDCTQTNNQVSQKLEDDLKLCKGELRVTEETIKSLRSDKLILEQKLSELEKKSAEEINSLQWKLEQERKTLNSKVYDLERKLDVFRQELTVAESTLSVKDSELAALKNNLDELEELREMKEDIDRKNEQTAAILKMQAVQLAEMELLYKEEQVLRKRYFNTIEDMKGKIRVYCRLRPLSEKEIASKERDSLTTTDEFTVEHPWKDDKPKQHIYDRVFDGDATQEDIFEDTRAMQSAVDGYNVCIFAYGQTGSGKTFTIYGVENNPGLTPCATAELFRILRRDSNKYSFSLKAYMLELYQDTLVDLLLPKNAKRLKLDIKKDSKGMVAVENVTIVSISTMEELNSIIQRGSEQRHTSGTQMNDESSRSHLILSIVIESTNLQSQSTARGKLSFVDLAGSERVKKSGSSGSQLKEAQSINKSLSALGDVISALSSGGQHIPYRNHKLTMLMSDSLGGNAKTLMFVNVSPVESSLDETHNSLMYASRVRSIVNDPSKNVSSKEIARLKKLIGYWKEQAGRRGEDEDLEEIQEERPTKERTDGRHS

SEQ ID NO: 142505 - protein, 146 aa, Glycine max
  Coding DNA Sequence Number=SeqID_50820
  Homolog annotation: Hit_ID=A7QKK7; Match level="QueryCoverage=80%, HitCoverage=33%, E-value=4e-25, Identity=49%"; Hit description =Chromosome chr2 scaffold_113, whole genome shotgun sequence
MKEENQIEELWREVRDLSLGNSGRDTGEFDLELEKPTRYVPWCSVDPYPSLRTMDDEMAKFPLYFNGPRPFECTVKAGEDEIHAGQVCGSIMLDRVRMMEGYHMQFDIKYAYFNFLQSIRYRSTPSTMINDKLSEEIDSDSAYYES

SEQ ID NO: 142506 - protein, 52 aa, Glycine max
  Coding DNA Sequence Number=SeqID_50821
MAVNESKEWVSGTRKTKSLRQNMLTSRSHYGRDEPMPRLCLFVLCNSWSNPV

SEQ ID NO: 142507 - protein, 429 aa, Glycine max
  Coding DNA Sequence Number=SeqID_50822
  Gene Ontology: Cellular component=Golgi transport complex; Biological process=protein transport
  Homolog annotation: Hit_ID=A9PE43; Match level="QueryCoverage=98%, HitCoverage=68%, E-value=1e-148, Identity=61%"; Hit description =Putative uncharacterized protein
  Pfam annotation: Domain name=COG6; Domain location=31-428; Score =167.1; E_value=4.8e-47; Accession=PF06419.2; Description=Conserved oligomeric complex COG6
MGTSVADLAPGLSRKLKKVQESRIDTPYLLSSLNTLSSFYDDNTPQARRNLRSTIEKRALSINCEFLDASHAAQLALDSVENEVDSLAACCDRRRRIMQLGGNEAVPSFRASKHNRAEYVLALLTLSVPQRGSNKSLKLLHKEIVACFLRDYQLSPEEINALREEELNENFFKALSHVQEIHANCKVLLRTHHQRAGLELMDMMAVYQEGAYERLCRERSVLFKYCAEEVANMRHNALFRRFISALTRGGPGGLPRPIEVHAHDPLRYVGDMLGWLHQALASERELVAVLLDPDTITDSGPKQFSNNSEDGSGKTESDLMFVLDRIFEGISDLLGRETALCNTLWALKDAAQNTFFDILKGRGEKLLRYPPLVAVDLSPPPAVTEGVSVLLEIIDNYNSMMVPASGQKPAFGPVISAILDPIVQEYPAP

SEQ ID NO: 142508 - protein, 127 aa, Glycine max
  Coding DNA Sequence Number=SeqID_50823
MNNLVYVMYNLKLKSRQIRKVVALPFENMKSNDEWITKQGDDIFYENNVQVKQEQPLGENDSGNNIDLVGKSLTDPTLDVFDIDNLILNDNVKDHFSTKEELEDDGEEENVGDSDIRDNFIKGLMDI

SEQ ID NO: 142509 - protein, 176 aa, Glycine max
  Coding DNA Sequence Number=SeqID_50824
MIVTLNDVSCLLHLPVIGRPIDHVPSTFNRKVVKILLMTRLGILTNEEAIALTTAGARSWAFVHLPTVGYFEPTTDALDDPVRDERMALSFKEGAKAIWSCLEHPMPSITTSMWFPTPYAIPSEKREPACSLVRLSPILVELSPGQTLAEYVASGDYSLLGLISDGVTHHVELTRS

SEQ ID NO: 142510 - protein, 227 aa, Glycine max
  Coding DNA Sequence Number=SeqID_50825
  Homolog annotation: Hit_ID=A7QKL8; Match level="QueryCoverage=92%, HitCoverage=62%, E-value=8e-75, Identity=68%"; Hit description =Chromosome chr2 scaffold_113, whole genome shotgun sequence
MGHASPYKEVKGMPVENRDGEDMVELVRSCQNEFKEYYIQMQAAKRSQAPHPSQLSEKLRLTRHFLSFYNFPYSLGVPCGEEKGIELKDDRIILDKTLADQVSSWKSSRGLSDTVVTDHACSGETCSYYHIGDVFICEKTGQVHVCDDTCREVVMDPTNELLVCTISGHCFDRLLSPSEMEPDTEQQQGGVTDEAEPFMGSGRFARAYSLGYNCADEKELEATLRFC

SEQ ID NO: 142511 - protein, 102 aa, Glycine max
  Coding DNA Sequence Number=SeqID_50826
  Homolog annotation: Hit_ID=Q99JN9; Match level="QueryCoverage=38%, HitCoverage=20%, E-value=2e-07, Identity=60%"; Hit description =Putative uncharacterized protein
MGGGKDKHNEEEKGVFSHLAHGVAQAAHGYPPGASPSSPRDMVWTPSTSTIGVQAWIRKHGKFKHGKFGKAFVDFIGLRTESSHCLYMNNYKPCILETWMYI

SEQ ID NO: 142512 - protein, 147 aa, Glycine max
  Coding DNA Sequence Number=SeqID_50827
  Gene Ontology: Mol. function=nucleic acid binding; Cellular component= intracellular; Biological process=defense response signaling pathway, resistance gene-dependent
  Homolog annotation: Hit_ID=Q9C801; Match level="QueryCoverage=70%, HitCoverage=23%, E-value=3e-09, Identity=36%"; Hit description =Protein MOS2
MTVMVSCRGVAFHQKLKNDLERLLEDHATRGVQECRCRRKGLDWATKDVKVVKIKWRTAKEGLRFFGDAPPALILSNNEKDNKNKEKKEKSEKEKVVRIVGGRDAGLKGNVVFRIGDDYLVLELSRSGEKVKIKVGDVVELGSKEEE

SEQ ID NO: 142513 - protein, 478 aa, Glycine max
  Coding DNA Sequence Number=SeqID_50828
  Homolog annotation: Hit_ID=A2XQJ0; Match level="QueryCoverage=25%, HitCoverage=21%, E-value=6e-08, Identity=33%"; Hit description =Putative uncharacterized protein
MEGRREEVDGGEEEIVVLPKVEEEKRGGIETVEDYWLVGKKDMELILKMALWNFNRNLVIIEKIKNYKNPNMVDLSKCPFWVRIYDLLISQRTKTVAVSLKNNMVIGGINKEVFVEGVMRKLRNEGEKEQNEGIDNRQELRVKIEDVADSLLKFRLSNEESYNKKNEVAKEKVVEEKEGTRSTSANPKEETSLLAKLMKSKYHPHGSLWEALKGYRSSFTWASILEAKRILEEAHEATQVPKGMKADSLYGKHTSNGIYSVKSGYFVANSRWNPTKSTLSKGGGFVEEHMDRRCITKMQEFGLASFFKYPPSLVEFKGKEDLSGLPMSHWVEFFIDIMDEDPRAMMFVILWAIWYTRNQHVFQNKRMKVQPLLSKMAFVPLSREDITMAQESNLIPTYGKTPPLGIFKINFDAAMRKEVGTRLGFIVHDSEGLVLAPASMLIQSMFGPREAEAFTFQWSIIKAAELLLSDACYEIDCL

SEQ ID NO: 142514 - protein, 64 aa, Glycine max
  Coding DNA Sequence Number=SeqID_50829
MRAKLETTDEVQDIARQEDTIQRFNHKPFNLVTSYGESEVKPEKIPKWESLVSIGKAYSWSQQA

SEQ ID NO: 142515 - protein, 1015 aa, Glycine max
  Coding DNA Sequence Number=SeqID_50830
  Gene Ontology: Mol. function=protein binding; Cellular component =membrane coat; Biological process=intracellular protein transport
  Homolog annotation: Hit_ID=A7QKM8; Match level="QueryCoverage=93%, HitCoverage=97%, E-value=0.0, Identity=64%"; Hit description =Chromosome chr2 scaffold_113, whole genome shotgun sequence
  Pfam annotation: Domain name=Adaptin_N; Domain location=69-632; Score= 181.3; E_value=2.4e-51; Accession=PF01602.11; Description=Adaptin N terminal region
  Pfam annotation: Domain name=HEAT; Domain location=180-216; Score =22.5; E_value=0.0015; Accession=PF02985.13; Description=HEAT repeat
  Pfam annotation: Domain name=HEAT; Domain location=348-384; Score =7.5; E_value=2; Accession=PF02985.13; Description=HEAT repeat
  Pfam module annotation: Pfam domain module=Adaptin_N::HEAT::HEAT; Domain location=69-632::180-216::348-384
MTTPNVVLRVRDPPVVCIHRSRQHSSDHSHSLTPGSSKRRRGAAEDAGGEGADNGLSPWPLEGVSGPHQDRIVLREIETLKRLLNDADTPKRKIKEYIIRLLYVEMLGHDASFGYIHAVKMTHHDALLLKRTGYLAVTLFLSDDHDLIILIVNTIQKDLASDNYLVVCAALNAVCRLINEETIPAVLPRVVDLLNHSKDAVRKKAVMSLHRFYLKSPSSVSHLLSNFRKRLCDNDPGVMGASLCPLFNLVSDDVHSYKDLVVSFVNILKQVAEHRLPKTYDYHQMPAPFIQIKLLKILALLGSGDKQASGHMYTVLEDIIRRSDSMTNIGNAVLYQCICCVASIYPNPKLLEAAADVIAKFLKSDSHNLKYMGIDALGRLIKLSPHIAEQHQLAVIDCLEIKAVGDFDPDDSLKRKTFELLYKMTKSSNVEVIVDRMIDYMISISDDHYKTYIASRCVELAEQFAPSNHWFIQTMNKVFEHAGDLVNIKVAHNLMRLIAEGFGEDDDAADSQLRSSAAESYLRIIGEPKLPSVFLQVICWVLGEYGTADGKYSASYISGKLCDIAEAYSNDENVKAYAISALLKIYAFEVAAGRKVDILSECQSLIEESLASHSTDLQQRAYELQALIGLDVQAVETIMPRDASCEDIEVDKNLSFLNGYVQQSLERGAKSYIPEDVRTGMGNMNNFRSQDHHETLQHGLRFEAYEVPKAPMQPKVTPVSFASSADIVPVPEVLSSRETHHISSVGSTSEAGSSELKLRLDGVQKKWGKPMYSSSTSSASVSYSTSQKPTNGATQVDGATTVNSKVRDSYDSRKTQVEITPEKQKLAASLFGGSTKPEKRSSTSHKVSKSSASAADGSQGSKAAVVPNDVAVEKTIHQPPPPDLLDLGEPTVTTAPPYVDPFKELEGLLDPSTKSATNHNVAAATNAPDIMSLYAETTASGGYSIPVSGGYDVNLLSELSNAAAKATSGETIVTSLPQSIMGRNAKDSLEKDALVRQMGVNPSSQNPNLFSDLLG

SEQ ID NO: 142516 - protein, 480 aa, Glycine max
  Coding DNA Sequence Number=SeqID_50831
  Homolog annotation: Hit_ID=A7QKN0; Match level="QueryCoverage=25%, HitCoverage=65%, E-value=3e-36, Identity=62%"; Hit description =Chromosome chr2 scaffold_113, whole genome shotgun sequence
  Pfam annotation: Domain name=DFDF; Domain location=342-365; Score =37.4; E_value=5.1e-08; Accession=PF09532.1; Description=DFDF motif
  Pfam annotation: Domain name=FFD_TFG; Domain location=397-441; Score =62.9; E_value=1.1e-15; Accession=PF09542.1; Description=FFD and TFG box motifs
  Pfam module annotation: Pfam domain module=DFDF::FFD_TFG; Domain location=342-365::397-441
  Subcellular localization annotation: CTP_CleavageSite=25; ConfidenceScore=5.02e-01
MNLQIKSPTPSSKSEEQVFSDPAVIQSEYSGLRSSPVGELPSSPVAGLLSSPVASVGGRSLTESIQRQDSPAISSKAFPSGLPSHQSVTQLGPSNLSDATQVASHPSFSAAMYWQGPSGISSSSYHSLLQSSSLHPTSLAASLVVQNQMQNAETQVPINGGWTGLSEYGLPVSSAMTSLVNQTHSPSLTSLKNSDSLDIPSLLSTKTPVSYSPSMTFDGSNMPQFSSTLQDINSIQAQISGNICPDPRPIHPQHSVHRSAPSYVDSTSGSLPTATSLLTPDQFAYPREQLLSLSHLNPTQKDMGSLTLTSSGSSALIPSPASQAPLLPLPTSVQKPPYTAPQYTEEFDFEAMNEKFKKDEVWGSLGKTTTKIEGVANNASLSLGDRECHGVIPNPKTAYKKDDFFDTISCNSLTHGSRNGQNRFSERMKQDTETFGNFQQRPNFTNGGYGAGRGANFRGSNNWGRGYGYNGRGRGPNFPF

SEQ ID NO: 142517 - protein, 20 aa, Glycine max
  Coding DNA Sequence Number=SeqID_50832
MVWDNLQDAPLTWVNDSTPV

SEQ ID NO: 142518 - protein, 600 aa, Glycine max
  Coding DNA Sequence Number=SeqID_50833
MTIGGCGVVLCEQCRGRTGDVWWGLRGCPGIAMCIQDELPAGNEALQGRSEKSLTESWTGRTPMTSDNGEVLTKKALPPILDHRGDSKQFSDICGSTEEFHIEWFAEEGNEGSGKRLFQLLKSQLGLRGPYKWLNGGGLDHGGCNSGIAYDESPVSLKGSTVYEDIVKEDDDEVVEVWPENQVHCGLEGRWHVAQPKQHYFELVMAVMGSEGGLGDISIMEPIPDRHHVKSTVVDAKPPRTILLLDKQHRRREEARAGLNKPFLKHGINLKLNLLLLIVRITVGPHVDWRGVWDQVNIMIDGPSRRKALGCVDGKWVRRIFKKYNNMEVGNIVVFPIEATKLGHGSEWSKKLIHKGWCTPSIDHFPPSLVMGFEWSDRASSGRKPVRRKVSGAKLPDNEVKLIWAGVYMRPTGVFIFHDKKENPRGATMPSMVVRAREAGASWDEESGMMGLGFAANLWHQAEDEATQKERGRQIDNVISQVFELRQECGPGGKLGVAVLVDLKDPTKRFGAVKTRHFYLHFVGGCRNRGGVGHRVHGIAKTSKDILEMAGEACVLVEEEDTEKRREGTKKDKTTSSKEEIFPKVTSLIIIHSSSDVVVE

SEQ ID NO: 142519 - protein, 418 aa, Glycine max
  Coding DNA Sequence Number=SeqID_50834
  Gene Ontology: Mol. function=transferase activity; Biological process= paclitaxel biosynthetic process
  Homolog annotation: Hit_ID=A7QKP0; Match level="QueryCoverage=95%, HitCoverage=98%, E-value=1e-129, Identity=54%"; Hit description =Chromosome chr2 scaffold_113, whole genome shotgun sequence
  Pfam annotation: Domain name=Transferase; Domain location=7-396; Score=291.6; E_value=1.6e-84; Accession=PF02458.6; Description =Transferase family
MSSRTSFSVVHGEPELVVPAGPTPRELKNLSDIDDQEGLRFQHQVIMFYQKSHVMEGKHPATVIKYGLAEALVHYYPLAGRLREWPNRKLTVDCSGEGILFVEAEAHVSLKELGNSILPPCPHMKELLLDVPGSQGILGCPLLLFQVTRLTCGGFAFAARMNHTICDSLGLVQFLTMVGEIARGVSISQFPVWQRELFNARDPPRITYAHHEYDETKHCSNKDTMDFDQMAHESFFFGPKEIATLRSHLPQHLRKCSTFEILSACLWKCRTKALGLEPNEIVGLSPFITARGKVGLHVPNGYYGNAFAFPMALSKAGLLCQSPLEYALGLIKKAKAQMGLEYVKSVADLMVLKGPAGAIPFVSFYGRFRNNEGEDGVVVPILLPHHVMKRFLFELVKITSERQPTYDGIALPLDAMCM

SEQ ID NO: 142520 - protein, 107 aa, Glycine max
  Coding DNA Sequence Number=SeqID_50835
MASQFASEPLMEKEETVAHCLIAKTMATIDSNPKNGTSENIIIITKPWDVKRVQNVAQIEVDNKHKSFTVIKVKAFYNGFLGDVAGEAKMGIEAPTEAYFSVPVLPN

SEQ ID NO: 142521 - protein, 599 aa, Glycine max
  Coding DNA Sequence Number=SeqID_50836
  Gene Ontology: Mol. function=binding
  Homolog annotation: Hit_ID=Q8H132; Match level="QueryCoverage=91%, HitCoverage=95%, E-value=0.0, Identity=62%"; Hit description =Putative uncharacterized protein At4g19450
  Pfam annotation: Domain name=DUF1218; Domain location=160-259; Score=- 14.1; E_value=0.039; Accession=PF06749.3; Description=Protein of unknown function (DUF1218)
  Pfam annotation: Domain name=MFS_1; Domain location=9-500; Score= -18.8; E_value=0.079; Accession=PF07690.7; Description=Major Facilitator Superfamily
  Pfam annotation: Domain name=Nodulin-like; Domain location=7-255; Score=360.3; E_value=3.2e-105; Accession=PF06813.4; Description =Nodulin-like
  Pfam module annotation: Pfam domain module=DUF1218::MFS_1::Nodulin -like; Domain location=160-259::9-500::7-255
MAGQSRKWMILVATIWIQAFTGTNFDFSEYSSSLKSHLNISQLQLNYLATASDMGKVFGWSSGLALMYLPLSLVLFIASSIGFIAYGLQWLAIKNLITLPYYLFFLLCLLSGCSICWFNTVCFVLCIRNFPVNRPLALSLTVSFNGVSAALYTLAANSIDPSSDALYLLLNALVPLLTSLAALVPILLQPPLDSLNRSPEASRRNSVIFLVLNFLAIFTGIYLLLFGSSTSDESTSRLYFGGAILFLISPLCIPGTIYARDWFHHAIHSSFRMEGSGFILVHVDDLELHKELLTRQNSTLSLSNGDGHGLLSENGSKYRSQSAKSSDVCCGKMFGQDQLAMLGEEHTAAVVVQRLDFWLYYVTYFCGGTIGLVYSNNLGQIAQSLGLSSSISTLVTLYSAFSFFGRLLSAVPDYIRNKFYFARTGWLAIGLVPTPVAFILLAVSDSAAALKTGTALIGLSSGFIFAAAVAVTSELFGPNSVSVNHNILITNIPIGSLLFGFLAALIYDENAYKIPGELMADTLVCMGRKCYFWTFVWWGGMSVLGLCSTQAMELLILEGGCIGVMILEAELKQGRVKILFLSPAMHQTGKTWKLWKHEV

SEQ ID NO: 142522 - protein, 334 aa, Glycine max
  Coding DNA Sequence Number=SeqID_50837
  Gene Ontology: Mol. function=protein binding; Cellular component =nucleus; Biological process=cell division
  Homolog annotation: Hit_ID=A7PLG7; Match level="QueryCoverage=88%, HitCoverage=82%, E-value=7e-91, Identity=58%"; Hit description =Chromosome chr7 scaffold_20, whole genome shotgun sequence
  Pfam annotation: Domain name=Cyclin_C; Domain location=164-294; Score= 60.1; E_value=7.5e-15; Accession=PF02984.10; Description=Cyclin, C -terminal domain
  Pfam annotation: Domain name=Cyclin_N; Domain location=37-162; Score =90.1; E_value=6.8e-24; Accession=PF00134.14; Description=Cyclin, N -terminal domain
  Pfam module annotation: Pfam domain module=Cyclin_C::Cyclin_N; Domain location=164-294::37-162
  Subcellular localization annotation: CTP_CleavageSite=12; ConfidenceScore=5.27e-01
MPQPHSPSFLLCQQHYSFSFQQHSQTLTPPSPFTFPDNHQHDHLLSLLSKQRATHSSFSPRHDVVRWISTVSDFHAFAPLTTVLAVNYFDRFVTTLRFQSEQKPWMTHLAALACVSLAAKVEETRVPLLFDFQVGESKFLFEAKTIQKMELLVLSTLEWKMNPVTPISFFQHFLARLGLKRHLHSEFLCRCQRLLLSVIADSRVMSYLPSTLAAAIMIHIIKEIEPLNATEYQNQLPGLLKTSEEQVNECYKLILGLYVCSNGIHNLRRKRLSEPSSSPDGVIDASFSCDSSNDSWTVASPSVEPVFKRRKPQDQQMRLPSVNRVVIDVLNTPR

SEQ ID NO: 142523 - protein, 572 aa, Glycine max
  Coding DNA Sequence Number=SeqID_50838
  Gene Ontology: Mol. function=protein binding; Cellular component =cytoplasm; Biological process=ubiquitin cycle
  Homolog annotation: Hit_ID=Q9FE83; Match level="QueryCoverage=83%, HitCoverage=90%, E-value=1e-161, Identity=60%"; Hit description=F -box protein SKIP2
  Pfam annotation: Domain name=F-box; Domain location=83-129; Score =27.5; E_value=4.8e-05; Accession=PF00646.24; Description=F-box domain
  Subcellular localization annotation: CTP_CleavageSite=48; ConfidenceScore=5.68e-01
MNPYANPGHAPVVARVTHAPPPLSSTRCFLLRFKILPYLSATSCTNPPFSMGQSPSTSAAPPPDLNRLQIAQLHPNTDSDSTDYTLRLSDDCLAAIFHFLNTADRKRCSLVCLRWRLVDGQRRHRLSLNAQPELLDFVPSLFNRFDSVTKLALRCDRKCASINDEALVLISLRCRNLTRLKLRGCRDITELGMAGVGDNCKALKKLSCASCMFGAKGIAAVLDRCFTLEDLTLKRLRGVHHIGDMAVGAAASLKSICLKELVNGQSFAPLLIGSKKLRTLKVIGCTGDWDETLVRVGCSNNGLVEVHLEKLQVTDVGLVAVSKCLGLDTLHVVKTAECSDVGLCAVAERCKLLRKVHIDGWRTNRIGDDGLVAIAKHCLNLQELVLIGVYPTFSSLAAIASNCGNLERLALCGIGTVGDAEIECIADKCVALRKLCIKGCPVSNAGIGALASGCPNLVKLKVKKCKRITGKGVEWVREQRVSLAFNYDDSEFEALDGGASDGVGGAQDNTVEFLPNIINQTTVAEAEASSSNNNNRMTMLRSRFGFLAGRNLVPGAFRRWSNSDNVSSSSFG

SEQ ID NO: 142524 - protein, 40 aa, Glycine max
  Coding DNA Sequence Number=SeqID_50839
MADKCDYSPNCGQVTVADNSQSQVVAYFRTQEYFGVWGLV

SEQ ID NO: 142525 - protein, 205 aa, Glycine max
  Coding DNA Sequence Number=SeqID_50840
MASLLNLPVLEVPLLEGARDVDGEVGADAAGDVDGGAEGAEGAPAAGGGEGGAKGPGFGEGVEDQGAGEGRGEVVGGGGEEDEAVSGGDGLDGEVAGEEGGVAAEEKVVEGWVGREGEPRGGDGIEGVELDDGGRVGVGENGVERKKGRERRGGDLGSKVVLLVDEYVVLVFGVWLWKKKKKKTTQAWLWPWDGTVGKGKDRKWG

SEQ ID NO: 142526 - protein, 248 aa, Glycine max
  Coding DNA Sequence Number=SeqID_50841
  Gene Ontology: Mol. function=methyltransferase activity; Biological process=metabolic process
  Homolog annotation: Hit_ID=A7P453; Match level="QueryCoverage=78%, HitCoverage=78%, E-value=3e-94, Identity=84%"; Hit description =Chromosome chr1 scaffold_5, whole genome shotgun sequence
  Pfam annotation: Domain name=Methyltransf_11; Domain location=105 -186; Score=44.0; E_value=5.5e-10; Accession=PF08241.3; Description =Methyltransferase domain
MKLTPTKPFILRCFLISLFLSLPFLFLYLFYPQQQQHHITTKDLRIRPGYSSYESYIQRQLNKTLNPKLRKIWTTRDWNRKIPVFARFFEDLKVKKLLKNTSKALCIGARVGQEVEALRRIGVVDSVGMDLVPYPPLVMKGDFHNQPFQNDTFDFEFSNVFDHALYPQRFVSEIERTLKPEGVCVLHVALSRRADKYSANDLYSVQPLVELFKRSALVHVRSVDGFGLDTEVAFRKKGEPPPAAHHRL

SEQ ID NO: 142527 - protein, 164 aa, Glycine max
  Coding DNA Sequence Number=SeqID_50842
  Homolog annotation: Hit_ID=A5BKB9; Match level="QueryCoverage=45%, HitCoverage=7%, E-value=1e-12, Identity=50%"; Hit description =Putative uncharacterized protein
MGLGMEKSANMRTSKPSRKGIDRKKRKGNKIARTHRRLGLGGIKVLVMPVTGGRNHLTGDRRKGMYVLKTVMYSLDRVFSKAVPKTLFELWTNRTPSIRHLIRIVKSGNVRFIENGEISGSIVPREVKIKEVRVQIPLVFIVTNNNEEVKGPDSPVLTIGHPAH

SEQ ID NO: 142528 - protein, 148 aa, Glycine max
  Coding DNA Sequence Number=SeqID_50843
MDRANCNIMVGGLVDDVGIDMSRNTIDPCLGQYKYFQILDYSKHLLNLISLGHALGAGRGRGISEDAHEADVPRRRRPTASARRQRVRLREGVTERPEDVPQLHEDVPHVSDATPEMTGAVDAVQTEGVATDGSLGSPAADEGFPGGP

SEQ ID NO: 142529 - protein, 525 aa, Glycine max
  Coding DNA Sequence Number=SeqID_50844
  Homolog annotation: Hit_ID=A7PLG1; Match level="QueryCoverage=99%, HitCoverage=99%, E-value=0.0, Identity=72%"; Hit description =Chromosome chr7 scaffold_20, whole genome shotgun sequence
  Pfam annotation: Domain name=DUF247; Domain location=91-511; Score =726.5; E_value=1.9e-215; Accession=PF03140.6; Description=Plant protein of unknown function
MVAVFNKELLSWYLITLKLKETLESGIPSSPNSGNRSTEFPQQQQEPTEALQVVINEDGEKFEEEPNSPTSEWVVTIKEKLDEAGQEDVASSWSKLSIYKIPHYLRDGSGDDKSFAPQIVSIGPYHHGKKRLRQMDRHKWRSLNHVLKRTKHDIRLYLNSMKEIEERARSCYEGPISLSSNEFAEMLVLDGCFVLELFRGATEGFKQLGYSRNDPVFAMRGSMHSIQRDMIMLENQLPLFVLDRLLGTQLGKPDLKGLVASLSLRFFDPLMPTDEPLTKSDRNKLESSLGGTNTFDPLSDQEGLHCLDVFRRSLLRSGPQPVPRIWIKRRSNAQRVADKRRQQLIHCVTELKEAGIKFKKRKTDRFWDIKFKDGKLRIPRLLIHDGTKSLFLNLIAFEQCHLDCSNDITSYVIFMDNLINSPEDVGYLHYRGIIEHWLGSDAEVADLFNRLCQEVVFDINNSYLSPLSEDVNRYYNHRWNTWCASLRHNYFSNPWAIISLVAAVVLLLLTLAQTYYGIYGYYRPA

SEQ ID NO: 142530 - protein, 40 aa, Glycine max
  Coding DNA Sequence Number=SeqID_50845
MRDDEAVPKREKEKKKKKKKKLWIPPLPVLRDGCCAACSS

SEQ ID NO: 142531 - protein, 925 aa, Glycine max
  Coding DNA Sequence Number=SeqID_50846
  Gene Ontology: Mol. function=binding; Cellular component=nucleus; Biological process=metabolic process
  Homolog annotation: Hit_ID=A7Q1I8; Match level="QueryCoverage=67%, HitCoverage=91%, E-value=1e-150, Identity=40%"; Hit description =Chromosome chr7 scaffold_44, whole genome shotgun sequence
  Pfam annotation: Domain name=PPR; Domain location=224-258; Score =12.5; E_value=0.26; Accession=PF01535.11; Description=PPR repeat
  Pfam annotation: Domain name=PPR; Domain location=286-320; Score =32.8; E_value=1.2e-06; Accession=PF01535.11; Description=PPR repeat
  Pfam annotation: Domain name=PPR; Domain location=348-382; Score =41.2; E_value=3.6e-09; Accession=PF01535.11; Description=PPR repeat
  Pfam annotation: Domain name=PPR; Domain location=410-444; Score =27.4; E_value=5.2e-05; Accession=PF01535.11; Description=PPR repeat
  Pfam annotation: Domain name=PPR; Domain location=516-550; Score =24.0; E_value=0.00054; Accession=PF01535.11; Description=PPR repeat
  Pfam annotation: Domain name=PPR; Domain location=578-612; Score =30.8; E_value=4.9e-06; Accession=PF01535.11; Description=PPR repeat
  Pfam annotation: Domain name=PPR; Domain location=679-713; Score =43.0; E_value=1.1e-09; Accession=PF01535.11; Description=PPR repeat
  Pfam annotation: Domain name=PPR; Domain location=714-748; Score=3.7; E_value=2.8; Accession=PF01535.11; Description=PPR repeat
  Pfam annotation: Domain name=Ribosomal_L18p; Domain location=7-105; Score=-38.4; E_value=0.021; Accession=PF00861.13; Description =Ribosomal L18pL5e family
  Pfam module annotation: Pfam domain module=PPR::PPR::PPR::PPR::PPR::PP R::PPR::PPR::Ribosomal_L18p; Domain location=224-258::286-320::348 -382::410-444::516-550::578-612::679-713::714-748::7-105
MMSDSTNKFQARFLKHMRLAHKDIENRELLAIIAHKRLRVGVGVCSPFATTVNPCLALLCCWQLPLSTVYRVGILAALRSLKTRSVIGLMITASHNKVSDNGIKIADPSGGMLSRHWEPFADALANAPSPQRLLLLINEFVEKEGISVDGDWQVESIFPRILKSSFHNVYRVNHSRPRKPPFPFPKRTECDESLLLHYLSNGWHDDARNLLQNSSGGDLHSRVVRWTSLLSNFSRHGFVTEARTLFDIMPHRNLVSYNAMLSAYLRSGMLDEASRFFDTMPERNVVSWTALLGGFSDAGRIEDAKKVFDEMPQRNVVSWNAMVVALVRNGDLEEARIVFEETPYKNVVSWNAMIAGYVERGRMDEARELFEKMEFRNVVTWTSMISGYCREGNLEGAYCLFRAMPEKNVVSWTAMIGGFAWNGFYEEALLLFLEMLRVSDAKPNGETFVSLVYACGGLGFSCIGKQLHAQLIVNSWGIDDYDGRLRRGLVRMYSGFGLMDSAHNVFEGNLKDCDDQCFNSMINGYVQAGQLESAQELFDMVPVRNKVASTCMIAGYLSAGQVLKAWNLFNDMPDRDSIAWTEMIYGYVQNELIAEAFCLFVEMMAHGVSPMSSTYAVLFGAMGSVAYLDQGRQLHGMQLKTVYVYDLILENSLIAMYAKCGEIDDAYRIFSNMTYRDKISWNTMIMGLSDHGMANKALKVYETMLEFGIYPDGLTFLGVLTACAHVGLVDKGWELFLAMVNAYAIQPGLEHYVSIINLLGRAGKVKEAEDKTNADVARRAAKRLFELEPLNAPGHVALCNIYAANDRHIEDTSLRKEMRMKDKGMKASEQDYFEQLSSSFRCLVDLIPAEKCKFDGVNNKVVVDGANGVGGVKLKDLGKLLNVLIIEVRNSSEDGGVLNDGVGADYVQKEKVLSNNFGSKDTGIR

SEQ ID NO: 142532 - protein, 93 aa, Glycine max
  Coding DNA Sequence Number=SeqID_50847
MMFNLISEDWRGFVTSWLVRADTYFKHSSWIHALDSPPMASTISIVIVDTKKEGTLSKSGNRKEEKEGILKQAQPNSGAKRASGAKRATNCKR

SEQ ID NO: 142533 - protein, 85 aa, Glycine max
  Coding DNA Sequence Number=SeqID_50848
MRLRTASGDVVPINLEIEATCRRNNAARRRREQDTEGSSYTSPPLSPHHAEMDGEPARRVTLESHPRGLLQHRHSSVLHEHCKTG

SEQ ID NO: 142534 - protein, 705 aa, Glycine max
  Coding DNA Sequence Number=SeqID_50849
  Gene Ontology: Mol. function=RNA binding; Cellular component =ribonucleoprotein complex; Biological process=mRNA processing
  Homolog annotation: Hit_ID=A7PEJ5; Match level="QueryCoverage=99%, HitCoverage=99%, E-value=1e-172, Identity=45%"; Hit description =Chromosome chr11 scaffold_13, whole genome shotgun sequence
  Pfam annotation: Domain name=CRS1_YhbY; Domain location=239-322; Score=88.4; E_value=2.3e-23; Accession=PF01985.12; Description=CRS1 YhbY domain
  Pfam annotation: Domain name=CRS1_YhbY; Domain location=357-440; Score=78.8; E_value=1.8e-20; Accession=PF01985.12; Description=CRS1 YhbY domain
  Pfam module annotation: Pfam domain module=CRS1_YhbY::CRS1_YhbY; Domain location=239-322::357-440
  Subcellular localization annotation: CTP_CleavageSite=28; ConfidenceScore=5.07e-01
MDVLLKVAIQLPIFSPPVCPNPTRDRCSTELRFSRWNNANAEKFNRRRRTIQEIEDEICRTRRFTAADNITNTAFAADSAAAAETFKSLGTPSAPSQPSIPGKKSKYSKPPPKPKPLLDSHPVVSRAASLEFRPGPENVRIGDDGVSYVVDGAPFEFRFSYTETPNAKPVKLREPPFAPFGPASLPRPWTGRNPVPPSKTTVKDFHALALPPPDEEEVQPVRLAGPVWESRDEVLGEPLTKDEINRLIKATEKSSRQLNIGRDGLTHNMLENIHTYWMRRSACKIKCRGVCTVDMDNVCQQLEERTGGKIIYRQAGTVYLFRGKNYNYETRPRFPFMRWKPVSPVYPRLIKRVPEGLTLEKATEMRQKGRDLMPICKLGKNGVYWDLVTNIREAFEECELVRINCQELNTSDYRRIGAKLKDLVPCALLSFENDHILMWRGQNWRPSLPDPRDDDKEANKINVDNGNSNKLPSDAQELSALCLQNNPVENLSNEPLDISILSNSDDVSLYKAVSCPTENSNQLVSVVTDAASLSMKSCEAETTEDAMVASCEPQMLPGTNNNSVSNIVDPYSDKFPGAADVSETSRSALCTEGILSLLEQAVEKGSALVLDDEFLDDDLLYQTTVAFAKSTPPEPVYKLPKQVVIVKSERQEGLTLETEEITSVTRIGEKMNKSSKIRRKEYGRGSLNVLVPHRTINVDKLAILK

SEQ ID NO: 142535 - protein, 87 aa, Glycine max
  Coding DNA Sequence Number=SeqID_50850
MNCLQPSLITSLESPSDSSCEKMKKKKKVAATGVSLSKAYALREQHPLSETLSSLNELGESGRESAKHARTISSPSESFVSFGAKRA

SEQ ID NO: 142536 - protein, 235 aa, Glycine max
  Coding DNA Sequence Number=SeqID_50851
MASKKRRACTSQPQREEPTWDSTKFVSEDNIHLRNILPEKNVELTYTQYDEFLEELERRDAFLEWPIIIPEREHLTTFSQFLHTYLDHRTITEKLCMPGGQFILNAEGTPWKILWKDLTTLTQTWTVLSYFNLAPTSHTSYLNMDRTRLIYELGSGRSKCSASHSSTSNSSSGLYSTFPSLYSSRASHFYDVESSIGPISSHAESSSTLPSSATGDDDVAEASDDDDYIADVTTA

SEQ ID NO: 142537 - protein, 423 aa, Glycine max
  Coding DNA Sequence Number=SeqID_50852
  Gene Ontology: Mol. function=transferase activity, transferring glycosyl groups; Cellular component=integral to membrane; Biological process=metabolic process
  Homolog annotation: Hit_ID=A6XNC7; Match level="QueryCoverage=95%, HitCoverage=97%, E-value=1e-140, Identity=54%"; Hit description =(Iso)flavonoid glycosyltransferase
  Pfam annotation: Domain name=UDPGT; Domain location=1-416; Score= -94.4; E_value=7.5e-06; Accession=PF00201.9; Description=UDP -glucoronosyl and UDP-glucosyl transferase
MAFALSSQFCESLVTVCDKKKLKVIFLPFLSTSHIIPIVDIARLIHTVKFPASQVGLPDGVETFNVSTPPDMISKIGKGLSLLQGEIEQLFQDLKADCIVTDMFYPWTADAAANLGIPRLMFLGGSYLSHSAQHSLKKYAPHHLEMTRLQSYGSLFDTFYDLEGTYQEHYKTVTGTKTWSLGPVSLWVNQDASDKAGRGYAKEEGWLKWLKSKPEKSVLYVSFGSMSKFPSSQLVEIAQALEESGHSFMWVVKNRDEGDDRFLEEFEKRVKASNKGYLIWGWAPQLLILENSAIGGLVTHCGWNTIMEGVTAGLPMATWPLFAEQFFNEKPVVDVLKIGVAVGAKEWRPWNDFGKEVVKKEDIGKAIALLMGSGEESAEMRRKAVVLATAAKTAIQVGGSSHTNMLGLIQELKSLRFEGNCLP

SEQ ID NO: 142538 - protein, 230 aa, Glycine max
  Coding DNA Sequence Number=SeqID_50853
  Gene Ontology: Mol. function=transcription factor activity; Cellular component=nucleus; Biological process=regulation of transcription, DNA-dependent
  Homolog annotation: Hit_ID=A9NJI8; Match level="QueryCoverage=63%, HitCoverage=87%, E-value=2e-75, Identity=94%"; Hit description =Dehydration responsive element-binding protein 1
  Pfam annotation: Domain name=AP2; Domain location=26-77; Score=68.7; E_value=2e-17; Accession=PF00847.11; Description=AP2 domain
MESEGRREGGERETTAATRKVEGAERRYKGIRMRKWGKWVAEIREPNKRSRIWLGSYSTPVAAARAYDTAVFYLRGPSARLNFPELLVREGPAALVAGCDMSAASIRKKATEVGARVDALQATLHHHYVPPRQLLSGGGGGSGDFPVRVVDLNKMPEPESSDCEWDRGLRQSDVVDEAYGGVEYCTGTAMAYGAQQLGTKGEIVKGEIEMERATAKGKRCSHGLCFDNDG

SEQ ID NO: 142539 - protein, 511 aa, Glycine max
  Coding DNA Sequence Number=SeqID_50854
  Gene Ontology: Mol. function=transcription factor activity; Cellular component=nucleus; Biological process=regulation of transcription, DNA-dependent
  Homolog annotation: Hit_ID=Q9AXI4; Match level="QueryCoverage=100%, HitCoverage=100%, E-value=1e-150, Identity=56%"; Hit description =APETAL2-like protein
  Pfam annotation: Domain name=AP2; Domain location=149-210; Score =42.1; E_value=2e-09; Accession=PF00847.11; Description=AP2 domain
  Pfam annotation: Domain name=AP2; Domain location=252-303; Score =58.1; E_value=2.9e-14; Accession=PF00847.11; Description=AP2 domain
  Pfam module annotation: Pfam domain module=AP2::AP2; Domain location =149-210::252-303
MWDLNDSPDQRKDYESEGCSSSLYDDKGKRVASVSNSSSSAVVVEDGSEEEDSERGGSRTLDNKKTNKIFGFSVAHDDSDHPPVTHQFFPVEDSELPVTAAAAAAGSSFPRAHWVGVKFCQSETPGAGKAVKVSEPMKKSRRGPRSRSSQYRGVTFYRRTGRWESHIWDCGKQVYLGEYYDVDDCICGGFDTAHAAARAYDRAAIKFRGVEADINFNIEDYEEDLKQMTNLTKEEFVHVLRRQSTGFPRGSSKYRGVTLHKCGRWEARMGQFLGKKYVYLGLFDTEIEAARAYDKAAIKCNGKEAVTNFDPSIYDGELNSESSGGVAADHNLDLSLGNLISKHSNSQSSRNHFPNSATDQHMPPESNWQSGGSKPKLVNILPKPCGRSNMEAYGQGESETLRLLSQTHLQSPTTKEMHRYGPYRSPAEPQMPHNFAHHLHQPSFHVPSSSSNRGRIGSDLSLSMSDQQQWQQAGPPHLLATAAASSGFPQQIRPSQGWLQKNGFHSLMRPS

SEQ ID NO: 142540 - protein, 336 aa, Glycine max
  Coding DNA Sequence Number=SeqID_50855
  Gene Ontology: Mol. function=binding
  Homolog annotation: Hit_ID=A7PLQ2; Match level="QueryCoverage=88%, HitCoverage=24%, E-value=7e-57, Identity=42%"; Hit description =Chromosome chr7 scaffold_20, whole genome shotgun sequence
MLSAVLKFLADATAMCFAPHNHGLFLNYTSKCAQHIISSLDWLHHNQIQFKEEDKRNIIFCLKGSFTYAAKILNVILTESSGSSITLPKTFAVANNLLDLIISIESCMGSGYAMRLVAAAKTWLPDVLLALGSTSILKHTDCGEEHSTAPEQMKLHFPKWPLILAKTELFKANEAEDNESSRPEKFSAFSKLLEMLIILLKKNPSIMDAVGVIFMVSSLIGLEQKDFGLALGLLRFVGLKLFKPDDRDWGDMMLSCLQEIFPKIERGIAEENDKDELEKLTYAKEFIEPLWMYHLYETGRFAMSQSIGVTQDYGYAQGNSAFKIMERTVQDHHYRT

SEQ ID NO: 142541 - protein, 27 aa, Glycine max
  Coding DNA Sequence Number=SeqID_50856
MVAELIGAEPEMEIGSRSESCSILVVG

SEQ ID NO: 142542 - protein, 566 aa, Glycine max
  Coding DNA Sequence Number=SeqID_50857
  Gene Ontology: Mol. function=DNA binding; Cellular component=nucleus; Biological process=regulation of transcription, DNA-dependent
  Homolog annotation: Hit_ID=A7PLD0; Match level="QueryCoverage=84%, HitCoverage=60%, E-value=1e-143, Identity=53%"; Hit description =Chromosome chr7 scaffold_20, whole genome shotgun sequence
MASKPSPSPSPSSSRSEPLVDPSAESGDVAALYIVKDIRDVANKVEGSSPTAKDVLLVIDSLKKQVAAERVVYVKKRIEENRQKLVGVTNHLCTMSTERRNCSITDTNRSLDLLTKRQKDAIDMHNGVHASNGDVESNGYHDDNHGSTAVLLGSNVAVKNAVRPIKLPEVKKLPPYTTWIFLDRNQRMTEDQSVVGRRRIYYDQNGGEALICSDSEEETMDDEEEKREFIESEDYILRMTVKEFGLTDIVLESLAQCFSRNTSEIKAKYETLSIHDNAGGCSKAGDSEENSQSGNFFLEKDLEAALDSFDNLFCRRCLVFDCRLHGCSQDLVFPAEKQPTWNPPDTENAPCGPNCFRSSERFAKTSSAQADEEKSSGGALSRKKSSAKRRIKCSQSESASSNAKNISESSDSENGPGRDAVSASRSAPPKTKPVGKGGIGKRNSKRVAERVLVCMQKRQKKTMVSDSDSISEALDRSSNDMVTDPHAMSSEDNMRKEEFVDDNVCKPEITDNKSWKALEKGLLEKGMEIFGRNSMQEYDHWSKCLYEVKLVFSQFHGEWMGIILKL

SEQ ID NO: 142543 - protein, 609 aa, Glycine max
  Coding DNA Sequence Number=SeqID_50858
  Gene Ontology: Mol. function=protein serine/threonine kinase activity; Cellular component=anchored to membrane; Biological process=protein amino acid phosphorylation
  Homolog annotation: Hit_ID=A7PLB4; Match level="QueryCoverage=59%, HitCoverage=79%, E-value=1e-144, Identity=67%"; Hit description =Chromosome chr7 scaffold_20, whole genome shotgun sequence
  Pfam annotation: Domain name=DUF313; Domain location=108-186; Score= -13.2; E_value=0.0022; Accession=PF03754.4; Description=Domain of unknown function (DUF313)
MRSLETLKELVATITDWKSLKKMVCKPFKPCILHLAISQHVTQLYSEEELVQLNNFRKLHSSVESKSKTKNTDQRVTGKRQIEGMPKEERPMPAVIKKPKKIILMQNNQTPDLPAEIKNRVTELNGHDIKFLMHKKLFCSDVKPNSNRLSMPINEIMCEFLTEAEIAKLDERDDTNGKGRLVGVESIRILLLIAICLFTSSSASKIGETCGSDNKCDAGLSCQACPANGNTRTRCSRIQPLSPTSRVKGLPFNRYSWLTTHNSYALAGARSATGSVLVAPMNQEDTVAEQLKNGVRGFMLDMYDFQKDIWLCHSFQSKCFNFTAFVSAWPLLSSFFNVTQQPAINVLKDMRTFLDGNPSEIITIFIEDYVTAPQGLTKVFKDSGLSKYIFPVSRMPKNGGDWPTVDDMVQKNQRLVVFTSKSAKEASENIAYQWTYVVENQYGDDGMKAGSCPSRAESPAMNTESRSLVLVNYFHSAPNRSQACADNSAPLLDMTKTCHEAAGNRWANFIAVDYYQRSDGGGAPLAVDEANGHLTCGCDNIAYCKENAKFGTCDVPPISPPPPATETLSTGNQQTQNDNHTNNAYIGRTAKLMQSVVGILATTTFLAWL

SEQ ID NO: 142544 - protein, 395 aa, Glycine max
  Coding DNA Sequence Number=SeqID_50859
  Gene Ontology: Mol. function=oxidoreductase activity; Cellular component=chloroplast; Biological process=metabolic process
  Homolog annotation: Hit_ID=Q8W3L2; Match level="QueryCoverage=100%, HitCoverage=57%, E-value=1e-141, Identity=66%"; Hit description =Zeaxanthin epoxidase
  Subcellular localization annotation: CTP_CleavageSite=71; ConfidenceScore=5.05e-01
MASTLSCNSFNHSMAVFSKSHFSILMYKELSLDISPCVSYGSRTTKQRKTLMQIKATVAEEPPGVWKTVVVSENGGGGDGAPQKKKKLKVLVAGGGIGGFEKDMSAIRGEGQYRGPIQIQSNASADLEAIDLEVAEEVMRAGCITDDRINGLVDGISGSWYIKFDTFTPAAERGLPVTRVISRMTLQDILARAVGEDAIMNDSNVVDFVDHGGKVTVELENVQKYDGDLLVGADGIWSKVRKKLFGQIEATYSGYTCYTGIADFVPADIESVGLNFPAGRYQVFLGHKQYFVSSDVGAGKMQWYGFHQEPAGGADIPNGRFYPIFHPHPQVGKKERFLKIFEGWCDNVIDLIHATEEEAILRRDIYDRTPTFTWGKGRVTLLGDSIHAMQPNMGQ

SEQ ID NO: 142545 - protein, 627 aa, Glycine max
  Coding DNA Sequence Number=SeqID_50860
  Homolog annotation: Hit_ID=A7PL99; Match level="QueryCoverage=81%, HitCoverage=86%, E-value=1e-134, Identity=54%"; Hit description =Chromosome chr7 scaffold_20, whole genome shotgun sequence
MWHEARRSEKKVHDMMDAARKRAQRRAVYLAKRRGDPQQSIQLVGFRSRTYRDDALYQATQDQQGLIPWNGKQDVLIDRFDGRALLDFIRDSSHRRVPEKSEEEEELEEFVNFERYRDLIKHRRRGCRIRYRRFYGSAATDFFVLVLKLNLQTRFLILTVSDEEALQHVNQEMEAKAAAPFTSDRSNLSQPAASKGSYSQVGFSYDGNGKEETHISDDDDNDNEEEEDDEDDEDFNSDDSNDEGMEIIAKEYGVKRYGWLVYMDKKAKEEEKRQKELIKGDPAIRKLSRKERRKASQIEREREREATRISGTRVLHHDPYRETRQSPTYEAYSRSRRSRSPLRSYSPSHSRRYSRSGHSDDIHRSKPRTPKIEYITEFGGSGAADERRPEGFSPPRSPTSQVDLLNRPTSGCILEALHVDPASGVSIDKDKGTKVLKPSVSGSSSALAKLKAGGSGGPLKQGEKKETPQERLKRIMNKQLNKQIKKDTAAELAKKREQERQRQEKLAETSRLSRYRCRSRSRSFSGSPPSCHAILNPLKVLSHRSNTMINLSKEDTGAVEVQVEAEVPEDIILVLIHGPLLAHVLRLLILDLPALKLLSPGTAKNGPRAVRDQGLWSLPHWSLLSTP

SEQ ID NO: 142546 - protein, 38 aa, Glycine max
  Coding DNA Sequence Number=SeqID_50861
MQWHNNDGEELCLSSLEGDNVRHGRDGIGRWRKEKVRR

SEQ ID NO: 142547 - protein, 1105 aa, Glycine max
  Coding DNA Sequence Number=SeqID_50862
  Gene Ontology: Mol. function=neuropeptide hormone activity; Cellular component=extracellular region; Biological process=neuropeptide signaling pathway
  Homolog annotation: Hit_ID=A7R1E9; Match level="QueryCoverage=88%, HitCoverage=86%, E-value=0.0, Identity=49%"; Hit description =Chromosome undetermined scaffold_349, whole genome shotgun sequence
MVCVFIEPGFLYHPVCNFHSSCLEPLIGSVWTLRTSQKISSNVVSYGFPFPTTFCSFHRQTLIINPLPATFTLHVPPPVFVSFFSLEWEYCDCFRLSTWGLLHKTFTCYVVLSCILFWLAGYGLCSLNGIQNPPDYDGCASFERSYDLGSSDATVSDSSLGYGFPSPHNSYENVCPKSHSFCFPSMLSGLSHKEKIIKEASLGESGSQYNSPFCAELPQDGRQTSNQSWSAEHGVFRLLNGGVVSCSLNTREEVDGIPPLPTEVGCKDDISSCGGSSLKQKTTRFWSTNSEVSKSNSFDGSVSPNVRIGPTMLDWGQKYLYSSSAAFLTVTNTCNDSILNLYEPFSSDLQFYPCNFSDVSLRPGESALICFVFFPKSLGLSSASLILQTSSGGFIVEAKGYATECPFGIQPLSGVQISPGGRLSKNFSLFNPFDETLYVKEITAWISISSGHNSVETEAICRINDFQVIDAWLFPTIKDRLVVNSGHSPMIAIRPHRNWDIAPHGSENLMEMDIMVGFEGKIFGAFCLHLLRPSQDTSDTIMVPIEAEVDSHSACDTVGIFISATLEGLATCDSGEIAITISLRNDAPYVLGFVKVMEVSDTELFRIKFKEGLLLFPGTVTQVGIIYCSHLHLDLHDFAPKVSNLRENCKLLILTNDSTSPLIEIPCEDILYICFEHHRKMHSSDQVEGKSKHTQFDSRRTGYMGRSMQLRPNLKVGSYVSKWITVKNPSQHPVVMQLILNSGEIINECRDLDDLLFPSSSSNLVLDEGATPKKYGFSIPENALTEAYVHPHEHVTLGPIIFYPSDRCGWSGSALIRNNLSGVEWIPLKGYGGLLSLVLLERSEHVDNVDFDLKMPKTLNFSLPYTLLHMKEISSACSQHLVKELYAKNTGDLPLEVKSIRVSGRECGLDGFKILSCKGFALEPGESTKLLISYQTDFSAAVVHRDLELVLATGIFLLPMKASFPYYMLSSCKRSMYWMRLKKSLGFILVASLIFLIFCFIFPQTTALGFLDFSCKSDDNLVHTTIKSAEKTPMLHHDQRKSKLSMASEMNHLMEASSGKYSYGQGNPSELEISQQLTHKSENHEQTSHALDIQSERKLSSSSEL

SEQ ID NO: 142548 - protein, 593 aa, Glycine max
  Coding DNA Sequence Number=SeqID_50863
  Gene Ontology: Mol. function=protein disulfide oxidoreductase activity; Biological process=intracellular signaling cascade
  Homolog annotation: Hit_ID=A4Q942; Match level="QueryCoverage=100%, HitCoverage=100%, E-value=0.0, Identity=59%"; Hit description =Putative uncharacterized protein
  Pfam annotation: Domain name=DUF547; Domain location=373-514; Score =290.9; E_value=2.4e-84; Accession=PF04784.5; Description=Protein of unknown function, DUF547
METRGSKAMVAAEKTVKNGRRSNRERKIALTQDVDKLKRKLRHEENVHRALERALTRPLGSLPRLPPYLPPHTLELVAEVAVLEEEVVRLEEKVVNFRQGLYQEAVYISSKRNAENLRDSMDQNSIRSSKHQRSKSLSQSELNSTTMARPQISLARSASSRRLFSDIFTDHSGKLVNGKLLHINQDSLSSIPEEGRRKENPLFYSSLKDKQSPEKKTAKVIAPVKKSPIKKESADKCVDHLKLQMEGRLVDQETAESSSSSLHDKVSEVDSTPNRISEDIVKCLCRIFVRVGTFKEKLGESKTPLSSTSVCSKEKDQLCDPYGICSESKMRDIGTYNSLCEIKASNVDLNRTRYVVFLIRRLKCLSNLTDIFRFLLGKLASVSMKDLTHQEKLAFWINTYNSCMLNAYLEHGIPESPEMIVALMQKATIEVGGQLLNAITIEHFILRLPYHLMFTCPKAAKHGEMKLRSIFGLEWSEPLVTFALSCGSWSSPAVRIYTASQVDNELEAAKRDYLQATVGITKTNKLIIPKLLDWYLLDFAKDLETLLDWVCLQLPIELRKEAIECLERRERQPLSQLVQMMPYDFSFRLLLHQ

SEQ ID NO: 142549 - protein, 50 aa, Glycine max
  Coding DNA Sequence Number=SeqID_50864
MEPPPSQSIEVSGTGCQAGDDTQDKIINEWLSCCYDCTQGIFDFLCCNFC

SEQ ID NO: 142550 - protein, 376 aa, Glycine max
  Coding DNA Sequence Number=SeqID_50865
  Gene Ontology: Mol. function=DNA binding; Cellular component=nucleus; Biological process=regulation of transcription
  Homolog annotation: Hit_ID=A5BDQ7; Match level="QueryCoverage=90%, HitCoverage=97%, E-value=7e-54, Identity=40%"; Hit description =Putative uncharacterized protein
  Pfam annotation: Domain name=Myb_DNA-binding; Domain location=231 -282; Score=38.1; E_value=3.3e-08; Accession=PF00249.22; Description =Myb-like DNA-binding domain
MVVCDFWELSLAQSQRKTPKSNIIMEPSLDLRLGFVPKPLSLFFGDVSGNRDKCDKVVTLDGFVQRLEEELTKVEAFKRELPLCILLLNDGACLVLEFQSIARLKEEKVKCSGMQDPPLKTSSGGNENENSEKKNWMSSAQLWSTQKSKSRNEEDDRSVPANSINGNSCVPEKEGSQVPSFGLMARASELSHSNSKSVGGDTSSGSSLLRVEVQSQPQPPQHMQQNPRKQRRCWSPELHRRFVDALQQLGGAQVATPKQIRELMQVEGLTNDEVKSHLQKYRLHVRRFPVFSIGQVDNGSWMTQDECGDKSKGNMSQSGSPQGPLTPLLLGGAGSAKGLSSPGRNSVDAEDEQSSDCRNWKGGLHHQQLETDNHSL

SEQ ID NO: 142551 - protein, 316 aa, Glycine max
  Coding DNA Sequence Number=SeqID_50866
  Gene Ontology: Mol. function=protein binding; Cellular component =nucleus; Biological process=transcription from RNA polymerase I promoter
  Homolog annotation: Hit_ID=A7R809; Match level="QueryCoverage=96%, HitCoverage=98%, E-value=4e-90, Identity=55%"; Hit description =Chromosome undetermined scaffold_2148, whole genome shotgun sequence
  Pfam annotation: Domain name=DEK_C; Domain location=3-56; Score=78.4; E_value=2.3e-20; Accession=PF08766.2; Description=DEK C terminal domain
  Pfam annotation: Domain name=SWIB; Domain location=136-211; Score =134.4; E_value=3.2e-37; Accession=PF02201.9; Description=SWIBMDM2 domain
  Pfam annotation: Domain name=SWIB; Domain location=265-316; Score =14.9; E_value=0.00079; Accession=PF02201.9; Description=SWIBMDM2 domain
  Pfam module annotation: Pfam domain module=DEK_C::SWIB::SWIB; Domain location=3-56::136-211::265-316
MVSESELIGRLREFLRSSDLNTTTTATVRRQLEADFGIDLSDRKAFIREQVDLFLQTEHNQPQQEERQNDDVEEQEEDAPNNPEQSQPSDSKEETDEEEEGEEEEDKPEQAKNAKKNKGRSNKLGDEVVKKRGGGFCKLCSLSPQLQEFMEAPEMARTEVVKQLWVYIREKNLQDPNNRRNIICDERLRSLFNVNSINMFQMNKALSKHIWPLESDDVVQVKSTPKEKQKKQERDDAYCIITSMTDSDEAKKKEKRQKGGGKSGFLAPLQLSDALVNFLGTGESELARTDVIKRMWDYIKGNNLQVCHCSELSCAI

SEQ ID NO: 142552 - protein, 941 aa, Glycine max
  Coding DNA Sequence Number=SeqID_50867
  Gene Ontology: Mol. function=protein serine/threonine kinase activity; Cellular component=cytoplasm; Biological process=protein amino acid phosphorylation
  Homolog annotation: Hit_ID=Q9M6N2; Match level="QueryCoverage=98%, HitCoverage=85%, E-value=2e-72, Identity=74%"; Hit description =Abscisic acid-activated protein kinase
  Pfam annotation: Domain name=Pkinase; Domain location=3-859; Score =51.9; E_value=2.2e-12; Accession=PF00069.16; Description=Protein kinase domain
  Pfam annotation: Domain name=Pkinase_Tyr; Domain location=3-283; Score=-122.4; E_value=6.5e-05; Accession=PF07714.8; Description =Protein tyrosine kinase
  Pfam module annotation: Pfam domain module=Pkinase::Pkinase_Tyr; Domain location=3-859::3-283
MWASVVYASSQEGFLHKEIDENVKREIINHRSLRHPNIIRFKEVILTPTHLAIVMEYASGGELFEKICNAGRFNEDEARFFFQQLISGVSYCHAMEVCHRDLKLENTLLDGSPALHLKICDFGYSKDLESIYKKRKTSEKRIRRMISWQVGWGCGVNIGKWRNSGTMTSSKMLDPCSFDERGSGSNMGDGVTLGSGGGTSLLVKDPIDEYFMAVCKVELPLIDGMDPVGCINGVGTHFKVQSMSDEVEVKLAKLSMDGATIHLFNLLKETKEHLTWTRLKQALRVYGDCHYNNMIEDLFYLCQMGTIEEYIADIVFISWLVVIGSMLGINVIGVPFWSGLQAGKREDDLYCIHEEGEFLSLSVENTLEDFHSIISSYIQVIPLYLIITGATVCCQSAVSYNSGETRCEIHASPSTSQNCALTVQKGSLCANLLSLSLVVRWPPQILLELPPELVPLSVPLSSSVELWFLGQGHHEHSEAVSKAKHLSDLKSAVEELRMFLDAELVEEMRRKHDNLYMVLALRAMNPDFDHIRDQVLTNEEVPSMKSLLTCLLRVPNPRKNENSLELTESSAMVSSQGRGRGRGHENRGRGGCGGGRNANVSTSKTHEPKFFEEEYQEYLQLKSNSASDHSSLFTSLSPPKILHLITLANGTKVTSKGVGKGSISPSLNLDPECGTGQLIGVGHESRGLYYLEMSSSVSCFMSLSPKLLHDRLGHPHLSKLKKMSSVLHSQPKSTVGTPAYIAPEVLLKQEYDGKGKAAYNIPPPYLRIAKSLWAMGYEIADVWSCGVTLFVMLVGSYPFEDPNDPKDFRKTIQRVLSVQYSIPDNVQVSPECRHLISRIFVFDPAERITIPEILQNEWFLKNLPPYLMDEKIMGNQFVESDQPMQNIDTIMQIISEATIPAAGTYSLDQFMADNIIDDDMDELDSDFELDVDSSGEIVYAI

SEQ ID NO: 142553 - protein, 765 aa, Glycine max
  Coding DNA Sequence Number=SeqID_50868
  Gene Ontology: Mol. function=nucleotide binding; Cellular component =intracellular; Biological process=defense response
  Homolog annotation: Hit_ID=A7QQ02; Match level="QueryCoverage=95%, HitCoverage=96%, E-value=1e-156, Identity=43%"; Hit description =Chromosome undetermined scaffold_139, whole genome shotgun sequence
  Pfam annotation: Domain name=AAA; Domain location=172-356; Score= -40.7; E_value=0.076; Accession=PF00004.20; Description=ATPase family associated with various cellular activities (AAA)
  Pfam annotation: Domain name=LRR_1; Domain location=554-574; Score =1.8; E_value=1.4e+02; Accession=PF00560.24; Description=Leucine Rich Repeat
  Pfam annotation: Domain name=LRR_1; Domain location=601-623; Score =4.7; E_value=41; Accession=PF00560.24; Description=Leucine Rich Repeat
  Pfam annotation: Domain name=LRR_1; Domain location=625-647; Score =10.0; E_value=4.2; Accession=PF00560.24; Description=Leucine Rich Repeat
  Pfam annotation: Domain name=LRR_1; Domain location=649-671; Score =10.1; E_value=4.2; Accession=PF00560.24; Description=Leucine Rich Repeat
  Pfam annotation: Domain name=LRR_1; Domain location=673-695; Score =12.4; E_value=1.5; Accession=PF00560.24; Description=Leucine Rich Repeat
  Pfam annotation: Domain name=LRR_1; Domain location=697-718; Score =6.6; E_value=19; Accession=PF00560.24; Description=Leucine Rich Repeat
  Pfam annotation: Domain name=NACHT; Domain location=171-320; Score= -37.1; E_value=0.047; Accession=PF05729.3; Description=NACHT domain
  Pfam annotation: Domain name=NB-ARC; Domain location=137-406; Score =35.4; E_value=1.6e-12; Accession=PF00931.13; Description=NB-ARC domain
  Pfam module annotation: Pfam domain module=AAA::LRR_1::LRR_1::LRR _1::LRR_1::LRR_1::LRR_1::NACHT::NB-ARC; Domain location=172-356::554 -574::601-623::625-647::649-671::673-695::697-718::171-320::137-406
MTDPLAGAAAGELLKGALEIIRSGYEFRPTLERSRETFDSLSSRVQKIKQLNRNLDSSTEEIDKLEALVRDGKELIDKYSKVTWWRFLCFPCYQCKLKASEDALTRHTTTIEPVHIRLGMMEIQSGIKIILQTLLMSGKENIGGAIEEPECIGMEQHLNKLKIELLKDGMSVLVLTGLPGSGKTTLAKKICWDTDIKGKFGVNIFVTVSKTPNLKSIVGTVFHGCRRPVPEFQSDDDAINRLSALLLSVGGNDKNPILLVLDDVWPGSEALVDKFTVQIPYYKILVTSRVAYPRFGTKILLGQLDHNQAVALFAHYAKLNDNSPYMPEEDLLHEIVRRCMGSPLVLKVTAGSLCGQPFEILDALEDEFHINEKVCFMDLGLFPEDQRIPVPALIDMWAELKVAKDEDKYYNNHFVILHDLLRELAIRQSTEKPFEQDRLIIDITGNDFPEWWVGENQQGTIGQMFPCFSRMIRQKQLKVAARILCISTDETFNSDWRDMKPYNTEVLILNLHSSQYSLPCFTKKMKKLKVLIVTNYGFHRSEIKKFELLGSLSNLKRIRLEKVSVPSLCELKNLQKLSLRMCNTRQAFENCSIQISNAMPCLEEMSIDYCNDLITLPDGLCEISPLKKLSITNCHKLSALPQGIGKLENLEVLRLCSCSDLLEMPNSFEGLNKLSCLDISDCVSLTKLPDDIGELKKLKKLYMKGSKLGELPYSVHKFEQFKHEINVICDEETVTLWENFRAFPNLKIEIFREDIDLNWLHGVHS

SEQ ID NO: 142554 - protein, 86 aa, Glycine max
  Coding DNA Sequence Number=SeqID_50869
  Subcellular localization annotation: CTP_CleavageSite=61; ConfidenceScore=5.35e-01
MAFMMEDKDSNTLDGVSSQLQLKSSLSSKASSQTLNKQQVLNRIRHRKSLNRIRGAFEDLLGSSKGNTASAQDQIWLQQDDAFSSP

SEQ ID NO: 142555 - protein, 31 aa, Glycine max
  Coding DNA Sequence Number=SeqID_50870
MASVINPCLSANHKIVWDLKTNNPRFASFIV

SEQ ID NO: 142556 - protein, 1354 aa, Glycine max
  Coding DNA Sequence Number=SeqID_50871
  Gene Ontology: Mol. function=histone-lysine N-methyltransferase activity; Cellular component=intracellular; Biological process =chromatin modification
  Homolog annotation: Hit_ID=A7PV29; Match level="QueryCoverage=100%, HitCoverage=100%, E-value=0.0, Identity=57%"; Hit description =Chromosome chr4 scaffold_32, whole genome shotgun sequence
  Pfam annotation: Domain name=Pre-SET; Domain location=1058-1191; Score=39.0; E_value=1.7e-08; Accession=PF05033.7; Description=Pre -SET motif
  Pfam annotation: Domain name=SET; Domain location=1193-1338; Score =182.7; E_value=9.5e-52; Accession=PF00856.19; Description=SET domain
  Pfam annotation: Domain name=zf-C2H2; Domain location=668-691; Score =11.7; E_value=0.62; Accession=PF00096.17; Description=Zinc finger, C2H2 type
  Pfam annotation: Domain name=zf-C2H2; Domain location=702-725; Score =20.5; E_value=0.0065; Accession=PF00096.17; Description=Zinc finger, C2H2 type
  Pfam annotation: Domain name=zf-C2H2; Domain location=736-759; Score =4.0; E_value=4.2; Accession=PF00096.17; Description=Zinc finger, C2H2 type
  Pfam annotation: Domain name=zf-C2H2; Domain location=805-828; Score =15.0; E_value=0.27; Accession=PF00096.17; Description=Zinc finger, C2H2 type
  Pfam module annotation: Pfam domain module=Pre-SET::SET::zf-C2H2::zf -C2H2::zf-C2H2::zf-C2H2; Domain location=1058-1191::1193-1338::668 -691::702-725::736-759::805-828
MEVLPCSGVQYAGESDCPQQSSGTAFVYQEQPNCPENGEHVNFVAAQLNESSHKMQGPQIERHLSTNSDCQCIGTSCCDCQVDDQHEYCGFHDFEEDMINEPCLTSENFISVVDTIEIESPNNSREGDLSCSEPKWLEGDESVALWVKALTETARDVKVWKEFAMEASRCKGYSNFGRILLKLHKELFDSILWNGVNTLWDAVAPMQSTLGSEWKTWKQDVMKWFSAPPSLSSSKDTQQQSSDDLYQANLQVCRKRPKLEVRRADTHASQVEIKDQTIALEADPGFFKNQDTLSTIAAQSCKQEGVREVSMTTSPSNLANKWNEIVVEATASDFLHIKEMESTPTNEMSVAKSVEPGSKNRQCIAYIEAKGRQCVRWANDGDVYCCVHLSSRFLGSSTKSEKPVPVDTPMCEGTTVLGTRCKHRALPDSLFCKKHRPHAETVQTSNLPQNTLKRKHEENYTGSKDMYALVNVESPLQVDPVSSIGGDSVHVESNFNEKPKHSENDHNAVVSMHCIGSPPYDYKNPCREGPKRYCLYCERHLPSWLKRARNGKSRIVSKEVFTELLGECSSWEQKVHLHKACELFYRLFKSILSLRNPVPKDVQFQWALTEASKDSNVGEFFTKLVHSEKARIKSIWGFNDDMDISSIMEEPPLLPSTINDNYDEENAIKCKICSAEFPDDQALGNHWMDSHKKEAQWLFRGYACAICLDSFTNKKLLETHVQERHHVQFVEQCMLLQCIPCGSHFGNTEQLWQHVLLVHPVDFKPSTAPKQQNFSTGEDSPVKHDQGNLAPLENNSENTGGLRKFVCRFCGLKFDLLPDLGRHHQAAHMGPNLASSRPAKRGVRYYAYRLKSGRLSRPKFKKTLAAASYRLRNKANANLKRGIQASNSLGMGGITIQPHVTESETTNIGRLAEHQCSAVSKILFSEIQKMKPRPNNLDILSIAQSACCKVSLAASLEEKYGILPEKLYLKAAKLCSENSILVNWHQEGFICPRACNVSKDQALLSPLASLPNSSVRPKSVNLSDPASDEWEVDEFHCIINSHTLKIGSLPKAVILYDDISFGKESVPVSCVVDQELMHSLHMNGCNRQNISPSMPWETFTYVTKPMLDQSLSLDSESLQLGCACLCSTCCPETCDHVYLFGNDYDDAKDIFGKPMRGRFPYDENGRIILEEGYLVYECNHMCRCNKSCPNRVLQNGVRVKLEVFKTEKKGWAVRAGEAILRGTFVCEYIGEVLDVQEARDRRKRYGAEHCSYLYDIDARVNDMGRLIEEQAQYVIDATKFGNVSRFINHSCSPNLVNHQVLVESMDCERAHIGFYASRDIALGEELTYDYQYELMPGEGSPCLCESLKCRGRLY

SEQ ID NO: 142557 - protein, 134 aa, Glycine max
  Coding DNA Sequence Number=SeqID_50872
  Gene Ontology: Mol. function=oxidoreductase activity; Cellular component=membrane; Biological process=electron transport
  Homolog annotation: Hit_ID=O81974; Match level="QueryCoverage=89%, HitCoverage=23%, E-value=2e-31, Identity=62%"; Hit description =Cytochrome P450 71D8
MTPKINNKITHCYYTFFLFLLLHWLIKKYKSKSSHTLSPGPRKLPLIGTCINLLTVAGSLQYHALRELAHKYEPLMHLQLCEISAVINCILPKMVAKEIMKTHDLAFVQPQLLSPQTLAYGATNIAFAPYGGDY

SEQ ID NO: 142558 - protein, 98 aa, Glycine max
  Coding DNA Sequence Number=SeqID_50873
MWNLELMNQDAKHFVSLGSTPPPSRLSTLNKELEMVLATLLELKNEEHEHCCKMAKIMLKVMVASEAIINTINAKDQDENLHTVLYNQDLDRPAIVAG

SEQ ID NO: 142559 - protein, 199 aa, Glycine max
  Coding DNA Sequence Number=SeqID_50874
  Subcellular localization annotation: CTP_CleavageSite=36; ConfidenceScore=5.17e-01
MACVLLLNCYQHPPLQNNLVLKVKRRTVFTVALVVVGSMVVGVAAGVDAGERQSKRLRGEDANGNENDDMCGFITELPWEAAMGSDAGLGVGLGGLGAGYGIGGSIGRGGGTSDGGGDGWAEEGNSSGGGSGGCGGGTDEGNGDRWRNIMLSNCWLMRSSLKSMDAWNASSRRLAAEGAVSAIEERRGGQVGPIVMNSN

SEQ ID NO: 142560 - protein, 303 aa, Glycine max
  Coding DNA Sequence Number=SeqID_50875
  Gene Ontology: Mol. function=dimethylallyltranstransferase activity; Cellular component=chloroplast; Biological process=isoprenoid biosynthetic process
  Homolog annotation: Hit_ID=Q5G1J1; Match level="QueryCoverage=75%, HitCoverage=78%, E-value=6e-71, Identity=53%"; Hit description =Geranyl diphosphate synthase
  Pfam annotation: Domain name=polyprenyl_synt; Domain location=56-260; Score=198.7; E_value=1.5e-56; Accession=PF00348.8; Description =Polyprenyl synthetase
MATSHIYAKETKTKEYTVTTEEIELEDALNFDFKARMLAKAHTVDAAITLKDPHKIHQAMRYSLLAGGKRVHPLLCIAACELLDGTEATALPAACAVEMIHTMSLIHDDLHCMDNDDLRRGKPTNHKVFGEDVAASTKGVSPSRVVRAIGGTLLEVAAVLGVLVGSGTDEEAERLRRFARCIGLLYQVVDDIIDVTKSSEELGKTAGKDLVAHKVTYPKLLGIHKSKEFAGKLMQDAKEQLCGFDPQRRAPLFALTNYIAQSPEATLYSLPLLALAIKHDPPVAMAIQADPAIGTCDTSLRGH

SEQ ID NO: 142561 - protein, 64 aa, Glycine max
  Coding DNA Sequence Number=SeqID_50876
MTMITNSSSVPGVAMPVYTTFKAIESKDQDAQHRCLLYWAVVYPALFFGEKLPGVTTLPMSGEV

SEQ ID NO: 142562 - protein, 266 aa, Glycine max
  Coding DNA Sequence Number=SeqID_50877
  Gene Ontology: Mol. function=sequence-specific DNA binding; Cellular component=nucleus; Biological process=regulation of transcription, DNA-dependent
  Homolog annotation: Hit_ID=A7PUU2; Match level="QueryCoverage=87%, HitCoverage=96%, E-value=5e-75, Identity=59%"; Hit description =Chromosome chr4 scaffold_32, whole genome shotgun sequence
  Pfam annotation: Domain name=GATA; Domain location=147-182; Score =75.2; E_value=2.2e-19; Accession=PF00320.18; Description=GATA zinc finger
GGSGRGRDTDIGFETLKPRDRKRQIHGRLFPLGHVMGPCTCGMFHSQTSSFSVLFSMPNHKPPYDHSDNIYDYSSFTPSSSSVDCTLSLGTPSTRFSEDEEKRSCHEPRSVSNFCWDLLQSKHNHPQSHSKSSRTTNTTDPLLARRCANCDTTSTPLWRNGPRGPKSLCNACGIRYKKEERRASAAAATPPAAAASGGMMDSAQVYNNSWYAHQQSQKMQCFSPGMGSEFRFVDDGDRDAADNGIQFLSWRLDVTDRTSLVHDFTR

SEQ ID NO: 142563 - protein, 29 aa, Glycine max
  Coding DNA Sequence Number=SeqID_50878
MDISISEYIFICKLKTVERSEHLSTDMLW

SEQ ID NO: 142564 - protein, 1266 aa, Glycine max
  Coding DNA Sequence Number=SeqID_50879
  Gene Ontology: Mol. function=RNA binding; Cellular component=nucleus; Biological process=ribosome biogenesis and assembly
  Homolog annotation: Hit_ID=A7PUU3; Match level="QueryCoverage=82%, HitCoverage=97%, E-value=0.0, Identity=63%"; Hit description =Chromosome chr4 scaffold_32, whole genome shotgun sequence
  Pfam annotation: Domain name=Arf; Domain location=1109-1258; Score =132.9; E_value=9e-37; Accession=PF00025.12; Description=ADP -ribosylation factor family
  Pfam annotation: Domain name=Nrap; Domain location=83-1069; Score =1033.7; E_value=0; Accession=PF03813.5; Description=Nrap protein
  Pfam annotation: Domain name=WCOR413; Domain location=130-294; Score=- 101.9; E_value=0.066; Accession=PF05562.2; Description=Cold acclimation protein WCOR413
  Pfam module annotation: Pfam domain module=Arf::Nrap::WCOR413; Domain location=1109-1258::83-1069::130-294
MEADAIAVDSTELKLTELLKEVNVDHSHQFSKLVDDTVSAIKTSIDKIPNDFKVTADLASRFVTDIGADKVEFKFKKPASVKIGGSYSIQSIAKPEVNVDLIIRLPKECFHEKDYLNYRYYAKRCLYLCLMKNYLEKSPSIDRVEWSTLQNEARKPLLVVYPAAKLVEVPGFFVRIIPSAKAIFSIAKLNLKRSNIHNLSDGTALLATPKYNSSILEDMFIEDVEFINNYFLGWKELREALILLKVWARQRSSIHVHDCLNGFLISVILAYLASKQHITNSMKSTEIIRITLNFIATSELWSRGLYFPKEGHSNITKEQRMQLKESFPVVISHPFGGFNLAFRMSRIGFTQLQNEATLTLRCMEKCRDGGFEEVFMTKIDYAGKYDYCMRINLKGKKEVFASGFCLDDECWRSYEDKIHGILSKGLNDRAKFIQVTWRNTHCQWSVDDGLSVLDKVPLFIGISVSTLEKAFRMVDIGPNAESKEEALEFRKFWGEKAELRRFKDGRIAESTVWEIEQWAKHLILKRIVEHVLSRHLSLSKENIVVVVDQLDFSLLHGSGDPISYSGNLLGAFDVLSKRLRLIEDLPLKVSSVQPLDSAFRFTSVFPPEPHHLANEKHESLRLNKLVPSCIQPLEVMIQLEGSGNWPMDEIAIEKTKSSFLVQIGVSLQKMWGMTCTATEDNVDVLVSGYAFRLKILHERGLSLLNKEIGNDQAKRIPSADKKLFIRSQHANMINGLQSRYAIFGPVVRLAKRWAASHLFSSCLVEEAVELLVAYLFLNPLPYDVPCSRITGFLRTRKQPLCICKGKAAYNIPPPYLRIAKSLWAMGFLRLLSHYDWTFSPLIVDINHDLSQSDGKEINDNFLLRRKGQGENGQSVGSAMFLATVYDKESEAWTGLSPSGMELKRLVAYARSSANLLAKLTFLEEIGPFRWECLFRTPLNNYDAVIFLHKDKLPYPQRLLFPSEVNHGTHVAEGQASKCFQPFLLPKDLKGRPEELRNKLLQEFSTTFQVWHDYLGGDVIGLTWGESYPSKKRKHEEVVVEEEYNPCKVLKAVGEVGKGFVKIQLSNHLPLDIINDLSLWNYVRSRVEEFWEPNGSSEYHKENQAEREGNANSNGRIGQFWENHNRFKDKRRGHQRHQSHARLQHQNHNLPKKTIRSYWRNYFEQTDGLVWVVDSSDLRRLDDCKFELDNLLKEERLSGASLLILANKQDIKGALTPEEIAKVLNLEAMDKSRHWQIVGCSAYTGEGLLEGFDWLVQDIASRIYMLD

SEQ ID NO: 142565 - protein, 515 aa, Glycine max
  Coding DNA Sequence Number=SeqID_50880
  Gene Ontology: Mol. function=nucleic acid binding; Cellular component= ribonucleoprotein complex; Biological process=nuclear mRNA splicing, via spliceosome
  Homolog annotation: Hit_ID=Q2PEQ2; Match level="QueryCoverage=50%, HitCoverage=43%, E-value=3e-82, Identity=63%"; Hit description =Putative U1 snRNP 70K protein
  Pfam annotation: Domain name=RRM_1; Domain location=172-254; Score =65.9; E_value=1.4e-16; Accession=PF00076.13; Description=RNA recognition motif. (a.k.a. RRM, RB
  Subcellular localization annotation: CTP_CleavageSite=20; ConfidenceScore=5.15e-01
MGDNNSNNDAFMRNQNAAVQARTKAQNRSNVLQLKLIGQSHPTGLTANLLKLFEPRPPLEYKPPPEKRKCPPLSGMAQFVSKFAQPGDPEYAPPVPETETPVAQKRARIHKLRLEKGAAKAAEELEKCDESYIVNLLIFHDFVFSGCHSYIGFYADDPHNDPNVSGDPYKTLFVAKLSYETTESRIKREFESYGPIKRVGIFEYPSGDSVRLVADKDTNKPRGYAFIEYLHTRDMKAAYKQADGRKIDGRRVLVDVERGRTVPNWRPRRLGGGLGTTRVGGSNSSLVLKNQECGRTDTVIETGKYHVKELGTKTKNGSDHVNILMKGSGIAIRERIGTTETEIGPGTETGKEIEIEIVDVIEIEHVIVSEGGTVTGIENMIDIVRGIEIMKLAKLIEDAHVIGSLIIIVLNLNMGKGIMTMSLRMIVVGKTSMSMDIGMQTLIMTLLSIMTPTIMEMIVVTITISILTLIGWKMTTMQDVQHLNHMKRREVMMWTVNIGAQRDHIPGSMIIRNWA

SEQ ID NO: 142566 - protein, 493 aa, Glycine max
  Coding DNA Sequence Number=SeqID_50881
  Gene Ontology: Mol. function=sugar:hydrogen symporter activity; Cellular component=integral to membrane; Biological process =carbohydrate transport
  Homolog annotation: Hit_ID=Q1XF09; Match level="QueryCoverage=98%, HitCoverage=97%, E-value=1e-177, Identity=63%"; Hit description =Putative polyol transporter protein 2
  Pfam annotation: Domain name=MFS_1; Domain location=34-440; Score =118.6; E_value=1.8e-32; Accession=PF07690.7; Description=Major Facilitator Superfamily
  Pfam annotation: Domain name=Sugar_tr; Domain location=29-488; Score =244.6; E_value=2.2e-70; Accession=PF00083.15; Description=Sugar (and other) transporter
  Pfam module annotation: Pfam domain module=MFS_1::Sugar_tr; Domain location=34-440::29-488
MSLEDKNAGGQQFMENGDNHKGLNKYACASVLAANIVSAIFGYVVGVMTGALIFIKEDLQISDLQVQLLAGTLHLCALPGSMVAGRASDYIGRRYTIILASITFLLGTTLMGYGPSYLILMIGNCIVGIGVGFALVVAPVYSAEISPPSYRGFFTSLPELSSNIGVLLAFMSNYFLENLSLRLGWRMMMVLPSIPSFGLVILMLKLVESPRWLVMQGRVGEARKVLLLVSNTKEEAEQRLRDIKGIVGIDENCTLDIVQVPKNTRSGAGALKEMFCNPSPPVRRILIAAIGLHFFMRIDGYGGFLLYIPRVFERTGITDKSTLMLATVGMGITKVVFAFVSMFLSDRVGRRILLLISAGGMVVTLLGLGICLTIVEHSKEKLVWATTLTVIFTYIFMGIACTGVGPVTWVYSSEILPLRFRAQGLGVCVVVNRLTNVVVVSSFISIYKTITMGGIFFVFTGINALALLFYSSLPETKGRSLEDMEIIFGRSSK

SEQ ID NO: 142567 - protein, 136 aa, Glycine max
  Coding DNA Sequence Number=SeqID_50882
  Gene Ontology: Mol. function=pantetheine-phosphate adenylyltransferase activity; Biological process=coenzyme A biosynthetic process
  Homolog annotation: Hit_ID=Q9ZPV8; Match level="QueryCoverage=66%, HitCoverage=45%, E-value=2e-23, Identity=61%"; Hit description =Putative uncharacterized protein At2g18250
MAVHGDDDTMVMVVPKLSPPNTYEAVVNGGTFDRLHDGHRLFLTIMPKLETCVQASAELARRRIVIGVCDGPMLAKKQFAELIQPIEERINNVKTFIKIEVVDLVSGESGEIKLSSSMLRKIEAERAKQQNTIPQT

SEQ ID NO: 142568 - protein, 254 aa, Glycine max
  Coding DNA Sequence Number=SeqID_50883
  Homolog annotation: Hit_ID=Q0PN09; Match level="QueryCoverage=95%, HitCoverage=99%, E-value=1e-78, Identity=65%"; Hit description =Lateral organ boundaries domain protein
  Pfam annotation: Domain name=DUF260; Domain location=40-118; Score =43.3; E_value=4.9e-10; Accession=PF03195.5; Description=Protein of unknown function DUF260
MTVQERDDSKSESDNGVTTLLQRMRESESEKESARWIDTPEAQGHATVFVAKFFGRADLMSFISNVPEPQRPALFQSLLFEACGRTVNPVNGAVGLLWTGNWHVCQAAVETVLRGGTVRPMPELLGLDAPTPTADDASEGEVTCTDKWRVRDPNPNFPGTRFPGSRSDKAGSGGKRKRFEELAKLQTATTDLNLRLTPSFLQNAASYGCRQEIRWPGSPSMNSEESGTTTACLESGIGDHYAHDGDRKVLNLFI

SEQ ID NO: 142569 - protein, 294 aa, Glycine max
  Coding DNA Sequence Number=SeqID_50884
  Gene Ontology: Mol. function=acyl-CoA binding; Biological process =metabolic process
  Homolog annotation: Hit_ID=A7PLM8; Match level="QueryCoverage=65%, HitCoverage=93%, E-value=2e-35, Identity=42%"; Hit description =Chromosome chr7 scaffold_20, whole genome shotgun sequence
  Pfam annotation: Domain name=ACBP; Domain location=192-274; Score =34.2; E_value=8e-10; Accession=PF00887.10; Description=Acyl CoA binding protein
MELLWELAFTIALSLLLPLVFLKLLSVTPNFEANEKVAVIRRDHDHRVESDSNSWETDKVVQIGGKIDEFRDKPIVGKLVVPEIVDVSCGSPKIHNSEKIDGDRLHNEIELEDLAEDPVVDEGNEGVVNINKVEVELMECDSRENKVEEVEISQCERYYNEIEESSMNEEMGENKGSVVDEDDWEGIERTELERRFGAAVVFVGSKSNANLSNDVKMKLHGYHRIATQGPCHEPQPMALKFSARAKWIAWRQLGIMSPEEAMEQYISLLSENIPDWIVENPYDNAKPASAKLTL

SEQ ID NO: 142570 - protein, 686 aa, Glycine max
  Coding DNA Sequence Number=SeqID_50885
  Gene Ontology: Mol. function=nucleoside-triphosphatase activity; Cellular component=nucleus; Biological process=DNA replication
  Homolog annotation: Hit_ID=A7PUS7; Match level="QueryCoverage=70%, HitCoverage=93%, E-value=1e-121, Identity=47%"; Hit description =Chromosome chr4 scaffold_32, whole genome shotgun sequence
  Pfam annotation: Domain name=AAA; Domain location=408-606; Score= -41.8; E_value=0.096; Accession=PF00004.20; Description=ATPase family associated with various cellular activities (AAA)
MDQSSPYYNRFPQTPSSTKKGRSGYEPSDTESERQEIPRHERERRNFTLEETKDFTLMNKSPMALHRRHPSRFENEVSSASTASTASAPRRRHHSKSPYKLRVAEANVAVAVAGVASSSPIIGLNTRRNISPLSRPDIGRTVSPFREQRIEKPHYKRSVTAPRLRIQESNNGGRTNEKVNRQREASPFKAPSVGEINEMIAQVKLSQDPTSDYSSVLESTDSIHPGDLFFSRECNAFQAKNSSLPRRIEQREHFSPRPPVNTTRVPSERKGKNADIKMNMNILSRSTTVLSTSATSRKGSGTGKPSSVTSEGSGKTTESMRKFTANRKKNQKDTWFSCMRTGNCRTTRKSPERRPIDESSFIERAVVVESLPQFWADKHEPASLNGFICNRQEAQLLKELVSQGSCPHILLQGPSGSGKRELAMALLREIYGDACCNDQRLKKVSVPITSSSHHMELDVNSESNAKYALMGLIKEISNIYAVAPEVSNINFKSDFKVIVLYDVHKAVDNIRHIIKWIIDRYSDICKLVLCCEDDADIIEHVKNRFKVIQVDAPQNHEIIEVLIQIAKNEEIDLSMNFAAKIATKSKQNLRKAIMALEACKAHNLLSIRGKFQMLLLDFVHPKLILQKLVGHLLKRIEVSLRRELYYWHAYYDRRLPPGITALLKLEEFVAKFMSMCRKNSGNRQYV

SEQ ID NO: 142571 - protein, 467 aa, Glycine max
  Coding DNA Sequence Number=SeqID_50886
  Gene Ontology: Mol. function=nucleoside-triphosphatase activity; Cellular component=plasma membrane; Biological process=cell division
  Homolog annotation: Hit_ID=A7QBQ4; Match level="QueryCoverage=98%, HitCoverage=94%, E-value=1e-142, Identity=55%"; Hit description =Chromosome chr1 scaffold_75, whole genome shotgun sequence
  Pfam annotation: Domain name=AAA; Domain location=246-416; Score =57.3; E_value=5.1e-14; Accession=PF00004.20; Description=ATPase family associated with various cellular activities (AAA)
  Pfam annotation: Domain name=AAA_5; Domain location=246-377; Score= -17.6; E_value=0.062; Accession=PF07728.5; Description=ATPase family associated with various
  Pfam module annotation: Pfam domain module=AAA::AAA_5; Domain location=246-416::246-377
MPSPSSIFSAYASMTASIMLLRSMANDLVPQPIRGYLYSTFRYLIKPRSPTLTLIIEESTGIARNQVYDAAEAYLSTRVSPENERLKISKSAKEKKLTVRLEKGEKVVDCFDGACFKWRFICAESEKNNPNDHSNNNSISVRSEKRSFELSFPKKYKEMVLDSYLPFILEKAKEMKDEERVLKMHTLNTSYCYSGVKWDSINLEHPSTFETLAMEPELKNAVIEDLDRFVKRKEFYKRVGRAWKRGYLLYGPPGTGKSSLIAAMANYLKFDIFDLQLGNIVRDSDLRKLLLATANRSILVIEDIDCSVDLPERRHGDHGRKQTDVQLTLSGLLNFIDGLWSSCGDERIIIFTTNHKERLDPALLRPGRMDMHIHMSYCSYQGFKILASNYLETPSDHPLFGEVEGLIEDIQITPAQVAEELMKNEDPEATLEGFVKLLKRKKMEGDVCENSTPDKAEPTHQQSKRRK

SEQ ID NO: 142572 - protein, 465 aa, Glycine max
  Coding DNA Sequence Number=SeqID_50887
  Gene Ontology: Mol. function=nucleoside-triphosphatase activity; Cellular component=plasma membrane; Biological process=cell division
  Homolog annotation: Hit_ID=Q683K1; Match level="QueryCoverage=93%, HitCoverage=87%, E-value=1e-115, Identity=48%"; Hit description=AAA -type ATPase like protein
  Pfam annotation: Domain name=AAA; Domain location=245-441; Score =47.0; E_value=6.5e-11; Accession=PF00004.20; Description=ATPase family associated with various cellular activities (AAA)
  Pfam annotation: Domain name=AAA_5; Domain location=245-386; Score= -5.5; E_value=0.0075; Accession=PF07728.5; Description=ATPase family associated with various
  Pfam module annotation: Pfam domain module=AAA::AAA_5; Domain location=245-441::245-386
  Subcellular localization annotation: CTP_CleavageSite=45; ConfidenceScore=5.19e-01
MGFYTQNLFSSFTSASSWFEVYAAFSTFMMLLRTAFHDLIPQQFRSLIVSKLESFFTKYQPNNEIRLKINQFWDENSGDRNELFDAAQEYLPTRISHTYKSLKVGKLQDEKHIELAVDGSEDVVDEFEGTKFTWKLDEGSKEDSNNHNKKYSFELTFNEKHREKALDLYIPHVLKTYEAIKAERRIVRIYSRLDGYWNDSELSHPATFDSLALSPELKKDIIDDLERFQRRKEHYKKVGKPWKRGYLLYGPPGTGKSSLIAAMANYLKFDVYDLELTSIYSNSDLMRSMKEASNRSIVVIEDIDCNKEVQARSSGLSDDQDSVPDNEAAKVKTNRFTLSGLLNYMDGLWSSGGEERIIIFTTNHKEKIDPALLRPGRMDMHIHLSFLKGKAFRVLATNYLNIEGDHPLFEEIDGLLEKLEVTPAVVAEQLMRNEDPDDALETFVTFLKEMDKDSNCHLELRGTSE

SEQ ID NO: 142573 - protein, 477 aa, Glycine max
  Coding DNA Sequence Number=SeqID_50888
  Gene Ontology: Mol. function=transporter activity; Cellular component= intracellular; Biological process=transport
  Homolog annotation: Hit_ID=Q94FN0; Match level="QueryCoverage=96%, HitCoverage=95%, E-value=0.0, Identity=81%"; Hit description =Phosphatidylinositol transfer-like protein IV
  Pfam annotation: Domain name=CRAL_TRIO; Domain location=122-308; Score=149.9; E_value=7.2e-42; Accession=PF00650.11; Description =CRALTRIO domain
  Pfam annotation: Domain name=CRAL_TRIO_N; Domain location=36-105; Score=46.8; E_value=7.7e-11; Accession=PF03765.6; Description =CRALTRIO, N-terminus
  Pfam module annotation: Pfam domain module=CRAL_TRIO::CRAL_TRIO_N; Domain location=122-308::36-105
  Subcellular localization annotation: CTP_CleavageSite=28; ConfidenceScore=5.04e-01
MSPKGSFKKKAINASNMLRNSLTRKGRRSSKVMSVEIEDVHDAEELKIVDEFRQALILDELLPAKHDDYHMMLRFLKARKFDIEKTKQMWSEMLKWRKEFGADTITEDFEFKEIDEVLQYYPQGHHGVDKDGRPVYIERLGQVDATKMMQVTTMDRYIKYHVREFERTFDVKFAACSIAAKKHIDQSTTILDVQGVGLKNFNKHARELVTRLQKIDGDNYPETLNRMFIINAGSGFRILWNTVKSFLDPKTTAKINVLGNKYDTKLLEIIDASELPEFLGGTCTCADQGGCMRSDKGPWKDAEIMRMVQNGDHKCSKKSVSQGKEEKENSEEHKTSKLEANHTPHLSPVVEEVPATKASQPKDLSPMADKSAVKKVDEKASKPQNTPDKTAASTEFSTVMKRMAELEEKMVTINNQPTAMPPEKEQMLNATITRADDLEKQLLATKKALEASLVKQEELSAYLDKKKKKKKKRFFFF

SEQ ID NO: 142574 - protein, 796 aa, Glycine max
  Coding DNA Sequence Number=SeqID_50889
  Gene Ontology: Mol. function=metal ion binding; Cellular component =Golgi apparatus
  Homolog annotation: Hit_ID=A7QE39; Match level="QueryCoverage=99%, HitCoverage=99%, E-value=0.0, Identity=57%"; Hit description =Chromosome chr4 scaffold_83, whole genome shotgun sequence
  Pfam annotation: Domain name=DUF248; Domain location=285-786; Score =1140.9; E_value=0; Accession=PF03141.7; Description=Putative methyltransferase
  Pfam annotation: Domain name=Methyltransf_11; Domain location=404 -499; Score=43.2; E_value=9.1e-10; Accession=PF08241.3; Description =Methyltransferase domain
  Pfam module annotation: Pfam domain module=DUF248::Methyltransf_11; Domain location=285-786::404-499
  Subcellular localization annotation: CTP_CleavageSite=68; ConfidenceScore=5.42e-01
MALFQTRKKSSSPSYVSTLTILVFIALCVFGVWMLTSNSVVPPQTQSDEDTSTRTAIDTSATTNDELSSSEDSHETTSKSGEKEKDNPTAVYGDNPGHLPDDAIKADDNNSNNEPQKQQVDISDSQLSEESSLTQKDQVTAVIHEAGSDSDVKISEPEKQDEENQEQQDVQSFGTRGGSKTEEDEANKEQLREDKGVVEVAKKYEKVPADTSQQDSDAASKGTSSQEEETQNPKAEKKGGKSKKPWSTQVDQSQQENKRQTVESNSDEKLEDHTWYLCNVTAGADYIPCLDNEKALKQLRSTKHYEHRERHCPEDPPTCLVPIPKGYKTPIEWPSSRDKIWYHNVPHKLLAEVKGHQNWVKVAGEFLTFPGGGTQFIHGALHYIDFVQQAEPNIAWGKRTRVILDVGCGVGSFGGFLFERDVIAMSFAPKDEHEAQVQFALERGIPAISAVMGSQRLPFPSSVFDLVHCARCRVPWHLDGGMLLLELNRVLRPGGYFVWSATPVYQKLEEDVEIWKEMTSLTKSICWELVTINKDGLNKVGAAVYRKPTSNECYEQREKNEPPLCKDDDDPNAAWYVPLQACIHKVPVDQAERGAKWPETWPRRLQKPPYWLNKSQIGIYGKPAPQDFVADNERWKNVVEELSNAGISLSNVRNVMDMRAVYGGFAAALRDLPVWVFNVVNVDSPDTLPIIFERGLFGIYHDWCESFNTYPRTFDILHADNLFSKLKDRCKLVAVMAEVDRIIRPGGKLIVRDESTTLGEVETLLKSLHWEIIYSKIQEGMLCAKRGKWRPDSVAL

SEQ ID NO: 142575 - protein, 182 aa, Glycine max
  Coding DNA Sequence Number=SeqID_50890
  Gene Ontology: Mol. function=molecular_function; Cellular component =membrane; Biological process=auxin mediated signaling pathway
  Homolog annotation: Hit_ID=A7QE45; Match level="QueryCoverage=71%, HitCoverage=42%, E-value=2e-22, Identity=38%"; Hit description =Chromosome chr4 scaffold_83, whole genome shotgun sequence
MKCRYESVHFNRIDGLAKVLGGVLASVGGASIITLYKGPVIYTPHLGLHQEQYLSTLGDATGKNWNLGGIYLFGHSLCWSGWIFLTNAAFFEKDYKAWQFNSSREICSVLFSGLVTSGLASAIQIWTIGKGGPNTSLKLAAATQKSDESVHLNRIDAVAKVLGVLVSFGGATIIISVGRSPA

SEQ ID NO: 142576 - protein, 67 aa, Glycine max
  Coding DNA Sequence Number=SeqID_50891
MELGNDVVKVLYNENEAPQYLLWCTPNCIRGQCGQCISCTKDCPIHNAIGVQQIKYTGALSNCPNAL

SEQ ID NO: 142577 - protein, 75 aa, Glycine max
  Coding DNA Sequence Number=SeqID_50892
  Homolog annotation: Hit_ID=A5B7I8; Match level="QueryCoverage=66%, HitCoverage=4%, E-value=7e-14, Identity=70%"; Hit description =Putative uncharacterized protein
MDEKLSQNCKLWKELKDHLSYIVTTNQLVQSGQISIEHLETNSMIANPLTKGLPSKIFHEHVAHMGVLQFEESLV

SEQ ID NO: 142578 - protein, 667 aa, Glycine max
  Coding DNA Sequence Number=SeqID_50893
  Gene Ontology: Mol. function=protein binding; Cellular component =integral to membrane; Biological process=regulation of translational fidelity
  Homolog annotation: Hit_ID=A7QE27; Match level="QueryCoverage=98%, HitCoverage=98%, E-value=0.0, Identity=58%"; Hit description =Chromosome chr4 scaffold_83, whole genome shotgun sequence
  Pfam annotation: Domain name=DUF726; Domain location=304-654; Score =363.6; E_value=3.2e-106; Accession=PF05277.3; Description=Protein of unknown function (DUF726)
MAAATSYLTGTQRYAAGALFGLALHQAQLHQTHPLGLSTDDFPSDSETSSTLAVSEHPNLWVHHNSGLLRPVLKYLDINSAAWSGLEETAGFSSASRHVGPFLRLLSEDFDDDDDDSSQRLDQELALSEAVDAMVHSLEKNSESLVSRREKLREYENQCREKFSTADVQPNSEKVDLQLETQEDTGTPFLDCEDSHQGSFDSNIDEIPTEEVMILSYPRKVTVLYELLSACLSDLGENNKKYSRRRKGYDARQRVTLRLLATWLDIKWAKMEAIETIVASSAMSFIKEQEASKEETQSKEDKWAKWKRGGIIGAAALTGGTLMAVTGGLAAPAIAAGLGALAPTLGTLIPVIGASGFAAAASAAGTVAGSVAVAASFGAAGAGLTGSKMARRVGDVEEFEFKAVGENHNQGRLGVEIMISGFVFEDDDFIRPWEGLDDNLERYALKWESKNLFALSTAIQDWLTSRIATELMKQGAMMTVLHALLTALAWPAALLAATEFIDSTWTIAIDRSDKAGKLLAEVLLGGLQGNRPVTLVGYSLGARVIFKCLEFLAETENSAELVERVVLLGAPIAIKDENWEAARKMVAGRFVNAYSRNDWMLGVAFRASLLSQGLAGIQPVDIPGIQNVDVTDHIEGHSSYLWATQQVLDELELDTYYPVYNKFLSRQ

SEQ ID NO: 142579 - protein, 376 aa, Glycine max
  Coding DNA Sequence Number=SeqID_50894
  Gene Ontology: Mol. function=zinc ion binding; Cellular component =intracellular; Biological process=regulation of transcription
  Homolog annotation: Hit_ID=A7QE16; Match level="QueryCoverage=53%, HitCoverage=94%, E-value=5e-73, Identity=67%"; Hit description =Chromosome chr4 scaffold_83, whole genome shotgun sequence
  Pfam annotation: Domain name=Glyoxalase; Domain location=18-141; Score=43.5; E_value=7.6e-10; Accession=PF00903.16; Description =GlyoxalaseBleomycin resistance proteinDioxygenase superfamily
  Pfam annotation: Domain name=zf-B_box; Domain location=238-283; Score= 50.1; E_value=7.5e-12; Accession=PF00643.15; Description=B-box zinc finger
  Pfam module annotation: Pfam domain module=Glyoxalase::zf-B_box; Domain location=18-141::238-283
MKMEIEEVGNCEALPLLSLNHVSLLCRSVWVSMRFYEDVLGFVPIKRPSSFKFTGAWFYNYGIGIHLIENPNIDEFDTCVNEERPINPKDNHISFQCTDVELVKKRLEERGMRYVTAVVEEGGIQVDQVFFHDPDGYMIELCNCENIPIIPISSCSFKPRGHSFKKAAPNNAAAIVFCAADEAALCRACDEKVDPCSFIDVLRSDLIFFAVLCKLEIRVHMCNKLASRHVRVGLASPSDVPRCDICENAPAFFYCETDGSSLCLQCDMIVHVGGKRTHGRYLLFRQRVEFPGDKSSHAENPASQPLEPGEAKRGQNPLPKLKMGEKQQNHKMPMVPTPGPDADGHAKMESKMIDLNMKPNRIHEQASNNQVRVHEK

SEQ ID NO: 142580 - protein, 104 aa, Glycine max
  Coding DNA Sequence Number=SeqID_50895
  Gene Ontology: Mol. function=catalytic activity; Cellular component =chromatin; Biological process=auxin mediated signaling pathway
  Homolog annotation: Hit_ID=A5AQT6; Match level="QueryCoverage=100%, HitCoverage=100%, E-value=3e-42, Identity=77%"; Hit description =Putative uncharacterized protein
  Pfam annotation: Domain name=Auxin_inducible; Domain location=5-104; Score=162.3; E_value=1.3e-45; Accession=PF02519.5; Description=Auxin responsive protein
MAIKKSNKLPQAVVLKQIVKRCSSFGKKQTYNEEGLPDDVPKGHFAVYVGDNRTRYIIPISWLAQPQFQSLLQRAEEEFGFTHDMGLTIPCDEVAFESLTSMMR

SEQ ID NO: 142581 - protein, 104 aa, Glycine max
  Coding DNA Sequence Number=SeqID_50896
MVARSDARATMGPRSASLMVGLEARDFACLVAFTCCLRGGEEERGRGGEGGGKKKRRGQKRRGKERRKGAKEGGAGKRKEERRRKKLKGRRGGISCTDKGISYK

SEQ ID NO: 142582 - protein, 2502 aa, Glycine max
  Coding DNA Sequence Number=SeqID_50897
  Gene Ontology: Mol. function=phosphotransferase activity, alcohol group as acceptor; Cellular component=histone acetyltransferase complex; Biological process=regulation of transcription, DNA -dependent
  Homolog annotation: Hit_ID=A7QDY4; Match level="QueryCoverage=100%, HitCoverage=62%, E-value=0.0, Identity=79%"; Hit description =Chromosome chr4 scaffold_83, whole genome shotgun sequence
  Pfam annotation: Domain name=FAT; Domain location=1413-1756; Score =124.0; E_value=4.5e-34; Accession=PF02259.14; Description=FAT domain
  Pfam annotation: Domain name=FATC; Domain location=2470-2502; Score =25.0; E_value=0.00027; Accession=PF02260.11; Description=FATC domain
  Pfam annotation: Domain name=PI3_PI4_kinase; Domain location=2155 -2415; Score=75.4; E_value=1.8e-19; Accession=PF00454.18; Description= Phosphatidylinositol 3- and 4-kinase
  Pfam module annotation: Pfam domain module=FAT::FATC::PI3_PI4_kinase; Domain location=1413-1756::2470-2502::2155-2415
MPKELLQSSLRPILVNLAHTKNLSMPLLLGLARLLELLSNWFNVTLGGKLLEHLKRWLEPEKLAQSQKSWKAGEEPKIAAAIIELFHLLPPAASKFLDELVTLTIDLEGALPPGQVYSEINSPYRLPLTKFLNRYAPLAVDYFLARLSEPKYFRRFMYIIRSEAGQPLRDELAKSPQKILASAFSEFPLKSDVTVAPASTSTHTSLLGEESVVAPSTDASNPPAPPNATSDAYFQGLALIKTLVKLIPGWLQSNRSVFDTLVLVWKSPARISRLQKEQELNLVQVKESKWLVKCFLNYLRHDKNEVNVLFDILTIFLFHSRIDYTFLKEFYIIEVAEGYPPSMKKALLLHFLSLFQSKQLGHDHLVIVMQMLILPMLAHAFQNGQSWEVVDPSIIKTIVDKLLDPPEEVSAEYDEPLRIELLQLATLLLKYLQNDLVHHRKELIKFGWNHLKREDTASKQWAFVNVCHFLEAYQAPEKIILQVFVALLRTCQPENKMLVKQALDILMPALPRRLPLGDSRMPIWIRYTKKILVEEGHSIPNLIHIFQLIVRHSDLFYSCRAQFVPQMVNSLSRLGLPYNTTAENRRLAIELAGLVVNWERQRQSEMKVVTDSDAPNQINDVFNPSSADSKRSVDGSTFPEDATKRVKAEPGLHSLCGVMSPGGPSSITNIETPGSASQPDEEFKPNAAMEEMIINFLIRVRLTSNLLFYISMVALVIEPKDKEASAMYKQALELLSQALEVWPNANVKFNYLEKLLSSIQPSQAKDPSTALAQGLDVMNKVLEKQPHLFIRNNINQISQILEPCFKHKLLDAGKSFCSLLKMIFVAFPQEATTTPADVKLLHQKLDDLIQKHVTTVTAPQTSSDDNNASSISFLLLVIKTLTEVQRNFVDPLILVRILQRLQRDMGSSAGSHLRQGQRTDPDSAVTSSRQGADVGAVISNLKSILKLITDRVMVVTDCKRSVSQILNALLSEKGIDASVLLCILDVVKGWIEDDFCKQGTSVTQSSFLSPKEIVSFLHKLSQVDKQNFIPVALEEWDRKYLELLYGICADSNKYPLPLRQDVFQKVERLFMLGLRARDPEVRMKFFSLYHESLGKTLFTRLQFIIQNQDWGALSDVFWLKQGLDLLLAILVEDKPITLAPNSARVQPLLVSSSILELSGMPHKVNDVSEGSDDAPLTFEALVLKHAQFLNSTSKLQVADLLIPLRELAHTDANVAYHLWVLVFPIVWVTLNKDEQVTLAKPMINLLSKDYHKRQQANRPNVVQALLEGLQLSHPQPRMPSELIKYIGKTYNAWHIALALLESHVMLFPNDSKCSESLAELYRLLNEEDMRCGLWKKRSVTAETRAGLSLVQHGYWHRAQSLFYQAMVKATQGTYNNTVPKAEMCLWEEQWLYCASQLSQWDALADFGKSVENYEILLDSLWKLPDWTYMKEHVIPKAQVEETPKLRLIQAYFALHDKNTNGVGDAENMVGKGVDLALEQWWQLPEMSVHSRIPLLQQFQQIVEVQESARILMDISNGNKLSGNSVVGVQGNLYADLKDILETWRLRTPNEWDNMSVWYDLLQWRNEMYNSVIDAFKDFGTTNSALHHLGYRDKAWTVNRLAHIARKQGLFDVCVTILEKLYGHSTMEVQEAFVKITEQAKAYLENKGELTNGINLINSTNLEYFPAKHKAEIFRLKGDFLLKLNDSEAANLNYSNAISLFKNLPKGWISWGNYCDMAYRETQDEIWLEYAVSCLLQGIKFGVSNSRSHLARVLYLLSFDTPNEPVGRSFDKYYEQVPHWVWLSWIPQLLLSLQRTEAPHCKLVLLKIATLYPQALYYWLRTYLLERRDVANKSELGRIAMAQQRTQQSVSGTTSVGSLGGLSDGNSRVQGPGGSNLPSDIQVHQGSQPGGIGSHDGGNSHGQEPERSTIAESSIHNGNDQPLQQVSGNEGGQNTLRRPGALGFVASAASAFEAAKDIMEALRGKHANLASELETLLTEIGSRFVTLPEERLLAVVNALLHRCYKYPTATTAEVPQSLKKELSGVCRACFSADAVNKHVDFVREYKQDFERDLDPESTATFPSTLSQLTERLKHWKNVLQSNVEDRFPAVLKLEEESKVLRDFHVIDVEVPGQYFTDQEIAPDHTVKLDRVAADIPIVQRHGSSFRRLTLIGSDGSQRHFIVQTSLTPNARSDERILQLFRVMNQMFEKHKESRRRHICIHTPIIIPVWSQVRMVEDDLMYSTFLEVYENHCARNDREADLPITYFKEQLNQAISGQISPEAVVDLRLQAYNEITKNLVNDNIFSQYMYKTLPSGNHSWAFKKQFAIQLALSSFMSFMLQIGGRSPNKILFAKNTGKIFQTDFHPAYDANGLIEFNEPVPFRLTRNMQAFFSHGVEGLIVSSMCAAAQAVASPKQSQHLWHHLAMFFRDELLSWSWRRPLGMPIASMAAGGTMSPVDFKQKVITNVEHVITRVKGIAPQNFSEEEENVMDPPQPVQRGVTELVEAALNPRNLCMMDPTWHPWF

SEQ ID NO: 142583 - protein, 159 aa, Glycine max
  Coding DNA Sequence Number=SeqID_50898
  Gene Ontology: Mol. function=RNA-directed DNA polymerase activity
  Homolog annotation: Hit_ID=Q2HRL3; Match level="QueryCoverage=42%, HitCoverage=58%, E-value=3e-09, Identity=47%"; Hit description=Non -LTR retroelement reverse transcriptase-like protein, related
MSLCSLAFQAYIKGWSKKSLSYADKLELIKAVSQGIVNFWIEIFPLPQFVLDRINTSCHNFLWGKADIGKNKGSDVWNYNTSSSDSVLIKKIIQIRDFIISKELSTEEAKKRIQSWSTNEQLLIGIVYEYIGGVKPTVSWCSVIWNRAIPLRCLSSVAC

SEQ ID NO: 142584 - protein, 202 aa, Glycine max
  Coding DNA Sequence Number=SeqID_50899
  Homolog annotation: Hit_ID=A7PLM4; Match level="QueryCoverage=99%, HitCoverage=38%, E-value=7e-74, Identity=62%"; Hit description =Chromosome chr7 scaffold_20, whole genome shotgun sequence
MQTEDTEDHIHVFLNLYEDPKHISSDFWKDYLANGAVGRRIRLGSISGLGSSPDEGCCYVYNDKGTKTHVIMKHRTLMVKHMHWYEVGEKVSVCECRCTRARLPPSKFWLFEPRCGFHDIGGWYVETYGKDKNGRTMPSQRFWDGLDYSEQADRRLHPAMYLFALAYRTLDLEYAKASKRSFRNVVGAQMFRILHWCKKLVQ

SEQ ID NO: 142585 - protein, 193 aa, Glycine max
  Coding DNA Sequence Number=SeqID_50900
  Gene Ontology: Mol. function=protein dimerization activity; Biological process=DNA integration
  Homolog annotation: Hit_ID=A3BRV8; Match level="QueryCoverage=100%, HitCoverage=32%, E-value=3e-40, Identity=37%"; Hit description =Putative uncharacterized protein
MVISLEWSIYKDNDVAKAKKVKETLLDDIWWNKIDYILSFIAPIYDVLRKTNSDMTCLHLVYAILDSMIKNTKSNITLHCLVHSSNPRYYSHEWLSEDPSRVPPHEDVEFTDERKKCFKIYFDDVDVRRQVDLEFVYFYGRRKGFDDVDSLRDRGELVTKSWWLVHGIHVPTFQKIVLKLLEQPSSSSCCERN

SEQ ID NO: 142586 - protein, 73 aa, Glycine max
  Coding DNA Sequence Number=SeqID_50901
MKDATDTASRVYAHVQRASDTGHAPVIIAVEYSHRGFDVVGEREFDVVRGFFDSGMTHQMKLNDKLESLCQVY

SEQ ID NO: 142587 - protein, 168 aa, Glycine max
  Coding DNA Sequence Number=SeqID_50902
MHDSYLASYPVEYETPSIPFSLFREKAFLLSSLFREIPWGSSSPRGFSGFIFHLHSRVEDAGKNGGSLVTVSLPEDPLGVLPEDFRKKGSSRGNETTSGRTGLPESSRNTSSGMFPENVLLPETFQKRVLPDDILPRKGPITRTMSKRLQEDWARAAEEGPRVLMNLR

SEQ ID NO: 142588 - protein, 1313 aa, Glycine max
  Coding DNA Sequence Number=SeqID_50903
  Gene Ontology: Mol. function=alpha-mannosidase activity; Cellular component=lysosome; Biological process=carbohydrate metabolic process
  Homolog annotation: Hit_ID=A7QDV7; Match level="QueryCoverage=63%, HitCoverage=97%, E-value=0.0, Identity=70%"; Hit description =Chromosome chr4 scaffold_83, whole genome shotgun sequence
  Pfam annotation: Domain name=Alpha-mann_mid; Domain location=812-886; Score=101.1; E_value=3.3e-27; Accession=PF09261.2; Description=Alpha mannosidase, middle domain
  Pfam annotation: Domain name=Glyco_hydro_38; Domain location=496-808; Score=459.9; E_value=3.4e-135; Accession=PF01074.13; Description =Glycosyl hydrolases family 38
  Pfam annotation: Domain name=Glyco_hydro_38C; Domain location=860 -1310; Score=266.9; E_value=4.1e-77; Accession=PF07748.4; Description= Glycosyl hydrolases family 38 C-termi
  Pfam annotation: Domain name=UIM; Domain location=315-332; Score =14.8; E_value=0.33; Accession=PF02809.11; Description=Ubiquitin interaction motif
  Pfam annotation: Domain name=UIM; Domain location=385-402; Score =19.4; E_value=0.013; Accession=PF02809.11; Description=Ubiquitin interaction motif
  Pfam annotation: Domain name=UIM; Domain location=417-434; Score =12.5; E_value=0.85; Accession=PF02809.11; Description=Ubiquitin interaction motif
  Pfam module annotation: Pfam domain module=Alpha-mann_mid::Glyco _hydro_38::Glyco_hydro_38C::UIM::UIM::UIM; Domain location=812 -886::496-808::860-1310::315-332::385-402::417-434
MVLEATMICIDNSEWMRNGDYSPSRFQAQADAVNLICGAKTQSNPENTVGVLTMAGKGVRVLVTPTSDLGKILACMHGQASPGAAVKLCLGDLLVMGSNPETASLHMQGIAIGLTLREMGLSPQRELGLFTSLEQVELRVDAVVDCRVKFARPRLKVVHSNFMMPCFGFLKGLDIGGEMNLAAGIQVAQLALKHRQNKKQQQRIIVFAGSPVKHEKKMLEMIGRKLKKNSVALDIVNFGEEDEGKTEKLEALLAAVNNNDTSHIVHVPSGPNALSDVLISTPIFTGDGEGGSGFAAAAAAAAAGGVSGFEFGVDPNLDPELALALRVSMEEERARQEAAAKKAAEDAAKQEKGGEQQASSQDATMTERASAAMSEAENKTSDLMDDENALLQQALAMSMDDPAISHDVKDTDMSEASASDPDLALALQLSIADSTKDQGSQSDMSKLLADQSFVSSILASLPGVDPNDPSVKDLLASMQNQSEYNTGASVVPGKLNVHLIAHSHDDVGWLKTVDQYYVGSNNSIQGACVENVLDSVVVSLQLNQKRKFVFAEMAFFHRWWVEQTPQTQVQVRKLVDAGQLEFINGGWCMHDEATTHYIDMIDQTTLGHRFIKNQFNKVPRAGWQIDPFGHSAVQAYLLGAELGFDSVHFARIDYQDRAKRKVDKTLEVVWRSSKTFGSSAQIFANAFPVHYSPPSGFHFEINDDFVPVQDDPLLFDYNVEQRVKDFIAAAITQANVTRTNHIMWTMGDDFQYQNAESWFKQMDKLIHYVNKDGRVNALYSTPSIYTDAKNAANQPWPLKTDDYFPYADGPNAYWTGYFTSRPAFKRYVRILSGYYLAARQLEFFAGKKSTVGHTIDLGDALGVAQHHDAVSGTAKQHTTNDYAKRLAIGASRAEAVVSSSLYCLTSKKLGVQCSAPTSAFSQCQLLNISYCPPTEDGIPQAKSLVAVPIQQSYLWYSSSQGEGQDSGAYIFRPHTPPNIVSRSVPFKIIRGPLVDEVHQEFSSWIYQVTRVYKDKEHAEIEYTIGPIPIEDGIGKEVITQMTANMVTDKEFYTDSNGRDFLKRVRDHRDDWPLQVHEPVAGNYYPDKKSELSVLVDRATGGGSIKDGQVELMLHRRMLFDDGRGVDERLDELVCQNDRCQGLTVRGNYYVGIHKLGAGSHWRRTTGQEVYSPLLLAFAHEDLGNWKAFHVTRGTVIDPNYNLPPNVALITLEVLDNGMVLLRLAHLYEAGEDAQLSTLTKVELKKMFATKMIRGLIEVSLSANQEKEKMKKKTWNVAGDKGQGSKSVRGGPVSHINLVVELGPMEIRSFLLKF

SEQ ID NO: 142589 - protein, 379 aa, Glycine max
  Coding DNA Sequence Number=SeqID_50904
  Homolog annotation: Hit_ID=A7QDU4; Match level="QueryCoverage=63%, HitCoverage=91%, E-value=3e-67, Identity=49%"; Hit description =Chromosome chr4 scaffold_83, whole genome shotgun sequence
MAGQLARSRRLETQQQEQSRAKWTTSLTKILAALMVDQYTIVKSILDQSDFSWDEATGSITANDEIWAEYIKKHPDAETVKTGGCSIFKELCTIFSEPSTNGKHEYFAASKGEHTYTTPCPEPLNTHQEESSSESQDEEDANDLQTVQPTTPTAISTRKRGRKGIDDAIADAIFEMASASKMRAAAIEQQIARFSMADCIRDLDLMQGVDQQLYFAALELFDKPNAREIFLSLKKDKRLTWLRRNDNAIPNRRFVMVKKSSVSSKELNYNFLRFKNGKNNCIIGSSPQMLVWKICSLKISHYRKMKDLHFGRSDPLQEPEAKERMEVAEGEGWPWRSMRWPLLTDGVVTRTNGYEMECGEEDKHLACINFCWGVDKKKI

SEQ ID NO: 142590 - protein, 90 aa, Glycine max
  Coding DNA Sequence Number=SeqID_50905
MDLIAYSTPKKCSRKYLRSIRLRQERGLRIIGRIELAYGRVEVKATRFLDLAQFLTKLHKISSTSSNVDNRSKKQLCACKVYVAGHLALG

SEQ ID NO: 142591 - protein, 379 aa, Glycine max
  Coding DNA Sequence Number=SeqID_50906
  Gene Ontology: Mol. function=heat shock protein binding
  Homolog annotation: Hit_ID=A7PLM4; Match level="QueryCoverage=91%, HitCoverage=71%, E-value=4e-99, Identity=52%"; Hit description =Chromosome chr7 scaffold_20, whole genome shotgun sequence
  Pfam annotation: Domain name=DnaJ; Domain location=67-127; Score =50.0; E_value=8.1e-12; Accession=PF00226.22; Description=DnaJ domain
  Subcellular localization annotation: CTP_CleavageSite=53; ConfidenceScore=5.25e-01
MAYLAVAGAGYSSVAGINNRRPNFFIPIIPNNTISTLYSVASLCRCCREHGFSSASESAWTDFPVENAYELLGVSETSSFDEIKASFRKLAKETHPDLAESRNDSTASRRFVQILAAYEATTFKEMEVVEWLKWYRLTINNILAEKKVVVGTGYFDVLERDFYSAIHAAYYGPEIDSMELLPDCFEAEERSSYETPEVLHLVSGRDLFGMVCLANRVPEISITNNEKLTSFRSFHSGLCQSITHLNVHRNAERSDDFETHQGHSSKTSSIVSDAYRHLELHISGRVVATASRALPRCCSDEMQTEDTEDHIHVFLNLYEDPKHISSDFWKDYLANGAVGRRIRLGSISGLGSSPDEGCCYVYNDKGTKTHVIMKHRTLM

SEQ ID NO: 142592 - protein, 53 aa, Glycine max
  Coding DNA Sequence Number=SeqID_50907
MVIGSRTQGAPAFSGQSSSTGCYSAEVIHAIFLGKARTTFNKWVLVLEIDTGG

SEQ ID NO: 142593 - protein, 162 aa, Glycine max
  Coding DNA Sequence Number=SeqID_50908
MTVKNRLYSLLKEASSHQRNHGFRVQLYGLRLQPEFELRLCVPSGLLHRSRQQGLRLLLRRRRHQVQIRQGGQDSSLLRNRQLLGNPEEEDQDQVQHLLPIVPVSFTWVPAKSSPERPDIGSRPKPSESLQLDPCLGVSKHAVRTLLLISFVVIQMLLYRSS

SEQ ID NO: 142594 - protein, 265 aa, Glycine max
  Coding DNA Sequence Number=SeqID_50909
  Gene Ontology: Mol. function=kinase activity
  Homolog annotation: Hit_ID=Q7XIR9; Match level="QueryCoverage=61%, HitCoverage=34%, E-value=2e-14, Identity=30%"; Hit description =Putative RING3 protein
  Pfam annotation: Domain name=Bromodomain; Domain location=121-211; Score=19.8; E_value=3.3e-05; Accession=PF00439.16; Description =Bromodomain
MAKAEHPRRKLVIKIFPPGSKVSYSCGANTPKDSIVSKVCELKNKKGYYAMTMWVNTENPSESCVTDSRISRTEMATRVNTKNQSKVCESEKKKEDSVRVECKNREKKKQKVEHVMMMDRCKKMQCWAMLKRLMVGRDAWALQKDVLHPKIFYVLDKSEAMKKPKGLEDIESKLKNSDYSEAYEFVDDVRLVLSYALQYPPRSEVHRTATRITEGFEVNWKTMKEKWMREAEETNKICKRELHVCPNERSQVSNHLTKRSNIFMC

SEQ ID NO: 142595 - protein, 292 aa, Glycine max
  Coding DNA Sequence Number=SeqID_50910
  Homolog annotation: Hit_ID=A2Q4S5; Match level="QueryCoverage=84%, HitCoverage=39%, E-value=1e-23, Identity=34%"; Hit description=IMP dehydrogenase/GMP reductase, putative
  Pfam annotation: Domain name=DUF1723; Domain location=172-221; Score =56.2; E_value=1.1e-13; Accession=PF08330.1; Description=Protein of unknown function (DUF1723)
MVRTRGLGLALGRVVNRGLGKGDRDDSDGAPQRRRPTVSAHRHRVLVTVTDDEPMVPSDSPVVPATEPAVSADEPMVDAHVQDTGVDIGAGTDAEAAANDLEGFPGGLIDPSMLTEYAEHVAASVWTGEERPEFKLSSHGRKVQKLGRPVLDIKGLVAGTGLSPLIACSVDTSDQGLISSFVERWHRETSSFHLPVGEVTITLDDMASLLHLPIIGKFHSFQPLHVNETVLMLVDLLLISPEAARAKTGHCYGPYIRLSWLQDMYQRGCQAGHWTAVARAYLLILSGLHSFF

SEQ ID NO: 142596 - protein, 184 aa, Glycine max
  Coding DNA Sequence Number=SeqID_50911
  Homolog annotation: Hit_ID=A5BEV8; Match level="QueryCoverage=79%, HitCoverage=26%, E-value=1e-12, Identity=27%"; Hit description =Putative uncharacterized protein
MDEDQWMYESIMYEEVDMDYQNEEECGVNEPHVDCSDAFNTSQVFDSQEDVLRWARSVAHENGFVAVIIRSDTNTGSRGRTSVVGRKNLLEEILGLGNVGVPSSFVASQWLEDKAGWKSMVKPRNILLTLKEHNGNSCMTIKQIYNARSVYRSSIRGSDTEMQHLMKLLKRDQYIHWHRLKDED

SEQ ID NO: 142597 - protein, 93 aa, Glycine max
  Coding DNA Sequence Number=SeqID_50912
MAEQARQVFYVQDPYDERWCVVLPGKTIGVNVEDDDSYMDTYVSPLSIQITPNEEEADDEVVAEVVQKLQPREASTLFVEVKSEHLRSIYPIL

SEQ ID NO: 142598 - protein, 96 aa, Glycine max
  Coding DNA Sequence Number=SeqID_50913
MSAALMADRSGVTFHEDITNAVVVEITIGLEWEFLIPLGVILAILDLALIAISKSGPAVIAGKSIVLKPPTQNCLIYKHHLFLSTGQLAAASSAMP

SEQ ID NO: 142599 - protein, 357 aa, Glycine max
  Coding DNA Sequence Number=SeqID_50914
  Gene Ontology: Mol. function=binding; Cellular component=nucleus; Biological process=regulation of transcription, DNA-dependent
  Homolog annotation: Hit_ID=A2Q1G7; Match level="QueryCoverage=38%, HitCoverage=14%, E-value=1e-64, Identity=89%"; Hit description=HEAT
  Pfam annotation: Domain name=K-box; Domain location=54-142; Score =21.7; E_value=6.8e-06; Accession=PF01486.8; Description=K-box region
  Pfam annotation: Domain name=SRF-TF; Domain location=9-45; Score =24.9; E_value=0.00029; Accession=PF00319.9; Description=SRF-type transcription factor (DNA-binding and dimerisation domain)
  Pfam module annotation: Pfam domain module=K-box::SRF-TF; Domain location=54-142::9-45
MARGKIQIKRIENTTKKANKLTILCDAKVSIIMFSSTGKLHKIEQSTKQFFDQYQMILGVDIWNSHYENMQENLKKLKEVNRNLRKEFRMGDCLNVEDLRLLEEGMDKAAKVVRERKDIGTYDWPVEECHYCCRYLVCMILVALTGEKGKFNELLEDKGVNILIDPKALMNVIGTKMDFVDDKLRFSHITKGEDGNWAWLGMGKMMTRALVEEGALTALASIADSSEVQFQKYYDVVMPYLKAILVNANDKSNRMLRAKAMECISLVGMAVGKEKFRDDAKQVMDVLMSLQQSQLDADDPTASYILQAWARLCKCLGQDFLPYMGFVMPPLLQSAQLKPDVTITSTDSDTEFDEDDD

SEQ ID NO: 142600 - protein, 97 aa, Glycine max
  Coding DNA Sequence Number=SeqID_50915
MFVPPSTQWIFVLYNGSINCSCTLFGCIFDSEYGRAIEMKKDISLEALKDIIASQRTPYEGFKKIENGNDLRTIFTISFTYPNLPIVSLMENMTRGY

SEQ ID NO: 142601 - protein, 102 aa, Glycine max
  Coding DNA Sequence Number=SeqID_50916
  Homolog annotation: Hit_ID=A6FJQ2; Match level="QueryCoverage=37%, HitCoverage=84%, E-value=3e-11, Identity=92%"; Hit description=50S ribosomal protein L5
RIHEALRLARFVMTGETSDTCSSRRRSQLVCKRMPGADKPVRARQRMRKEKIPHQAPFAIQAAQLLGRAIGAGLFAITPAGERGMCCKAIKLGNARVFPVTT

SEQ ID NO: 142602 - protein, 46 aa, Glycine max
  Coding DNA Sequence Number=SeqID_50917
MKQALVEGDAKISGPNMYEKGAGYNHMRFLRATKLGQASFPVFLII

SEQ ID NO: 142603 - protein, 317 aa, Glycine max
  Coding DNA Sequence Number=SeqID_50918
  Subcellular localization annotation: CTP_CleavageSite=41; ConfidenceScore=5.46e-01
MAESSKKQKGTSSTTAAAGHRRHGPSEAPTAPIHSSLSSLRSSTLFSSDDQRLRYNSQFSSRIILDPKYLDTDFFNDETFDCYQVFQNSGLVDFMSLKLPYYPELVEFFYSNLKIHDGIISSEVHGISMIIDQSLFFSLTKLPSQCAPFEGTIVDDWKFDYSSHDARCMIDWAHLVRYRMHKALRANAPLPYPQLVTLFLRHFQIPLDDEPFVQVKRSFAIGAGTITSFGYHKDRDGQWLKKDALHPQDERTPSPPPQRDDSALMTKVLSKLRGLRTYVGERFDYLDGRFEGMDTHITQLEEDVTYLRRCFDLPPPS

SEQ ID NO: 142604 - protein, 416 aa, Glycine max
  Coding DNA Sequence Number=SeqID_50919
MRYNNAARKRREQEAQGRRGDHGLERHEGSQKLRIFLVPFVELEEASSTEVSAVRQSDRYYQYVDAVNGIDTHPYQHGDVGRPKKLNRHLDYNPGNELVTPLYVNPSDGYTDEIFGGRSMQKEIRVFSENPLSRLDDLIYQQGESYGITDSPHGMPHALSDPQLNESGARSGYISQNGFCQSFCINLEKCQLSSILPHKVSRVNLMENQHEYIVHHPQMQSKTPKVESSEPHKRQDLASSPYYDDSLGMNDPVHMMDNIITEKKNLNAQTDLSGPSYVAEDIQENSIKLERTKLIEEKNPIFMDSKVHEVKSTVIDMGHVPELHLLESFPANNFNAKINMQKNWELPSEGIVPVSSGMMGLSLNNLVGRARSDPDMSQRTSDHKKCALAEGLNREQGIDLSLTRNFDLNAPILNCE

SEQ ID NO: 142605 - protein, 198 aa, Glycine max
  Coding DNA Sequence Number=SeqID_50920
  Gene Ontology: Mol. function=protein serine/threonine kinase activity; Biological process=protein amino acid phosphorylation
  Homolog annotation: Hit_ID=A7NXT1; Match level="QueryCoverage=56%, HitCoverage=10%, E-value=6e-20, Identity=48%"; Hit description =Chromosome chr5 scaffold_2, whole genome shotgun sequence
MEIEATCRRNNAARKRREQEAQGRSQTSPPPSPQSYIQMEEEHARRMTLKDYSSTTTPQFFTSIARSEVQAAYISYHHSLITLPRSTKQVSLCSSSHLHRNVLISVFSYEDLQNMKEEYHGPERHEGSQKLRIFLVPLGESEETSSLEVSAVRQSDPDYQYVVAVNGMGDPTRTNIGGQSLTNETSPFGTEMNLAPVF

SEQ ID NO: 142606 - protein, 82 aa, Glycine max
  Coding DNA Sequence Number=SeqID_50921
MANFKATRQAPEGMKLHKRKRFFREATRWSGLFTIKDIKPYGGIEIEDQSKDHNWLVNGQILKIYLGGEVPQHTISFKLKDP

SEQ ID NO: 142607 - protein, 123 aa, Glycine max
  Coding DNA Sequence Number=SeqID_50922
MGEDEKMPEIDEATIENEMNENKLGQHLWTLQRWHDTLWRWHDVGHGGRCGINGQKLCRKLCSIASMDCASDENLETGQIQAKGPSGEGRRHKWRRMKAPMEKDEGPEAETLSRLLIVAEGPD

SEQ ID NO: 142608 - protein, 181 aa, Glycine max
  Coding DNA Sequence Number=SeqID_50923
  Homolog annotation: Hit_ID=A7Q161; Match level="QueryCoverage=62%, HitCoverage=18%, E-value=2e-11, Identity=39%"; Hit description =Chromosome chr10 scaffold_43, whole genome shotgun sequence
MAALRGVALPTQGVGTLPRRAINERQGQRKTRRVVNDIHGFFTKKNKEYQEKLPLVVLKVVEIIYSKANSEILHVVKVLLSPFIEFLKLTTCTLLRERDSGHNPSIGVESLYPCSAGLSLPSMLHSVPPIAALMVYDHRAESGASLGMLSSSSLYGGYGSFSMGDNGYGSMSSYATKLYGG

SEQ ID NO: 142609 - protein, 141 aa, Glycine max
  Coding DNA Sequence Number=SeqID_50924
MASWKRRVVPAQGGDSTWDSSCFTFETTWHRYQDNVHLQNILPKRNMELALEDRAPKYCRVRGQVIRFDTEINDFLDTLVNLADDIATALGTPGGGFVLNVDGAPWKLLRKDLTTLAQTWSVLSYFSLALTSHISDLVLGF

SEQ ID NO: 142610 - protein, 66 aa, Glycine max
  Coding DNA Sequence Number=SeqID_50925
MLLIPHDVAPCGVCRPGIFFINGILSFFNINGSRMLKEKKYYWRHQFKEKMSQEQAHHHRKPWIRA

SEQ ID NO: 142611 - protein, 108 aa, Glycine max
  Coding DNA Sequence Number=SeqID_50926
MRERYVSYPNFVRGLLLDDMQPLIGRFKILGTLCCTICKSRDEPEIKRKQGYAIREIPYCGGNQKEVLLRNPGRSEEERGSAFLALLILLKLLRKIVSVKKIQAEVLP

SEQ ID NO: 142612 - protein, 66 aa, Glycine max
  Coding DNA Sequence Number=SeqID_50927
MLLIPHDVAPCGVCRPGIFFISGILSFFNSNGSRMLKEKKYDWRRPFKEKMSQEQAHHHRKPWIRA

SEQ ID NO: 142613 - protein, 47 aa, Glycine max
  Coding DNA Sequence Number=SeqID_50928
MTLENYSSTTTPQFFISIARPEGKQKGSYTPLKVIACRLGKNSYKSS

SEQ ID NO: 142614 - protein, 206 aa, Glycine max
  Coding DNA Sequence Number=SeqID_50929
MALLSKAKFFQQIVNKAIIHKQGSKDLSYNAQKTRTLGRIYHGIILTKVFEAHGVIKKFLYETPEEQTPQVDDSILLNFIKNFGLNTRRDDQLDTMWKVAEEEDRVDADASQAEKRTKKNMDAPLSKVAPVPLCSPPSLVAPKAISAMYHLGEIDDDEDDLVFRKRKVAPPSDEATVPQMNKVKPTPQVPPPSTQTRTDKREKRGA

SEQ ID NO: 142615 - protein, 100 aa, Glycine max
  Coding DNA Sequence Number=SeqID_50930
MTSPTPPSPFYIDAIETIWEHDDSLCVDHFYGFLCCCRMPYVPGARIHIVNFYVWWTQPMSSYYRFTMLMLEVIIPFESHSPPADIVISSIGFGSSSKDT

SEQ ID NO: 142616 - protein, 75 aa, Glycine max
  Coding DNA Sequence Number=SeqID_50931
TCKRNLQDSGTLKRVAWGLDVGTRVSTTDYRTQLCGMLMRILKLAKYKLKAQVEKDKAPEWRRMKAQRQRHYQDY

SEQ ID NO: 142617 - protein, 30 aa, Glycine max
  Coding DNA Sequence Number=SeqID_50932
MGEDEKMPEIDEATIENEMNENKLGPQLEV

SEQ ID NO: 142618 - protein, 128 aa, Glycine max
  Coding DNA Sequence Number=SeqID_50933
MAWHLGMLLIGWLHGKRQRISRKKGKRNFSLVFLDPSLPEPPNDFKVKNPARLSKLMTRLKVVVPCDGHMGRAQRTIWAQRASDAKRNFSALSVTREFGRAQESRPLAKHKISSLSEMFISCQAQRVA

SEQ ID NO: 142619 - protein, 44 aa, Glycine max
  Coding DNA Sequence Number=SeqID_50934
MEKEILAVLYALKKFRSYHCVTKGEQASILWHCQNLPYGGHFNR

SEQ ID NO: 142620 - protein, 178 aa, Glycine max
  Coding DNA Sequence Number=SeqID_50935
MAPTRHPLDPDKSNRALGFPTLITGLCQLFGVPVAPSKVIRPPITRAFIEKYCTQRQAQDDAPQVADALPPHQAGPAGSFDSEQYLRHVVRQQAANHRAHVQTHDFLYQLSLSLQSKGFTSFPCPTPDQFKAEVAWPGDWPEARAGEAPAEAPDEADEAREDEEMTDLLDFLGGSGAT

SEQ ID NO: 142621 - protein, 163 aa, Glycine max
  Coding DNA Sequence Number=SeqID_50936
MSLKLPYYPELVKVFYSNLKIQDDIISYEVHGIYMIIDQSLFFSLTKLPSQGAPFEGTIVDDWKFDYSSHDARHMIDWAHLVRYRMHKALRANAPLPYPQLVTLFLRHFQIPLDDEPFVQVKRSFAIGAGAVTSFGYRKDHDGQWLKKDALPPQDERTPSPPP

SEQ ID NO: 142622 - protein, 82 aa, Glycine max
  Coding DNA Sequence Number=SeqID_50937
MVEENPRNGVNGGNGGEQNCELSHGLINMIERMQFHGLPSKDHDLHLKKFLRHTYIVRSLTNALDNIRLVAFSFTLSGKAED

SEQ ID NO: 142623 - protein, 59 aa, Glycine max
  Coding DNA Sequence Number=SeqID_50938
MSVKNLVGRLGVHDKTNHTLISQVILTRSKLHDESRLIQGVLMITKMMTKSSKVKNTSC

SEQ ID NO: 142624 - protein, 43 aa, Glycine max
  Coding DNA Sequence Number=SeqID_50939
MPQVGMARYVHVGTAIAAGENLAELAPREQVSPILLARQVFEG

SEQ ID NO: 142625 - protein, 250 aa, Glycine max
  Coding DNA Sequence Number=SeqID_50940
MFNEFYGELQWRQWHRVLTKILEKQIYIALVKEFYSNIYDPEGGAPKYYKVQGHVIRFDTETINDFLDNPVILAGGEEYLSYSQYLHTYPDHEAIVVALCTPEGGFVLNVNGTPWKLLRKDLTSLTQAWTVLYYFNLAPTSHTFDLNVDRATLIYGLVMKMDMDLGSFILGQITQIAQSNTSRLGLPVLIKPFCDAQGVVSDTPTFESLSPESDPLLMGLSPLRSEIPLKPDLGMTSLHIWPLIGTHGQT

SEQ ID NO: 142626 - protein, 54 aa, Glycine max
  Coding DNA Sequence Number=SeqID_50941
MEVEEPWLGLWLPLNYRVDMGARWCLALDVQQAGLVVDLGMAFVYDWVVGNEND

SEQ ID NO: 142627 - protein, 58 aa, Glycine max
  Coding DNA Sequence Number=SeqID_50942
MTAYGKDLCEGLKAFDAPPATPILGCFTAALSACPRLGIGRRPTGRNPSLSLRPSIST

SEQ ID NO: 142628 - protein, 57 aa, Glycine max
  Coding DNA Sequence Number=SeqID_50943
MTSRFCKLKRSWHFKFLSGSTLFYGGWIFELHFNGDFSPWRFSGRQRKRGGEEAPIH

SEQ ID NO: 142629 - protein, 80 aa, Glycine max
  Coding DNA Sequence Number=SeqID_50944
MGSPSMGGSKRRLSSRRLGGALREQRARLYSVDTWPEENERDEFSPALDYCELVKPSWKKNGKIQPYGATNGNLRNPMAT

SEQ ID NO: 142630 - protein, 83 aa, Glycine max
  Coding DNA Sequence Number=SeqID_50945
MEMYIKSNHYRLWLIIKNGEIPITSPEAKWTNANMTITELNTKAHYTLTYALSRNEYNKIYRLKIAKEICLLLGHTFTRLRLT

SEQ ID NO: 142631 - protein, 218 aa, Glycine max
  Coding DNA Sequence Number=SeqID_50946
  Homolog annotation: Hit_ID=A5B4W3; Match level="QueryCoverage=34%, HitCoverage=9%, E-value=1e-13, Identity=46%"; Hit description =Putative uncharacterized protein
  Pfam annotation: Domain name=PPR; Domain location=15-49; Score=28.3; E_value=2.8e-05; Accession=PF01535.11; Description=PPR repeat
MAHLLFDKIENKDVVSWSSMIKSYDRSQLLHEALDLLRDMHVMRVKPSEIGMISITHVLAKLADFKLGKAMFAYSVKGDKVFAKADGHSDNHKSNGKNHNSTNMPSNLTSARDHGMDKKKQEVVAAAGNGYDDFYDGLGCCHVRDTSMMGYRPPKTPIDPNKKLGSEDKGDPVDMAWYQRLVAMGRLIYFYHTGQQGIKVFTHVDCPGSIINQKFTSA

SEQ ID NO: 142632 - protein, 858 aa, Glycine max
  Coding DNA Sequence Number=SeqID_50947
  Gene Ontology: Mol. function=oxidoreductase activity; Cellular component=integral to membrane; Biological process=electron transport
  Homolog annotation: Hit_ID=A7NZ99; Match level="QueryCoverage=99%, HitCoverage=99%, E-value=0.0, Identity=64%"; Hit description =Chromosome chr6 scaffold_3, whole genome shotgun sequence
  Pfam annotation: Domain name=FAD_binding_8; Domain location=533-662; Score=144.6; E_value=2.7e-40; Accession=PF08022.3; Description=FAD -binding domain
  Pfam annotation: Domain name=Ferric_reduct; Domain location=335-492; Score=149.5; E_value=9.4e-42; Accession=PF01794.10; Description =Ferric reductase like transmembrane component
  Pfam annotation: Domain name=NADPH_Ox; Domain location=72-175; Score =157.1; E_value=4.9e-44; Accession=PF08414.1; Description=Respiratory burst NADPH oxidase
  Pfam annotation: Domain name=NAD_binding_6; Domain location=668-841; Score=242.9; E_value=6.9e-70; Accession=PF08030.3; Description =Ferric reductase NAD binding domain
  Pfam annotation: Domain name=efhand; Domain location=176-204; Score =25.9; E_value=0.00015; Accession=PF00036.23; Description=EF hand
  Pfam annotation: Domain name=efhand; Domain location=220-248; Score =9.7; E_value=1.7; Accession=PF00036.23; Description=EF hand
  Pfam module annotation: Pfam domain module=FAD_binding_8::Ferric _reduct::NADPH_Ox::NAD_binding_6::efhand::efhand; Domain location=533- 662::335-492::72-175::668-841::176-204::220-248
MSTEKGGKDESSTWILEGIDIDPIVERPKRDDEAPPNGIMVLKSPNDADVNNNNNSNVRSRVGIQGNNGGRKMMRAESGAARGIKSLRFLDRTVTGKEADAWKSIEKRFTQNAVDGKLTKDKFGTCMGMGAESKDFAGELYEALARRRNVCAENGITLDEVKVFWEDMTNRDLESRLQVFFDMCDKNGDGRLSEEEVKEVIVLSASANKLGNLKVHADAYASLIMEELDPDHNGYIEMWQLETLLKEMASAEDGTKKLDNCRAMTLSRAMIPSKYRTPVSKFLSTTAEFALDKWKKIWVVALWLAINLVLFIWKFKQYREREAFKVMGYCLCFAKGAAETLKFNMALIVLTMCRRTLTKLRGSFLNRIIPFDDNINFHKTIAVAVVIGTFIHVMMHITCDFPRLISCPENKFMSILGQDFNYEQPTFYTLLKSILGVTGILMVLLMAFIFTLATHYFRKSVVKLPLSLHRLAGFNAFWYAHHLLIVVYILLIIHGYFLFLTKEWDKKTTWMYLVVPLVLYAFERIHPFFRGKDHRVSIIKAIIYTGNVLALYMTKPQGFKYKSGMYIFVKCPDISSFEWHPFSITSAPGDDYLSVHIRTLGDWTTELKNKFTQVCEPHSAQPRKGNLMRMETRAPSSNYNHSSNSSIRYPKILIKGPYGAPAQSYKNYDVLMLIGLGIGATPMISILKDMLNNMKSESPKEGTYMQDSDHSYHLDDQIKKGPERAYFYWVTREQSSFEWFKGVMDDIADYDHDNIIEMHNYLTSVYEEGDARSALIAMIQKLQHAKNGVDVVSESRIRTHFARPNWKKVFTQLANAHQSSRIGVFYCGSPTLTKTLKELCLEFSLNSSTRFQFHKENF

SEQ ID NO: 142633 - protein, 155 aa, Glycine max
  Coding DNA Sequence Number=SeqID_50948
MPYKEIAPKKLSIKRCRRDALGEGFSAPVEFDNHRFRSVEHQQCFEAIKGWSFHRERRVQLIEDEYPNFQEEIARRHWEPLVTPMAKFDPEIVLEFYANAWPMEEGVWDMRSWIRSQWIPFIQRRCPQPVLGPPTDLGGGPAVRVQPEELPGLWL

SEQ ID NO: 142634 - protein, 77 aa, Glycine max
  Coding DNA Sequence Number=SeqID_50949
MSVKNLIGRLGVHDKTNHRLARRPIRVMLFCENTPTMWEWHRLKGALKPGVFISKAYTPKSPSGSLPPDSGPTQKTF

SEQ ID NO: 142635 - protein, 160 aa, Glycine max
  Coding DNA Sequence Number=SeqID_50950
MARYATLVQVSREVCEAAYFDEDEYDKMLHFLSNEVRRLKSNKNSEPCIDDNDEQANQQGHNYDGILDPIVVRTKGCGQVGVDESGKRRRIQKCGQCGGSGHNKCSCTNRPRNANVCVGGSFISFSEQTNTMCQPTDEYNYQLLMQQPHTFVAGSSRPGP

SEQ ID NO: 142636 - protein, 175 aa, Glycine max
  Coding DNA Sequence Number=SeqID_50951
DMPCTFKPTVDMNLTFKETQIILFMALKVAYSQLYRTRSVWCMPPTFVLDVIDGTPVEIVMLHYGKDWMPSFSNLKLANVMLSVLESVFETQDLIFGFDGMDNWDIVEPRGIPNCGSSEKSALWVLEWMQMEESFVNLLYGVLDEKAIRMKVAMILLLGTHNQYKGELIRNAERT

SEQ ID NO: 142637 - protein, 212 aa, Glycine max
  Coding DNA Sequence Number=SeqID_50952
MYICREKRVMRSARGDLRRRKAVTEKEKRTPFEPNLQGVVVELKLDGLRNVLKEENFEKDELKNRNNKKEDGSVFCLQIVEEEWGWNVDTMLYIDFTKMFLALMWLKCMWTRGCLTNLKKKLNDFKGDEVVVIDGVEVEAVVEGEDEAEIQVEDEVQVHEQGLVEVQVQAEDEASVVGEMAIVVEGVVEDDVGAEEDDDDVGAEEDDDDSSD

SEQ ID NO: 142638 - protein, 74 aa, Glycine max
  Coding DNA Sequence Number=SeqID_50953
  Gene Ontology: Mol. function=DNA-directed RNA polymerase activity; Biological process=regulation of transcription
  Homolog annotation: Hit_ID=Q9LNK0; Match level="QueryCoverage=91%, HitCoverage=61%, E-value=1e-15, Identity=57%"; Hit description=DNA -directed RNA polymerase subunit
  Pfam annotation: Domain name=RNA_POL_M_15KD; Domain location=1-55; Score=19.7; E_value=0.0013; Accession=PF02150.7; Description=RNA polymerases M15 Kd subunit
MEFCPSCGNMLQYELPYMGRPSRFFCSACPYVCHIENRVEIKRKQRLVRKEIEPIFSEDDMTNAPSTEVWLDNS

SEQ ID NO: 142639 - protein, 239 aa, Glycine max
  Coding DNA Sequence Number=SeqID_50954
MKQNLGFKIGIARNHIKHGLSSMISFFEPPGRSGGRGRGHDGGDGRGGIEVVGKVIGEEVVTVHGGSHNNDQLLIKSRNGSNSKKQLEGRVAKVEGKDQAWRDFLKECKDITHKGLENNRELVEASRKKECCQVFSLNGTPTERNSQSRAVLEIFPRGCFFCMYPAWEAPAELATSCMCDKCQVLEESANLIGDFMFELQHVIPVSALTGVVPSSSSSSSAGLGHRCRETPFPLALPAS

SEQ ID NO: 142640 - protein, 207 aa, Glycine max
  Coding DNA Sequence Number=SeqID_50955
  Gene Ontology: Mol. function=hydrolase activity; Cellular component =cellulose and pectin-containing cell wall; Biological process =negative regulation of Wnt receptor signaling pathway
  Homolog annotation: Hit_ID=A7PNM1; Match level="QueryCoverage=69%, HitCoverage=34%, E-value=1e-54, Identity=69%"; Hit description =Chromosome chr8 scaffold_23, whole genome shotgun sequence
  Pfam annotation: Domain name=PAE; Domain location=41-207; Score=77.5; E_value=1.1e-20; Accession=PF03283.4; Description=Pectinacetylesterase
MPSWSSSSSALTAPNLRLRTLRIWSSKDYAIAAFIFLILFSLLLFSHLDSRYDSQPHHSKLVPLTLLRNANQTRALCLDGSAPGYHFQSGFGSGSRNWLIHIEGGGWCNSIPSCYQRKFTHLGSSDHMEKLIPFSGILSSDPAQNPDFFNWNKVKIRYCDGASFAGHPESERGSGLFFRGQVIWEAIMDELLSTGLSNAKQVILPPQ

SEQ ID NO: 142641 - protein, 140 aa, Glycine max
  Coding DNA Sequence Number=SeqID_50956
MNNQFLEMLLHQSVQRWSSLQTTKGGISRAMRHLMGVKGDVGACQKVPLEIKEASEKNKVVNDVAVGQEKDDDEVEALEEIYNIRVGKRLAATGSTPAAKGNTVKDHMDLHMPIEENRIASLIQQTIAESVGDWYFDREA

SEQ ID NO: 142642 - protein, 90 aa, Glycine max
  Coding DNA Sequence Number=SeqID_50957
MGRMKKWKEGTENGEIAIRERETKKVKMNNSRVQDKNQEEFKTQEESLESRIKIQGSRSQESRSRFKTQDSRIKRRLNQDKYEKLFSKIE

SEQ ID NO: 142643 - protein, 398 aa, Glycine max
  Coding DNA Sequence Number=SeqID_50958
MGGRTVARDLAPINLEIEATCRRNNAARKRREKEAQGCSQTSPPPTPQSYIQMEEKHARQMTLGDYSSTATPQFFTSIARPEVQAANISYPHSLVLLIQGILFHGNDGLERHEGSQKLRIFLVPLGESEETSSTDASAVRQSDRDYQYVVVVNDMNGINALNPNGILNDSMNFQRPLPIPPTPIQGSIESNASFSTAQLHPEYSNIRTADCRYPQQAAATLSSDTHPYQHGDVGRPKKLNRHLDYNPGNELVTPLYVNPSDGYSDEIFGGRSMQKERRVYSENPLSRLDDLIYQQGESYGITDSPHGMPHALSDPQLNESGARSGYILQNGFGQSFCINLEKCQLSSILPHKVSQVNLMENQHKSIVHHPQMQSKTPKVESSEPHKRQDLTSSPLHYI

SEQ ID NO: 142644 - protein, 86 aa, Glycine max
  Coding DNA Sequence Number=SeqID_50959
MTSRRIKIQEKGTSFVVQVEGTSTWVIVTKNKRGYISCGSAQVEGTSTWLFKENRGGYIPCGSLLVKAFTRLKRNLNDHRSLGDWM

SEQ ID NO: 142645 - protein, 125 aa, Glycine max
  Coding DNA Sequence Number=SeqID_50960
MNQDAEHSVSLGSTPPPSRLSTLNKELEMVLATLPELTNEEHEQCCKMAKIMLKVTVPSEIYGKVSRSFAVRWKDVLDRYWHLLDKDGNLHIVLYNQDLDILAIVAWWTTLRDFYHMTGEIIKCR

SEQ ID NO: 142646 - protein, 194 aa, Glycine max
  Coding DNA Sequence Number=SeqID_50961
MQSQGLALPPEPEVGNDPDTGNSENYGLYVEENHPCLIALGRLYEGSTNIHNILLRHDQVKVGVEEVRDADAPFPVPTQEVQLVGQTLTPSLLGRHILSSVYQNRHMTETSMRAGNANVYGFLEPQSIQRPGQSQSKRDVYLGAYLNGADLQMVVILPKKNVVIWFCSLHNRSDNYLKGIINSALKGLDDTPQN

SEQ ID NO: 142647 - protein, 169 aa, Glycine max
  Coding DNA Sequence Number=SeqID_50962
  Gene Ontology: Mol. function=nucleic acid binding
  Homolog annotation: Hit_ID=A5AQD2; Match level="QueryCoverage=53%, HitCoverage=17%, E-value=9e-17, Identity=43%"; Hit description =Putative uncharacterized protein
MEKSDRKTLNDKKAKKVYITWEDNDMDSSGDSENEVVNLSLMAKNYESEEEDSLKKSWYIDRGCPKHMTGDASEFTHISPKNSGHVTYGDNNKGRILGVGKIDYLEDMHIHEEKHKGKENGNDEDFQIDETKTSTDLPREWRTSRYHPLDNIIGDISKGVTTRQSLKDA

SEQ ID NO: 142648 - protein, 213 aa, Glycine max
  Coding DNA Sequence Number=SeqID_50963
  Homolog annotation: Hit_ID=A5AZ88; Match level="QueryCoverage=45%, HitCoverage=9%, E-value=3e-09, Identity=39%"; Hit description =Putative uncharacterized protein
GNNLKMWEEVVEKFLKKYFPESKTTEGKEAISSFHQFLDECLSEALERFYDLLRKTPTHGFTEPIQLNIFIDVQAFGKCFYWGKIKLKTPEEAMELIENMAAIFVEELMNLSVVFPKMMLLKRLPTMREFQSKSRARMKVSMSNHKSTESAIKNLEIQVGQLAKQIAESSSRGFGANTEKNPKEECMVVMTRSKREIIVENESRTNEEKELGA

SEQ ID NO: 142649 - protein, 81 aa, Glycine max
  Coding DNA Sequence Number=SeqID_50964
MGHQDVEQGSLTRRGSNGREKGDGREQVGEGRVVLPIGTRENCEQVRGRDRVQGGDGLGEVKEQKCFSGDCEGCQKSHLGT

SEQ ID NO: 142650 - protein, 60 aa, Glycine max
  Coding DNA Sequence Number=SeqID_50965
MTRFQKMAKEDALSLDNIEGGVCAEYTNAGVYGRRNSGSNKEAFEMGERRLHLSWTQGIL

SEQ ID NO: 142651 - protein, 119 aa, Glycine max
  Coding DNA Sequence Number=SeqID_50966
  Homolog annotation: Hit_ID=A5BB26; Match level="QueryCoverage=50%, HitCoverage=23%, E-value=9e-09, Identity=41%"; Hit description =Putative uncharacterized protein
MDNIFEVVPTTEEQKMVYDTFMLKDEAKNWWKDTRERMMALETPVIWENFKITFLEKYFPHNDNLNKLKADQCLVLKRKSEEMTHPPTIKYKMEGFKGKKVMIFGTPKVEACPKCGKTH

SEQ ID NO: 142652 - protein, 46 aa, Glycine max
  Coding DNA Sequence Number=SeqID_50967
MVAIAAQLPLSQLGRISVSDTEEEEEEEEHGLGVILSWLERRFAFR

SEQ ID NO: 142653 - protein, 242 aa, Glycine max
  Coding DNA Sequence Number=SeqID_50968
  Gene Ontology: Mol. function=endonuclease activity
  Homolog annotation: Hit_ID=Q2HUP4; Match level="QueryCoverage=51%, HitCoverage=42%, E-value=6e-50, Identity=76%"; Hit description =Endonuclease/exonuclease/phosphatase
MVDELVESGSVNVILWARAPTATRHITPERSAGKKNRHTHAAAAGTNEENKPESTDLDQEGIERIRIFLGRLEKPTVMDIGFMSHRSHDDTDTLIQTLRHMFTMSQDQRKTLSNLYDMDQLRNNVNARSLPGSNALYGSSTVSKEQGSLHRRPDVVKSKQGFPHFRERVWVKKLVHDRRIRFGTWNTGTLTGKSMEIVDVMVRRKINFMCLQETKWTSEKAKELDNSGFKLWYTEKIRSRNG

SEQ ID NO: 142654 - protein, 94 aa, Glycine max
  Coding DNA Sequence Number=SeqID_50969
MWEEVVEKFLKKYFPESKTTEGKEAISSFHQFLDEFQAFGKCFYWGKIKLKTPEEAMELIENMAASDHAILSDRTHIPTKRSLLELSSQDALLA

SEQ ID NO: 142655 - protein, 125 aa, Glycine max
  Coding DNA Sequence Number=SeqID_50970
MASRNENVPTIVYYDAYVTDCDDGVEFKGGNNVLVSMKRGMTFNALKTKIQLKMGLNRVGDFNDDEDEILADNNNINNNDNNDIHFLFQPTSTENAYHPYPNNVDVGDNQVADKPDCRHFLDQQQ

SEQ ID NO: 142656 - protein, 43 aa, Glycine max
  Coding DNA Sequence Number=SeqID_50971
MVWGFMILKELCYFEDPTKRIHAAEVRNIEFHVVVLWAHQAWS

SEQ ID NO: 142657 - protein, 77 aa, Glycine max
  Coding DNA Sequence Number=SeqID_50972
MGHEEEEEDDDNNNTNNNDDDNDDDDDNGDDHVPQQQQEEDNKHMQIQSNKIRDLDVYLEELVVGHQLIINFSLKNM

SEQ ID NO: 142658 - protein, 145 aa, Glycine max
  Coding DNA Sequence Number=SeqID_50973
MGEDSWSLVRKHLHKELTSWSKEYINLLGGIEKFEELKYSLLVAGLYMVTIDKSINITDMGYVIASQYKGFDDAKVESNKVASTSIPRLIQGQANKIMKKIRPQTISLVDQAFVSKHIVSNIQGSGNRLPGSVIDYQKTILKISF

SEQ ID NO: 142659 - protein, 80 aa, Glycine max
  Coding DNA Sequence Number=SeqID_50974
MKTYKKQSQVKGVESLELVCQHIAFSKYSCVLQKPIPLLFASIVSKIAENFRALCTACICILGNVRLEFLVDQQECLVQQ

SEQ ID NO: 142660 - protein, 72 aa, Glycine max
  Coding DNA Sequence Number=SeqID_50975
MVGKLLSNNSFNVRAFKTSMENVWKEWNFHQPLIIMNDLGPDEALNKVDLPWSPFWIRIEDFPLGFQTQAIT

SEQ ID NO: 142661 - protein, 74 aa, Glycine max
  Coding DNA Sequence Number=SeqID_50976
MELFGGLEMAPMWRSSMTNESQTVLMALFIRTIIVGLIRILPFCEMLKPLQFQAKRREGRAVGVSLSEAYALSE

SEQ ID NO: 142662 - protein, 195 aa, Glycine max
  Coding DNA Sequence Number=SeqID_50977
  Subcellular localization annotation: CTP_CleavageSite=67; ConfidenceScore=5.85e-01
MIIGLTSFSPKNTYFKCSGRVFNSTLVFSTGLSFFYSSKTILPEGFSSTPSNSSKQLCTSFSSSVVRHSIVKKRLSHEVQKVTVELSSSVGLSAHPLLSAASVCLVRQKNLAEHQYQGCAGISFVVQVEDTSTWIVATENKRGYISCGSVQVEGASTWLFKEKKGGYIPCGSLLVKVFTRLKRNLKDRRLLGDWM

SEQ ID NO: 142663 - protein, 353 aa, Glycine max
  Coding DNA Sequence Number=SeqID_50978
MAFRKRKSTAFRPQEPYDTTRFISEGAWERYAQNVHSRNILPERNVTLYISEYDEIRRELEQRRWHKALSRQPDGYIDVVLVKEFHANLYDPEDKSPRQVRGSVTPPRPGAPWKLLRKDLTTLAQTWSVLSYSNLAPTSHTSDPNIDRARLTYGLVMKMDMNLGSLISGQISQMAQSNSSRLGFPALITALWIARGVVLDSLTFESLSPAINLAYIRKNCWNPDDPTITFSGTRKTWARGPEASSSTPSAPTPPSAPSGTSAQSTKILVSMLQSLHHGLSLDFMAQVAWLGVQPSPLQGGEASTAQELQLEAEPEPKVTPEAEETPEDTLAATPTEDTDYVADMAAVQSTWDP

SEQ ID NO: 142664 - protein, 137 aa, Glycine max
  Coding DNA Sequence Number=SeqID_50979
MSHIKIRRSYPLPSLSTPLLKTVLLHHIVAFSFKLGTHPDETNLFPKIAALWEKLIGQQVFKGRDRGSNSTKQFWRIQRKKRERVREEWWHVLVPKTSPSYLPTLSSCHREIHNYPPQPPHADAKNRWSLNNNHQTL

SEQ ID NO: 142665 - protein, 164 aa, Glycine max
  Coding DNA Sequence Number=SeqID_50980
MERGHGMYYTPATFSEYPSQMYQYPFAGHHTDTSETSHSFGGVAETQPHFSWPTMTPSQQHDAPMATPNAPFTPQWNVPGAIPYMGDLLGVDLRKEFSAEAEQEKRGDNAAAEEILIVKREDGIDHVAHPHDITDTIMTDFDVFELGQGVRVRFYALGLGFGAK

SEQ ID NO: 142666 - protein, 127 aa, Glycine max
  Coding DNA Sequence Number=SeqID_50981
MTILVDDKRLPLEGEATMWKRLTLEGEMSWVTSVSVVLDLLMWWLVVHRCTPRYKCECGVKLPYVVARGPQARGQTDITNPISAPTSILDYWEKSESDSKSGQHDFSLSKSERVQFDSHEVRFCYHA

SEQ ID NO: 142667 - protein, 719 aa, Glycine max
  Coding DNA Sequence Number=SeqID_50982
  Gene Ontology: Mol. function=zinc ion binding; Cellular component =intracellular; Biological process=proteolysis
  Homolog annotation: Hit_ID=A5B236; Match level="QueryCoverage=97%, HitCoverage=97%, E-value=0.0, Identity=80%"; Hit description =Putative uncharacterized protein
  Pfam annotation: Domain name=SWIM; Domain location=548-606; Score =19.5; E_value=0.0029; Accession=PF04434.8; Description=SWIM zinc finger
MAIVESVGKIPLQDPPEEEFCAADLTWTKFGNAEHHDEVALIPYDRVDAFIIGECTNVECPTRFHIERGRKRTIGNLKEYKDDEYLEYRLYWCSFGPENYGEGGGILPSRRYRLNTRNRAARPQSMRGCTCHFVVKRLYAQPSLALIVYNERRHINKSGFICHGPLDRDAIGPGAKKIPYICNEIQQQTMSMIYLGIPEENILEKHIEGIQRYCGSDAKVSSLASQYVHKLGMIIKRSTHELDLDDQASIRMWIERNRKSVFFHQDTSESDPFILGIQTEWQLQQMIRFGHRSVVAADSTFGVKRLKYPLFTLLVFDSRQHALPVAWVITRSFTKPDVSKWLKALIDRARSVEPGWKVSGFLIDDAAAEIDLLRDIFCCPVLFSLWRVRRSWLRNIVKKCSNIEIQREIFKRLGRIVYNIWGGINASLALEQFLLDFVDQTAFMEYFKVMWLPKLEMWLSTMRNFPLASQEASGALEAYHVKLKAKLFDDSHLGALQRVDWLVHKLTTELHSSYWLDRYADESDSFQNVKEKYIASTSWHRALQIPDYAVSLDDKDHLFAKVVSQKDSSLTHIVWNPGSEFAFCDCSWSMQGNLCKHVVKVNMICENLKGYQPSMSFRSFQEVLMDLWKKPVDDSFALDLSLAWTHQMLDQIQKQVELNNSTDIGTVVNNMPLKWVSKKGRTYIGKPSSSLALPHGSSNTKSVVVYKKNRKRKRLSRLR

SEQ ID NO: 142668 - protein, 117 aa, Glycine max
  Coding DNA Sequence Number=SeqID_50983
MVKEERKEVSVSSKMLAKKESHFAIKTNIKETSPLRQPPHLLLCKKKLVSTARPLGFDIIPQVKELLDEGLVHKSLNPCALLVPKKGNDAILPPQGHWIKDSKKIGPKRQEKTLGFS

SEQ ID NO: 142669 - protein, 35 aa, Glycine max
  Coding DNA Sequence Number=SeqID_50984
MSDESSIERFIASLIEGLNPSNLSDGGIRIDSKHL

SEQ ID NO: 142670 - protein, 204 aa, Glycine max
  Coding DNA Sequence Number=SeqID_50985
MSSRNENVPVVVYYDAYVTDCEEGIEFKGGNNVLVSMWRGMAFNALKTKSNLLVQYEQQPSSTTNVETTVQSPQIHETSYTDYHTQTYHEGSSSYTPIPYKTTNDYYVPHFEPTEFDTHISSYTQLLGGLSNYCETTPQLNEPSQLNVDPTTDIHVAQSKSNKISHDYHAQNGLANKVVGDFSDNEDEILMDNNNNDDNYDNDI

SEQ ID NO: 142671 - protein, 63 aa, Glycine max
  Coding DNA Sequence Number=SeqID_50986
MGIFNHGVAAEDKGEESSTWEASLRSKEGSFLGKLEEEIFLGKLKEESFLEKLEGGYSHPSNS

SEQ ID NO: 142672 - protein, 126 aa, Glycine max
  Coding DNA Sequence Number=SeqID_50987
MRYQVACILNNEKKVLPVEQIVLPEELSSEEATGRSSSDNFSGRRFFRMNKLFYQKNLIPEKLPEEVLPVALFFWKNLLPEEVLLNSLGAMSTVESAFYVKQFLFILLEFKTTFTWKEPLSAHYTG

SEQ ID NO: 142673 - protein, 98 aa, Glycine max
  Coding DNA Sequence Number=SeqID_50988
MKLASTDLIRETHDTKLFQPSYNGKFFIPFPVDHNNKLAQFFQIENKDKEIYETNGCHGQQTSPFLSIDLSMEDPSDIFCSGYIQDEENVTITKSTKN

SEQ ID NO: 142674 - protein, 129 aa, Glycine max
  Coding DNA Sequence Number=SeqID_50989
MRKVRRKTKMFVDPKNANIATLVEVAETLQYMVSPRGRNTWTVDDLVPYVEKITILSEKQERITEPVAHGPASERRFPTQEFHILQSSVETRGFGRQKEVVEAEEISQQMEERGHGMYYTPPTFSQYPS

SEQ ID NO: 142675 - protein, 84 aa, Glycine max
  Coding DNA Sequence Number=SeqID_50990
PVQVIEVTSSEEDPEEDPEDLPPELVVDALDFLEGDEDPLLEVDSPEEVMSASEADSTEDSGPGEMAISGGSSSYHHYGHLCSG

SEQ ID NO: 142676 - protein, 65 aa, Glycine max
  Coding DNA Sequence Number=SeqID_50991
MTLGAEFNVESLTCRDWNTSLKVSQKVCVRFCARKKRTTYISMKFSRFKKLGLGFDMLMKDRDTG

SEQ ID NO: 142677 - protein, 96 aa, Glycine max
  Coding DNA Sequence Number=SeqID_50992
MTIEMDIEPKFNEKCKIHRKNHFDDIVNDEIAHLLKVVMVEITMVMVAMMTMITTMLVVAAMIEDHGGGYGDSHDSYGENDHYDGNSHGDDRFEIL

SEQ ID NO: 142678 - protein, 92 aa, Glycine max
  Coding DNA Sequence Number=SeqID_50993
MVYVRNDRLSRQHHESCDVARIILDFVRHHVQAIELRRLCAHNGGVRAVGGTDVLPDLLLMELIAPSRNMMKKNDHLPAEFLFNIVKVTKFV

SEQ ID NO: 142679 - protein, 132 aa, Glycine max
  Coding DNA Sequence Number=SeqID_50994
  Homolog annotation: Hit_ID=A5B3J2; Match level="QueryCoverage=55%, HitCoverage=16%, E-value=8e-08, Identity=41%"; Hit description =Putative uncharacterized protein
MLREEQEIQGSSQPSLPPSPQSYYQLEEEHAGRVTLEDYFSITTPQFFTSIARSEVQAANISYPHSLIQLIQENLFHSLSNEDPYAHLATYIEICNTVKIVGVPENAIRLTFFSFLWQRKQKGGYTPSKAIA

SEQ ID NO: 142680 - protein, 339 aa, Glycine max
  Coding DNA Sequence Number=SeqID_50995
  Homolog annotation: Hit_ID=A5B5G7; Match level="QueryCoverage=62%, HitCoverage=14%, E-value=5e-07, Identity=23%"; Hit description =Putative uncharacterized protein
MNENDDPAKRVCVLSGLSVQTLRFLKFSFSAKPALSRFHSQEAWDRYNNDIVVPRKLLPERNVVVYYTEFDEFKEELKRRKWGEELTSFADGSIDVAIVKEFYANLYDLEDKSPKQVRVRGHLIKFDEDTLNTFLKTPVIVEEGENVCAHSRFALLRPNPHELVAKLCIPRRGFELNANGQPLKILRKNMTILAQTWSVFSFFNLIPTSHTSDVILERAKLIYGIIMKMDMNVGYLISHQIFITTQHDSSRLGFSTLITTLCKARGVQSDSRSLKILSPAINLAYIKKNYWNLDDPTVTFRGPKKARGRRSEAPTTPAVPDTSAPSSSTALAPHNSTPA

SEQ ID NO: 142681 - protein, 108 aa, Glycine max
  Coding DNA Sequence Number=SeqID_50996
MQSLQGLGLPSIMSMDEFDTQVAWPGAQPSPSGGDGASAAQEPEPKEPAAAAKGPAEGEDELTSPEPFYFDTDVHMAQEETFTDQIPEPSPAPVPKETLPCSPVMEPE

SEQ ID NO: 142682 - protein, 49 aa, Glycine max
  Coding DNA Sequence Number=SeqID_50997
MPYRLHEGMAMEPEPALILTGKAQVDWGQVRVFPNSQSRVRVGDRIINT

SEQ ID NO: 142683 - protein, 95 aa, Glycine max
  Coding DNA Sequence Number=SeqID_50998
MKLDEDLSPNREDDFQTNNEENQAQRGDEGATSSSNDPLHWIGGPMIRSKTKKMKQAFQGMILTIKEKEDSCELRATPNWVALGIPIDEDALSPT

SEQ ID NO: 142684 - protein, 220 aa, Glycine max
  Coding DNA Sequence Number=SeqID_50999
MSLHDVHVCNTIDYDIHHVQSPDLENMTVFQNIIEVPSLYHKQWALDYPNYVVLDYNGNKHHIRVRKFNNRVYIADGLKHFRRDMRIYEGVMITFAVPDKNWKFDIHFSPPLHAQTCGRPPYSAREYVFTMDVDNRMIVRLYPLVLSLDAVSYVNAGDEYITVLGVRERRHFWKLSIHNGLQCLAEPWFQFLTENDLMAGDEVVFYFRPNQLLWEVIARK

SEQ ID NO: 142685 - protein, 62 aa, Glycine max
  Coding DNA Sequence Number=SeqID_51000
MIIIKTSKPIASTARYSVVFQIGSFAKYKKKEEVEMRVVIAKRAGRTKSVSYLCFPLISDER

SEQ ID NO: 142686 - protein, 28 aa, Glycine max
  Coding DNA Sequence Number=SeqID_51001
MAGHSSYTSWRCHTGRDEFEGERGLRET

SEQ ID NO: 142687 - protein, 303 aa, Glycine max
  Coding DNA Sequence Number=SeqID_51002
  Gene Ontology: Mol. function=binding; Cellular component =mitochondrion; Biological process=cell cycle
  Homolog annotation: Hit_ID=Q1RSH5; Match level="QueryCoverage=100%, HitCoverage=58%, E-value=1e-103, Identity=40%"; Hit description =Tetratricopeptide-like helical
  Pfam annotation: Domain name=PPR; Domain location=11-45; Score=38.6; E_value=2.2e-08; Accession=PF01535.11; Description=PPR repeat
  Pfam annotation: Domain name=PPR; Domain location=134-168; Score =31.1; E_value=4e-06; Accession=PF01535.11; Description=PPR repeat
  Pfam annotation: Domain name=PPR; Domain location=203-236; Score=1.5; E_value=5.2; Accession=PF01535.11; Description=PPR repeat
  Pfam annotation: Domain name=PPR; Domain location=237-271; Score =26.4; E_value=0.0001; Accession=PF01535.11; Description=PPR repeat
  Pfam annotation: Domain name=PPR; Domain location=97-131; Score=21.3; E_value=0.0035; Accession=PF01535.11; Description=PPR repeat
  Pfam module annotation: Pfam domain module=PPR::PPR::PPR::PPR::PPR; Domain location=11-45::134-168::203-236::237-271::97-131
MNAKGVAPVNSTYGTLIDAYSKYGLKEEALAWLKTMQSQGMEPDEVTMGIVVLLYKRAGEFQKAQEFFRRWIRGAPFRLACETFARIIRQGRSLNTVTLNTMIHLYGNCGRLRQACLLFQKMGEFRGLLEADVVSYQTLLYAYSTRKMVREAEELIQEMDERDLEIDEFTQFALTRMYVESGMLEQSWLWFKRFHLAGNISSDCYSANIDAYGERGYTLAAKEVFIFCKELKKLTVLEFNVMIKAYGIGKCYDKAYQLFDSMKKFGVVANKCSYNSLIPILASADKPHIAKSYLKKMQEAGLG

SEQ ID NO: 142688 - protein, 104 aa, Glycine max
  Coding DNA Sequence Number=SeqID_51003
MDSGMGTSFDFYYEYPSRSVMGIGLLKPLWNYMNCFLLFLFISRTKLSFLPRMDEDDLIERELEDGIELAVEDDKITDWIWSNITDWGVKLHKRNEVHDFNEPF

SEQ ID NO: 142689 - protein, 54 aa, Glycine max
  Coding DNA Sequence Number=SeqID_51004
  Homolog annotation: Hit_ID=Q153F8; Match level="QueryCoverage=64%, HitCoverage=10%, E-value=3e-12, Identity=88%"; Hit description =Pectin acetylesterase
MRSRQNGLFINSCFGHCQSERQDTWFADNSPAIGKKAHQQNHCLRGLKHGKRKP

SEQ ID NO: 142690 - protein, 317 aa, Glycine max
  Coding DNA Sequence Number=SeqID_51005
MELSGKSILLMKEARVWVSSLSAMQCAKRPLASQAEEFSALSMILNPCPHPKRNPPGILLGSLLKLLGTGAREEIVAPGPHQTPGKTDRCCSETINDFLDIPVILANGEEYPAYSQYLHMHPDHQAIAAALCTPGFDDTRNDMDLDLGSFISLQISQIAQSSTSRLEFPVLITVLCGIPVINLAYIKKNCWNPTDPSITFPGARRTRTKATAPAPDAPLPSQPPSQAASHSQTSTSAPPDMHSQMLRSLYQGQQIIIQDLHRLSLHLKMDSPLMTPEAYIQQPSGAGDDAGVDEDLIADLATADWGAWADLGEDTRP

SEQ ID NO: 142691 - protein, 62 aa, Glycine max
  Coding DNA Sequence Number=SeqID_51006
MASCGSSTSSTSISQQQLAEIIGSLKEELRNEIILNLKEEMRNEIEEENKWTLEKMKQELKD

SEQ ID NO: 142692 - protein, 96 aa, Glycine max
  Coding DNA Sequence Number=SeqID_51007
MTPSYSPPTQATVRVHKDVVVANCEQEPTTKAWLLTMAMVDIGRDMSTMWGGQREGGALGFESGVRCLGAGRKIRYRKQWPNHRRQNNNETNAQSS

SEQ ID NO: 142693 - protein, 105 aa, Glycine max
  Coding DNA Sequence Number=SeqID_51008
MHSVTYNQDLVSPTLLAGWTELKEFCGLIGNHQVTLTHYGHSVFLLTSLKVALNQKLSLNDTPCTIKFLTQSLLRSSRFIHLNLEETECRIVYNHHRKTAKIGNG

SEQ ID NO: 142694 - protein, 130 aa, Glycine max
  Coding DNA Sequence Number=SeqID_51009
  Subcellular localization annotation: CTP_CleavageSite=56; ConfidenceScore=5.89e-01
MPTLSNSVSTPSRCPSALATKLRRTTPTPPPTTTTTHASKPPQIGRVTVDTARNLAASSRSAFRRYTMMKEIIKCHSNRHTRIKGRRRRCPHVSLPDRRTFAGVAKFEDALLLGWFLRSENPSTYATHFV

SEQ ID NO: 142695 - protein, 148 aa, Glycine max
  Coding DNA Sequence Number=SeqID_51010
  Subcellular localization annotation: CTP_CleavageSite=36; ConfidenceScore=5.33e-01
MEEPSKKRKGSSSTTTVAGQRRHDTSSDPPAPPNPSFSSPWSLNLFSSDEQRQSQGVPFEGTLVDDWKHIYSSHDAREMRMNHSLRSNDHLLLVLVSLPPLDTERMWMANEDLQAFVGDSFDAMESRITRLEDDTSFISRCFDPLADP

SEQ ID NO: 142696 - protein, 113 aa, Glycine max
  Coding DNA Sequence Number=SeqID_51011
  Subcellular localization annotation: CTP_CleavageSite=45; ConfidenceScore=5.05e-01
MPLFTGVRLCTTTLPRPQPHPQVGSLVQWTTACRGPTIVFHSFISSKGLSKELKDLKTFHELKGPMTRSRVKLLQEDMAKRIKDGLLFKDKEGENYKELNWSMLKMVEQHAWV

SEQ ID NO: 142697 - protein, 309 aa, Glycine max
  Coding DNA Sequence Number=SeqID_51012
MASSRAIKWLQICDHGTNFKNNQFLNIFLRVFVQHLLCQEKFIGQKLVLFYFLPLLHSYKKLFKRPTLGCKSFKRQSTWLNHWTQRSNVLWGSLQEVEFASSYNHWTQRSNVLWGSLQEVGLPLGVITEHKGGRSFGVHCKRWDCLLEVTPAIGVDAPVTSAGSVVVSSSTVTTCLLSVGVATASTPVMLEESKLRVVKEREVGKELEDELIMNKKKVIEQHEKGFNRVVRQAGFFAKDLDLGLSYLFKDMKDDVFLDEENITTDEEVLVEPHRGLPRTDLGFYELVKLTKADLGFGELLENQPKMRAS

SEQ ID NO: 142698 - protein, 322 aa, Glycine max
  Coding DNA Sequence Number=SeqID_51013
  Gene Ontology: Mol. function=nucleic acid binding; Cellular component= intracellular; Biological process=regulation of transcription
  Homolog annotation: Hit_ID=A7PNR8; Match level="QueryCoverage=93%, HitCoverage=77%, E-value=3e-54, Identity=45%"; Hit description =Chromosome chr8 scaffold_23, whole genome shotgun sequence
  Pfam annotation: Domain name=zf-C2H2; Domain location=56-78; Score =21.2; E_value=0.0039; Accession=PF00096.17; Description=Zinc finger, C2H2 type
MEEGHCWIKTKRKYSINSSIDSPTNYPSSYDDYSWEEQAFAKDAAWSGCIWPPRSYSCRFCRKEFRSAQALGGHMNVHRRDRARLKQPYSPDQNEILSDGLEKTTQQQSSVQISFTSLGYLYPSSLDGLAPNTSPNSDPYSHAPASPSKFLASSINKRGREKPQIPLYKGCLESSPDLPSKSMSNLTEDFRFCSRRLDPEAGVEKMLKGLDSGCRSTERDDAKTDVAVILNLFMNQPHPPVKFETKEKYTSFKKGKADASSIPFFPKSCSADRHHMQSQMYEFSPSSIEELDLELRLGYRSKDPTKNCMEYCEPVFLYSVPH

SEQ ID NO: 142699 - protein, 94 aa, Glycine max
  Coding DNA Sequence Number=SeqID_51014
  Subcellular localization annotation: CTP_CleavageSite=25; ConfidenceScore=5.21e-01
MAKAKPACPLTMAILPPTTKSQTSDVSHKFGLSNEVAIFTSTSYESFEKSSLGEDCGVCADHLKCATENWEVVRRERKSLWWHRSILDNEDQKG

SEQ ID NO: 142700 - protein, 188 aa, Glycine max
  Coding DNA Sequence Number=SeqID_51015
  Homolog annotation: Hit_ID=A7R0D7; Match level="QueryCoverage=36%, HitCoverage=12%, E-value=7e-09, Identity=31%"; Hit description =Chromosome chr6 scaffold_305, whole genome shotgun sequence
VRVLPLNISLRVLEFEDEAYNLKVISLISSCAVSEIVAVPPRRSQPHNLKGGSCVAHTPACPAPPVKVFMILRVVNLDVVGDRHYFPYTVDGIPLLAIDIRTRVCEHDGSTQFDQSIVGMQKQNLDVNAITFTGVVSASTHVGPIDKVQYYFNVMINDHQIKPTKKHYCNIELGKLGAEKIISLEPQN

SEQ ID NO: 142701 - protein, 193 aa, Glycine max
  Coding DNA Sequence Number=SeqID_51016
MVSRRLGNIDFYINNNKLGKRSLDRSHKPSRTTDSDRDATVGVLDENDGVASDELLVVDKLAPAGAEEVATRCAVIDVAEVPLDAADVGDREELDRRIGTEVQRREARVGAEVQHGEAVVVVGIGGSEDLRERNDTVVHAVLIVIVISNLLVRRNLAKTSSEKGSTGDEGERADEKAEVMRGRGTLHVTLGKK

SEQ ID NO: 142702 - protein, 421 aa, Glycine max
  Coding DNA Sequence Number=SeqID_51017
  Pfam annotation: Domain name=MAP7; Domain location=2-167; Score= -80.3; E_value=0.059; Accession=PF05672.2; Description=MAP7 (E-MAP -115) family
MSHHSSSVNGKGTIHKDPLSRILDELSSLKLWKEKQERKEKGKKRVEEISQDERKKIREEERRKIMKEMKREKHASYSSHNSCKSLSEELRDYYEGRHRSHLRPHSHRREKERKPQEANIKLSYFHGKDNVEANLDWEIRVEQQLKKKSTSKSYGSHSYPKKDQGQGILGVTPSKPEDDKGKTIKKQALKASMQEKTSFINQDEATTSPSSSESEKAKGEESSEEIYPQEEGQPLVVKDKCKEVSVSSKSLAKKETHFTIKTNIKETFPLRQPPHFLFCKKALASIATPLGLEFIPQVKKLLDEGLVRKSLNPCALLVPKIGIITHQVPKIGGMMKVLSGATLFCKITRTPNISMVCVHRDPLGSDQGVPMNPKRIKVIPEWPTPPSVEGRSPEYEEPWDLRSNPFQGGGNDAILSRKGIR

SEQ ID NO: 142703 - protein, 125 aa, Glycine max
  Coding DNA Sequence Number=SeqID_51018
  Homolog annotation: Hit_ID=A7NZL9; Match level="QueryCoverage=27%, HitCoverage=12%, E-value=8e-07, Identity=64%"; Hit description =Chromosome chr6 scaffold_3, whole genome shotgun sequence
MEFIQSHVEPWMKDQRAQLPGLKEKVSDEVAVGVASRAQEADPRRVPVPLEPLSRPQGGIRLRFTGPSLLYGALQVPVMWEDDAGSIDINGTLFFLQQAHWHWPAEHTINCRRLISPKLIRTLSS

SEQ ID NO: 142704 - protein, 72 aa, Glycine max
  Coding DNA Sequence Number=SeqID_51019
MVVLTTCESCFFVMKSATVKAKPEELAKYVVSVQRKNGEKNGIAEKATEEKKKEAKQRECLSNESKSFYLNR

SEQ ID NO: 142705 - protein, 348 aa, Glycine max
  Coding DNA Sequence Number=SeqID_51020
MVVNEPTYNNFNNRGDIGGDNSDSSSDGGGSGYNYIGGGCDDDDIDSGASNSDNDCDVSNNSGDNNDGSGVGGRGDAAFQRHSFFRAYSQWYWRDDMEIASATGEITDIASGTSEIIRVYEENDDVIFEGSKKAIQIKLSGKYVALQICDDEDVETMLESFQQQNQMSVLELYIEKDVAGGSMFHSANSLTSCGNNLSNNEAQPPRNVSNLHGDEDDDDDDDDYLVSNSYVEESLDEDDSVDGISDTDDEVTDMIQPVRIVHPTECVQGIQNPFWNDALHYNNINWSHPDEEDICGLEMPSSFNVGQELYVGMDFDTKDAINSEFAYKVSYKKAWLAKQKATALEYGD

SEQ ID NO: 142706 - protein, 130 aa, Glycine max
  Coding DNA Sequence Number=SeqID_51021
MAISSVERHLKDTLRVDDEEGLEGGGDGGGVNGENNGEGTKRDYNSWSIVGHKVRNPIQDMHRYLHRYDGGVGVVGDLGEVKVVSFLALGEAINGLLKAVGDGLVSVVVWHGKGMSDQLLDLRTEARRRK

SEQ ID NO: 142707 - protein, 179 aa, Glycine max
  Coding DNA Sequence Number=SeqID_51022
MFGVVASGHDVVKELLALAELHDEMHDIVVLVGILQSHDVQMLWQVMHDLHLPPDVVNVYRRSKLLLRDRLACQLLPRLLVRTEVGYPKLAAPQLVVGLDLAVRWGLQNDELRPIHGDVKTVIDRKGFSLFGGYEKSLGGDKTVNEAVSQTFVGCMGETKEISALVDFLCLPAASYITG

SEQ ID NO: 142708 - protein, 52 aa, Glycine max
  Coding DNA Sequence Number=SeqID_51023
  Homolog annotation: Hit_ID=Q9FLE9; Match level="QueryCoverage=92%, HitCoverage=52%, E-value=7e-07, Identity=56%"; Hit description=DNA -binding protein-like
QSASKILQETCCYIRKLQEEVEQLSERLSELMDSVDISDIDRRTLQNLLQQY

SEQ ID NO: 142709 - protein, 191 aa, Glycine max
  Coding DNA Sequence Number=SeqID_51024
  Gene Ontology: Mol. function=kinase activity
  Homolog annotation: Hit_ID=Q7XIR9; Match level="QueryCoverage=82%, HitCoverage=33%, E-value=7e-15, Identity=31%"; Hit description =Putative RING3 protein
  Pfam annotation: Domain name=Bromodomain; Domain location=47-137; Score=25.8; E_value=9.2e-06; Accession=PF00439.16; Description =Bromodomain
MATWVSTKNPSGVCESKKKKEDTVCVECKNREKKKRKVEHVMTMDRCKKMQCWAMLKRLMVGRDAWALQKDVLHPKILYVLDKSEAMKKPKGLEDIESKLKNSDYSEAYEFVDDVRLVLSYALQYPPRSEVHRTATRIPEGFEVNWKTMKEKWMREEEETNKICKRELHVCPNERSQVCNHLTKRSNIFMC

SEQ ID NO: 142710 - protein, 113 aa, Glycine max
  Coding DNA Sequence Number=SeqID_51025
MEMYDASIFINTTSRTAVGDLAPINMEIEATCRHNNAARKRREQEAQRRSQTSPPPSPQSYIQMEEEHARQMTLEDYSSTATPQFFTSIARSEVQAANISYPHSLITLPRSTK

SEQ ID NO: 142711 - protein, 71 aa, Glycine max
  Coding DNA Sequence Number=SeqID_51026
MADTYKKARVMNQETRKTFVKKYTELKRKVKASSTCKESSSRPASKSSSKVINIDAPSDGESNDEGSDEDD

SEQ ID NO: 142712 - protein, 35 aa, Glycine max
  Coding DNA Sequence Number=SeqID_51027
MAIYKKSHFGAGEACPDARGNRGSGTGKKQKDIDI

SEQ ID NO: 142713 - protein, 37 aa, Glycine max
  Coding DNA Sequence Number=SeqID_51028
MSEIEEMQEQTKVNIDAMKEQMTIMMEAMMSMRKMME

SEQ ID NO: 142714 - protein, 51 aa, Glycine max
  Coding DNA Sequence Number=SeqID_51029
MHHFMNLVAWAAQMNMRHLNHLAKKDLVIAIPKLKFEKNKLCEACQKENQV

SEQ ID NO: 142715 - protein, 290 aa, Glycine max
  Coding DNA Sequence Number=SeqID_51030
MVSNPQEHKRKQKLPREIKAIKNVTVPKYLDLEWFSQQGFTFPNMLEAQGLSQLMQMKRPFYPELVKVFYTSARANLEGILFSIVNGVDMVIDVVSWKEVACMYMGGVCKFDEMPDGYNKMQTYRRMLLDPTRNMRNRLGVGGLNAEDSMLVYLITYILTPRSSNHAQFNVDVSNEIVDFTKASSEIIERHLKKLGMRFVDHEWIMIEELTTGNFDQMEENVEVEAPQEPAHQWSPFESLMIQKMGVMLHLHQENSTKFHSSLENIIAWLENIETRLTLGNLLNPDEDEA

SEQ ID NO: 142716 - protein, 97 aa, Glycine max
  Coding DNA Sequence Number=SeqID_51031
MDQLKHLSIPSGMLRFSNHASYPRLGHPTRKISMQQGQVDILIVRFPDPNYGVKMTKFREDPTVNEGWAAFLPRQLHVAFSRSFIKRLPPEASSWLL

SEQ ID NO: 142717 - protein, 235 aa, Glycine max
  Coding DNA Sequence Number=SeqID_51032
  Homolog annotation: Hit_ID=A5BEV8; Match level="QueryCoverage=81%, HitCoverage=25%, E-value=1e-12, Identity=27%"; Hit description =Putative uncharacterized protein
MDCLKKSVRYPRGPWAPGASPWTRARLPTPNVFKVTLYKRLLGMISRYALNQIAAEFEHIHYAGKNPSRCGCVMRNAHGLSCSCELSRYVVGIIPLETIHMFWWRLSFSGQGLSEPEEIAYPDLNSMCPPPEKSNVVHHHQTKQFQEGLCRYILDQFHLCFHDSIENIVNVKADGNYGYRAITALLGIGEDSWYLVRNHLLKELSKWSYEYINILGGIDKFEELKRFLFVDGLSM

SEQ ID NO: 142718 - protein, 39 aa, Glycine max
  Coding DNA Sequence Number=SeqID_51033
MNLKSEGGEEREFFRGCKIEELQEIQKVLKGGSELGSTT

SEQ ID NO: 142719 - protein, 132 aa, Glycine max
  Coding DNA Sequence Number=SeqID_51034
MVAWPGTKSSLHKEDEGPTTQVPQHMENESSEATIPEPFDIGEEAEETQVGQVAATTPERSLEATSEPSAPVVNLPSPQPTAEPSTPLLQMLEDPTTPVLAVDTSPPATPVLQLIDEEDGQTQDIQDQSQEF

SEQ ID NO: 142720 - protein, 99 aa, Glycine max
  Coding DNA Sequence Number=SeqID_51035
MCAPYSIQYTSLHSPNLKLILAKHKNPKNLKLQSKSSTLELRHEKEKKNQGTYLDETQLNARVCPLSETCRLEKLQLSLSLALTSLAKMMHLKYREACA

SEQ ID NO: 142721 - protein, 131 aa, Glycine max
  Coding DNA Sequence Number=SeqID_51036
MEWRRKRERRRHFKEKMSLEEAHHHRRSWIRAWRKKEMNEGRGREEHEILCSKRALKSEGGEGDTQVGSSRVPHGGTQPINKDEVVDREELEGYNGVDDNTVSDGLDGNSWWLGFMVVALLGGRVPLSTQI

SEQ ID NO: 142722 - protein, 204 aa, Glycine max
  Coding DNA Sequence Number=SeqID_51037
MYVASENGRKIYLVVGWENEGKYKQYKDKLVHKSTGTRKYQDKKNVTIIKTPYNERQRYQHKQKARRIEVIVIDRDLALMNALEVVFPYSTNLLCEFDISKNVKAKCKILVTKAEGWEIVMDACHINGSIPLSSLHMRWKMISISGTNGTCDSWGDLTLTNEEQVEEMNTMIGGLETSSVARKDVSDKKIPYMDEFSICCNSSS

SEQ ID NO: 142723 - protein, 308 aa, Glycine max
  Coding DNA Sequence Number=SeqID_51038
  Homolog annotation: Hit_ID=A7UQU7; Match level="QueryCoverage=40%, HitCoverage=21%, E-value=8e-17, Identity=39%"; Hit description=IMP dehydrogenase/GMP reductase, putative
  Pfam annotation: Domain name=DUF1723; Domain location=74-123; Score =43.7; E_value=6.5e-10; Accession=PF08330.1; Description=Protein of unknown function (DUF1723)
MQIMGFPSGPYDTSILRDFKNHIALRVWNGEERPELKLSSHGRKMAKFGRPTPEIEGLVVASGLSPLIACSLDTGNWGLMFAFVERWHKETSNLYLPVGEVTITLDDVALLLHLPTVGHSIASSYFMSKTLSICWWNYSRSALQRRELRRFCVMALTFNYREWGLRLGHYCTCAHCWIYEHFSSVGSDVPAEDYDERRPCACRWTSGKALPVSTYRRRLDRLTPDVSILPHPVVSSLSVEESDDRWMQFGEHIAPVGQLCAVSGHCSPDYMDWFYMISHPFMSLTQLGDPPRVPSVQQYEEFVEANVY

SEQ ID NO: 142724 - protein, 101 aa, Glycine max
  Coding DNA Sequence Number=SeqID_51039
MDWGKSMERRESQEWGQRDKGGEYHFFCSQEWDAEDARFDDVIAEDRTNQSELDALENKKDDFIGDFSKEVSLAIRELLKEVFSKKLLKEVFSRKLLKEAT

SEQ ID NO: 142725 - protein, 96 aa, Glycine max
  Coding DNA Sequence Number=SeqID_51040
MEGGTVCRAVVLNKLNRRCRVLAKSIAGGSDDDGGGCIEEGNHGIRVPHKASKRIQEKVGAETEGMAPAKGDVLWHGRSRSRGSHASHGPNKSIIR

SEQ ID NO: 142726 - protein, 363 aa, Glycine max
  Coding DNA Sequence Number=SeqID_51041
  Gene Ontology: Mol. function=metal ion binding; Cellular component =nucleus; Biological process=regulation of transcription, DNA -dependent
  Homolog annotation: Hit_ID=A7PNL3; Match level="QueryCoverage=76%, HitCoverage=74%, E-value=3e-47, Identity=44%"; Hit description =Chromosome chr8 scaffold_23, whole genome shotgun sequence
  Pfam annotation: Domain name=zf-Dof; Domain location=77-139; Score =133.3; E_value=6.9e-37; Accession=PF02701.6; Description=Dof domain, zinc finger
  Subcellular localization annotation: CTP_CleavageSite=86; ConfidenceScore=5.04e-01
MVYTSIPSYIDPANWQQQQPNHQQQGNNTAASSHLILPPPIQPPPPPPSQPHGLSGSTTAGSIRPGSMADRARMANIQEAPQKCPRCESTNTKFCYFNNYSLSQPRHFCKACRRYWTRGGTLRNVPVGGGCRRNKRSRGSSSSNTRSPANSDRQTASAGSASTTSGSSSADLVASLGGGTGVPPSLRFMAPLHQLGDHHHLGGGGGEIGLSYGLNYGAISGPMGGIGDLNFHIGGTLSGGGSMLSGLDQWRVPQTHQFPFLSGLEATSSHGLYPFEGASGSDGYGGTPIKVSTSGIISQLASVKMEDNRHHHHQELGLPRQFLGVNNNPNTNEQYWSGGGGATSTWTDLSAFSSSSTTSNNAL

SEQ ID NO: 142727 - protein, 672 aa, Glycine max
  Coding DNA Sequence Number=SeqID_51042
  Gene Ontology: Mol. function=ubiquitin-protein ligase activity; Cellular component=ubiquitin ligase complex; Biological process =protein ubiquitination
  Homolog annotation: Hit_ID=A7NZ27; Match level="QueryCoverage=93%, HitCoverage=90%, E-value=1e-140, Identity=44%"; Hit description =Chromosome chr6 scaffold_3, whole genome shotgun sequence
  Pfam annotation: Domain name=Arm; Domain location=449-483; Score =23.4; E_value=0.00082; Accession=PF00514.14; Description =Armadillobeta-catenin-like repeat
  Pfam annotation: Domain name=Arm; Domain location=484-524; Score =20.4; E_value=0.0068; Accession=PF00514.14; Description =Armadillobeta-catenin-like repeat
  Pfam annotation: Domain name=Arm; Domain location=525-565; Score =29.1; E_value=1.7e-05; Accession=PF00514.14; Description =Armadillobeta-catenin-like repeat
  Pfam annotation: Domain name=Arm; Domain location=566-606; Score =12.9; E_value=0.25; Accession=PF00514.14; Description=Armadillobeta -catenin-like repeat
  Pfam annotation: Domain name=Arm; Domain location=607-644; Score=2.9; E_value=4.7; Accession=PF00514.14; Description=Armadillobeta-catenin -like repeat
  Pfam annotation: Domain name=U-box; Domain location=260-348; Score =66.8; E_value=7.2e-17; Accession=PF04564.6; Description=U-box domain
  Pfam module annotation: Pfam domain module=Arm::Arm::Arm::Arm::Arm::U- box; Domain location=449-483::484-524::525-565::566-606::607-644::260- 348
MAEPEAESFRMLRNLTRIVIQISTLSSAASFVPILKPQCCDLARRIRFLAALFQELHDDIVSSRAVHFLALEDALFKAMELLRFATRASQVFTILDREQVMFGFTDVAVRFEHALSMISFGELDVSEEIKEQVALVITQFRRAKAQFDPPGFQLYEHLLFVYNQSYDVNTETAELRVICEKLQFLNVDDIKQESLALQKMVVDKGGYSQKNIHDMSLVVLKKIQDFLVMESGNNIVSPSEDFSHHTDEPYLKLCPQSLVIPDEFRCPISLELMKDPVIICTGQDPMAEKSVTFGVVMVTYDRSCIKKWLEAGHRTCPMTQQILSTSILIPNHALYGLISSWCEANGVEPPKRSGNLWLCKTTSDGSSEFIDLDILVSKLSSNDIEELRCAVEIGIWKDEGASPGAAVKLCLGDLLVMGSNPETASLHMQGSKYDGTYNWWPGELHCGFNAETAGAIPHLVDLLYAPDAGTQEHVVTALLNLSINVDNKERIMASEAVPGILHVLENGSMEAQENAAATFFSLSGVDENRVAIGASGAIPALVTLFCEGSQRGKVDAAKALFNLCLSQGNKGRAIRAGIVPKLIEMLTEPDGDMRDEAMTIMAVVANHSDGQAAIGSMNVVSTLVELVSNRSPGNKENATSEMVQKGQAESFPASRVDRKPLRLYLENCQLDF

SEQ ID NO: 142728 - protein, 143 aa, Glycine max
  Coding DNA Sequence Number=SeqID_51043
MSHDYHAKNRLLDEVVGDFNDHKDEILMDNDDNNINDNDDNDIQFLFQPTTTENVYRPYPNCTDVGDNQVVENPNYRHFLDQQQQSDSQDENDFKIESRTIQESRERFKRKFHQEDSRFKNNQDQDSRLKDSRIKRRLNQDKY

SEQ ID NO: 142729 - protein, 187 aa, Glycine max
  Coding DNA Sequence Number=SeqID_51044
  Subcellular localization annotation: CTP_CleavageSite=52; ConfidenceScore=5.33e-01
MASGASGTPDCFWRKQPSSPGRAGRQPPPFFPIKRQKGTVLRVPDSPWLCISAILGEKMISVKKIQAEVFLRSSPFFIRSSSVLRYSTGAKVDVSLSELNALSVCHLLSEASTRLADRRNLEGNLSRRHVLSASSAHSASHLSPSRLSASLALSENSLTRAKRDVKICEFLSDCEIPRGGGDIPTSL

SEQ ID NO: 142730 - protein, 131 aa, Glycine max
  Coding DNA Sequence Number=SeqID_51045
MGARDKSIMHKGNKNPDLVNDPAHAHSGPMLVQMMDPEKEAGLGRTRVAGAGGKGEVEGVDVEGAKVRGVEVDGASDPLALDLRVPQKVTEGSSRDSKVRESDVTPRALHKAIIRAGISSLEESCCAIREI

SEQ ID NO: 142731 - protein, 69 aa, Glycine max
  Coding DNA Sequence Number=SeqID_51046
MSDIEQVQEQMKVDMEAMKEWMTTIMEAMVSMRKMMEVNAATTVALVLLLRGTRFTRSGSIKIVIQSQM

SEQ ID NO: 142732 - protein, 147 aa, Glycine max
  Coding DNA Sequence Number=SeqID_51047
MKDRVWEENWSVRGSLASRENPFIALTPSNGHVEELVVSDLINREGVFGGLGMGSFGKILRILRRAAGHPRLRTYDRLRRLWGQHRRRPNRVLRRLSATDRRRIVNNSKTATRQPRRRTKEGLRRPWGQHRRRHNRGSTTVVSKRPS

SEQ ID NO: 142733 - protein, 169 aa, Glycine max
  Coding DNA Sequence Number=SeqID_51048
MNQHIAAIPSSERRIEGINRHRNCSVKKFELEFGSESASQRPRPRMVVGTIEEWCDLDGGGTVARMNKERTSRISRGIRRWRWCYTRWHSGGSKRNGSLENSSHQREVTNQIQLHCLPNKDTKNSHHTMSMSIGTWTNHKAYPAFVKDPFDGSFGKANLNFKIFELCFQ

SEQ ID NO: 142734 - protein, 288 aa, Glycine max
  Coding DNA Sequence Number=SeqID_51049
MEANREAENDIILGEKNGRHDIGGVKTYSGGKDVIMKARKVYMELLWFGSLEGSSNFERLGANKIDDARMKLGFDGAFAVDTDGCGDTNEKWRMKAYYGFPVRSRRKKAWNLLRSLASDASLPWSVNGAIDLEERLDRALVTHDWRALSGLKEFKFDKWWLKGSCVELMERIGQCRNTLNVGENWRLAVGRIMRIAILVIRRSKNSVEKLFQATPISMELVLDTILRCVNEEGIIGVDSVCRRTREIQGVKESVTIENILNSYRLASGQLINYQKSDIEFSRTKKTRC

SEQ ID NO: 142735 - protein, 293 aa, Glycine max
  Coding DNA Sequence Number=SeqID_51050
  Homolog annotation: Hit_ID=Q9C997; Match level="QueryCoverage=94%, HitCoverage=73%, E-value=6e-51, Identity=46%"; Hit description =Putative uncharacterized protein F23N20.10
MKCVPSTVFHLLLFIFPLVLSVHLISALSPTGSAKHSIKFILGGQNLGPWKNGVTQVAQAARPRTKGTLVLAANRTNRPDILHGFRRYQGGWDIANRHYWADKFHGEAVDTLHYVVNQSDYTVQTLRNVTEYLALAKTIAVAEMFLPSNIMDDIDKLNASSFDYDVSNDASTGSNWVNAICDTCMAMGEWVENPHAESALSNILPCVDQRTTNKTLFQSKQVVTNIVSIVNRFIYDTADASPAQGSMNYYNQSGPAMPPLCYPFDSQFRERQCTPQEVSSANASLVYFFYVHF

SEQ ID NO: 142736 - protein, 227 aa, Glycine max
  Coding DNA Sequence Number=SeqID_51051
  Gene Ontology: Mol. function=nucleic acid binding; Biological process= DNA integration
  Homolog annotation: Hit_ID=A5C693; Match level="QueryCoverage=46%, HitCoverage=48%, E-value=2e-17, Identity=41%"; Hit description =Putative uncharacterized protein
MRIQGTNRLRILCPNTLEGTSFVAQVEGTSTWVVILRTREGTSLVDQFKWWIHPLGYSKRTREGTSLVDLWLVKDFTRLKEISRTIGCLGTECRHGLLPNQYRSNLKSFQDHDEDQANLCLMKKSHENNKEGSVRKKWYIDSGCSKHMTGDVSKFTTISPKKSGHVTYGDNNKGKIIGVGKIDLDFNNTATIGMLMDWQVHQFLKSSKVKMEVRVSNPQELCLYLGR

SEQ ID NO: 142737 - protein, 38 aa, Glycine max
  Coding DNA Sequence Number=SeqID_51052
MEEELAAQLAQKGMKGKQNWAHEFVPNYCQYGNIRATI

SEQ ID NO: 142738 - protein, 256 aa, Glycine max
  Coding DNA Sequence Number=SeqID_51053
MPYNTSHIQLDARVVPRESTTHTQTASKASLIDTMRCNINHMQLIQQLPGRNNLVGIHQRQPLSHKQLLVVEGGGLIMSSLDKGIDYAFICRRVPCIIQALKREPIHVPLNCQLGRVVFVAMPLTQPVPLAVPEALLLSPSQLCIMINDEEFEEGSGKRDKENGVYLRGRGGGSWAWLKGRVIGCFERKREMKGKGKGREKKDVRREEGERCLEGRVKGGEKNGRRKGKGWRVTHTSLPGIVGDMTRLGTNLHGGV

SEQ ID NO: 142739 - protein, 104 aa, Glycine max
  Coding DNA Sequence Number=SeqID_51054
MQSLQGLGLPSFMSMQEFDAQEPAPEEPTTAAEGEDELTPLEPFYFDADAHMAQEEGTSRFQIPEPSPTPAPEETQPSTPVTEPEQPIQDSSAAPTLDLNEDQP

SEQ ID NO: 142740 - protein, 119 aa, Glycine max
  Coding DNA Sequence Number=SeqID_51055
MTVRFGFMTPFLISAILTSLFRCDSNVHVPIFEKLHVCENQLIEAVHDIQFIWLNFSVKKRLSHEVLKVTVELSVTEESGRASISRLRAKREISALSAAVVFSQTQRTTSAKLKSTYAC

SEQ ID NO: 142741 - protein, 176 aa, Glycine max
  Coding DNA Sequence Number=SeqID_51056
MMMEAMMSMRKMMEDNTATVVAVSTATEMDPIHPASFNQVNRPISYVVGQGGEVEKNACGPCHVQVQSKNSFPPYGFPPNYTPPTIVYAFGETHEVPQYHTLVVFGVYPGYTTEGEAFSGIPVLSALRISQCRLLSQPLHFVRGEESSTLLEKERIEHMEERLRAIEGGENYAFAE

SEQ ID NO: 142742 - protein, 61 aa, Glycine max
  Coding DNA Sequence Number=SeqID_51057
  Homolog annotation: Hit_ID=Q2HV31; Match level="QueryCoverage=63%, HitCoverage=6%, E-value=1e-10, Identity=79%"; Hit description =Prefoldin
MNNKAKQLEQALSQKAIGYEAWKQKLEHERKEYTTIVKEEKQRAQRPHMPKHKVTMKTRRQ

SEQ ID NO: 142743 - protein, 61 aa, Glycine max
  Coding DNA Sequence Number=SeqID_51058
MVVVVVFIGDKIGMDMVRFSRARQDKVGVARCNKKGGGSDKERGRVWGFDEWAKEIFQKTW

SEQ ID NO: 142744 - protein, 22 aa, Glycine max
  Coding DNA Sequence Number=SeqID_51059
MRRVGFTEKGRGSNAKATTRRN

SEQ ID NO: 142745 - protein, 199 aa, Glycine max
  Coding DNA Sequence Number=SeqID_51060
  Gene Ontology: Mol. function=peptidyl-prolyl cis-trans isomerase activity; Cellular component=chloroplast thylakoid membrane; Biological process=protein folding
  Homolog annotation: Hit_ID=A7QT90; Match level="QueryCoverage=83%, HitCoverage=50%, E-value=2e-46, Identity=56%"; Hit description =Peptidyl-prolyl cis-trans isomerase
MASIMSLSLSYVSLPKSQFSISGIFAGTLCNIPLTGISLAAEFADMPALRGKDYGKTKMRYPDYTETESGLQYKDLRPGNGPKPKMGETVVVDWDGYTRGYYGRIFEAQNKTKGGSFEGDDKNFVKFKIGYNEIWHAFSAKPQGVLCPLTVGLNPAWALSSLVHKMLHVIPAFEEAVSGLALGALEGVSSILLEIFDAF

SEQ ID NO: 142746 - protein, 212 aa, Glycine max
  Coding DNA Sequence Number=SeqID_51061
  Homolog annotation: Hit_ID=A7UQU7; Match level="QueryCoverage=43%, HitCoverage=16%, E-value=8e-10, Identity=39%"; Hit description=IMP dehydrogenase/GMP reductase, putative
MICRSWLEHEDATDVPERRRPTASARRQRVHQMIADARDMTDDVPDVAAEAPEMRADVECADRAEGSDADDAAEGFPGGPRDPSVLTSFADHVAHAVWSGQERPDLKLVSHGRKVTLIGRPVLEIEGLVGATGLSPLIDCSVTIGDPGLISAFVERWHGETSTFHLPFPCSFYGGGQIFADRVVGGVCRGGQSGDITHTWGICTTKMGSRHL

SEQ ID NO: 142747 - protein, 1305 aa, Glycine max
  Coding DNA Sequence Number=SeqID_51062
  Gene Ontology: Mol. function=binding
  Homolog annotation: Hit_ID=A7PAV4; Match level="QueryCoverage=99%, HitCoverage=99%, E-value=0.0, Identity=52%"; Hit description =Chromosome chr14 scaffold_9, whole genome shotgun sequence
  Pfam annotation: Domain name=HEAT; Domain location=1035-1071; Score =9.1; E_value=1.2; Accession=PF02985.13; Description=HEAT repeat
  Pfam annotation: Domain name=HEAT; Domain location=1074-1110; Score =19.6; E_value=0.012; Accession=PF02985.13; Description=HEAT repeat
  Pfam annotation: Domain name=HEAT; Domain location=616-653; Score =5.1; E_value=4.7; Accession=PF02985.13; Description=HEAT repeat
  Pfam annotation: Domain name=HEAT; Domain location=675-711; Score =7.5; E_value=2; Accession=PF02985.13; Description=HEAT repeat
  Pfam annotation: Domain name=HEAT; Domain location=714-750; Score =22.5; E_value=0.0016; Accession=PF02985.13; Description=HEAT repeat
  Pfam annotation: Domain name=LisH; Domain location=152-178; Score =15.1; E_value=0.029; Accession=PF08513.2; Description=LisH
  Pfam annotation: Domain name=LisH; Domain location=6-32; Score=1.7; E_ value=1.5; Accession=PF08513.2; Description=LisH
  Pfam module annotation: Pfam domain module=HEAT::HEAT::HEAT::HEAT::HEA T::LisH::LisH; Domain location=1035-1071::1074-1110::616-653::675 -711::714-750::152-178::6-32
MDVERSSLCNCVVNFLLEENYLLTAFELLHELLDDGRDDQAIRLKQFFSDPNLFPPDLISRLNSLRVADPQTLLEEKEAAEEKLAISDYELRLAQEDISKLKSELQKKAENHNELKAEKISGDVSVNDGQQIQQKKNSSFTDLGPLKETERRDLNCAVKEYLLIAGYRLTAMTFYEEVTDQNLDSWHNTPASVPDALRHYYYQYLSSTSEAAEHVSHCILPKLVLRLYSRNKGAEKLFDYMVLLHMTLLYGLRVLILMISLSLETIIQPSKLLFHRHFSLSHGFYMLFVTNQLSQKLLGLQWHIDIMAMLTSSLVFKLNWSVYVGFRTTEQEKFSLLRENETLLNANKRLNQEKENLLKNKDMADAQIVTLTKSLDAMQKDLKDKENLVQVLKQSLEHQRKELNDCRAEITSLKVHIEGSHLGNNLVISDVNNVQSESLEKYKEEMKKLQMENEWLKEKNIRSPEPGNFVGSEKENLQINDKVIEIHEDQGAISDPIDVALGAVHNEDAQSPVVQTLAQYADKHEDTLPELFNPANTNNAFKNIKNVSEQNVGQQAEDSSLLVKSDSVNDGAISERTASSLYSWLEEILKHYYLLGLGTIQILADALPKIVPYVLINHREELLPLIMCAIERHPDSSTRDSLTHTLFNLIKRPDEQQRRIIMDACVNLAKNVGEMRTETELLPQCWEQISHMYEERRLLVAQSCGELADFVRLEIRNSLILSIVQQLIEDSASVVREAAARNLAMLLPLFPNMDKYFKVEDMMFQLVCDPSGVVVETTLKELVPAVIKWGNKLDHVLRVLLSHIVNSALRCPPLSGVEGSIESNLRVLGERERWNIDILLRMLAELLSWVHQKVIETCPFSSTTETTQAVLSTALLELYARGQVEWGAFEWMHVECFPNLIQLACLLPQKEDNLRSRISKFLLSVSESFGDSYVTCIMLPVFLIAVGDDADLTFFPTSIHSRIKGLRPRSAVADRLSTMCVLPLLLAGVLSAPGKHEQLAEYLRKLLLEENSMQNQSTKHTPEIINAIRFICIYEENHGMIFNILWEMVVSSNASMKINAAKLLKVIVPHIDAKVASTHVLPALVTLGSDQNLTVKYGSIDAFGAVAQHFKNEMIVDKIRVQMDAFLEDGSHEATIAVIRALVVAISQLTAMPNSSSDLMRRRERANAFCEAIRALDATDLPANSVRDLFLPAIQNLLKDLDALDPAHKEALEIIMKERSGGTFESFSKVMGAHIGLPSSVTSFFGESGLLGKKETTEPPSEATVSPKAAAPSPAEDTRFKRIMLGNFSEMLRGKAKAPEEGQNQ

SEQ ID NO: 142748 - protein, 103 aa, Glycine max
  Coding DNA Sequence Number=SeqID_51063
  Gene Ontology: Mol. function=lipid binding; Cellular component =cellular_component; Biological process=lipid transport
  Homolog annotation: Hit_ID=Q43681; Match level="QueryCoverage=71%, HitCoverage=74%, E-value=7e-27, Identity=67%"; Hit description =Probable non-specific lipid-transfer protein AKCS9 precursor
  Pfam annotation: Domain name=Tryp_alpha_amyl; Domain location=38-103; Score=53.0; E_value=1.1e-12; Accession=PF00234.13; Description =Protease inhibitorseed storageLTP f
MDVYDTFLVTSTTTWVAVVVVALLLLAEVGPMAEAVTCTPTELSPCLPAITSGAKPSNACCTKLKQQKPCLCGYLKNASLKQYVNSPNARKTVASCGIPFPTC

SEQ ID NO: 142749 - protein, 450 aa, Glycine max
  Coding DNA Sequence Number=SeqID_51064
  Gene Ontology: Mol. function=RNA binding; Cellular component =ribonucleoprotein complex; Biological process=regulation of translation
  Homolog annotation: Hit_ID=A7PAT8; Match level="QueryCoverage=84%, HitCoverage=54%, E-value=2e-71, Identity=42%"; Hit description =Chromosome chr14 scaffold_9, whole genome shotgun sequence
  Pfam annotation: Domain name=CRS1_YhbY; Domain location=199-284; Score=58.0; E_value=3.1e-14; Accession=PF01985.12; Description=CRS1 YhbY domain
MEIPKSKSLQITCPFGGKILRRNEDMKRTVAATIMLFLSFHPSLSTNSYSYSRFHISSSLPPNSNNGHNHQHTSTSPSDVPIKAPIPPWMKKGPLLLQPHELFHLSNPKSKKFKPEKHELSDKALMGKEVRGKRAMKKIVERVEKLHKTQNSYETRVGSLNVENFGGYLKNLKENDEDEKFGFVKVKREKVVTAAELTLDKVLLRKLRNEAERMRTWIKVKKARVTQDVVDQIKRTWRRNELAMTKFDIPLCRNMDRAREIVEVLTKTGGLVVLSKKDFLVVYRGCNHQLTTKGSPSLRTNRFEMNRVELATKGDICWVVSNNSSSKMLSWNADHKDSISTGIQDVNCQLPLPVDADLLPVEVPRFQPPFRLCPPHSSAKQTAYELTYFRKLAQPLPTHFVLGRNKGLKGLAAAILKLWEKSLIAKIAIKYGIPNIDNEMMATELKASLI

SEQ ID NO: 142750 - protein, 47 aa, Glycine max
  Coding DNA Sequence Number=SeqID_51065
MAMQLHLRTLSLLDIWVLMVLLCLLLEEEPIYIPQVFKANGRKIRPN

SEQ ID NO: 142751 - protein, 117 aa, Glycine max
  Coding DNA Sequence Number=SeqID_51066
  Subcellular localization annotation: CTP_CleavageSite=65; ConfidenceScore=5.17e-01
MTPTYIVQHSVATYLSAGGRRETQGCVFQGKRTCKVNTNTYSRKMSGKTKTCGLRTLIVKGSGVVFMHEEELREFYGSITEAPEAIFQQNGGGGCHPARPGELGCFLLKQPSFQNAL

SEQ ID NO: 142752 - protein, 97 aa, Glycine max
  Coding DNA Sequence Number=SeqID_51067
MKGQIKASFSTKTARQVWKILLRLKGSSWCGVSMEHNGDLLWLLVAVGDRERAWNSKFREDPTINEGWAAFLSRQLHVASLRSFIKRLPREASLRLL

SEQ ID NO: 142753 - protein, 440 aa, Glycine max
  Coding DNA Sequence Number=SeqID_51068
  Gene Ontology: Mol. function=methionine gamma-lyase activity; Cellular component=cytosol; Biological process=methionine catabolic process via 2-oxobutanoate
  Homolog annotation: Hit_ID=A7QJ62; Match level="QueryCoverage=98%, HitCoverage=99%, E-value=1e-179, Identity=72%"; Hit description =Chromosome chr2 scaffold_105, whole genome shotgun sequence
  Pfam annotation: Domain name=Aminotran_1_2; Domain location=49-363; Score=-75.6; E_value=0.0018; Accession=PF00155.12; Description =Aminotransferase class I and II
  Pfam annotation: Domain name=Aminotran_5; Domain location=86-382; Score=-197.2; E_value=0.067; Accession=PF00266.10; Description =Aminotransferase class-V
  Pfam annotation: Domain name=Beta_elim_lyase; Domain location=83-287; Score=-117.7; E_value=0.011; Accession=PF01212.12; Description=Beta -eliminating lyase
  Pfam annotation: Domain name=Cys_Met_Meta_PP; Domain location=38-424; Score=246.0; E_value=8.1e-71; Accession=PF01053.11; Description =CysMet metabolism PLP-dependent enzyme
  Pfam module annotation: Pfam domain module=Aminotran_1_2::Aminotran _5::Beta_elim_lyase::Cys_Met_Meta_PP; Domain location=49-363::86 -382::83-287::38-424
MAESAVTNRKRSSGDDAVSENDRKRKNMVARNMDPAEALALTRHEFGEHGGVNMSIEASATFTVMEPETLGRMFAGELGPDRDFFIYSRHFNPTVVNLGRHMAALEGTEAAYCTASGMAAISSVLLQLCSTGGHVVASTTLYGGTHALLTHFLPGKCNITTTFVDIADLESVESAIVEGKTNVLYFESMANPSLKVADIPELCRVGHAKGVTVVVDNTFAPMVISPARLGADVVVHSISKFISGGADIIAGAVCGPASLVNSMMDLHDGSLMLLGPTMNAKVAFELSERIPHLSLRMKEHCHRALVFATRLKKLGLKVIYPGLEDHPQHKLLKSIANREYGYGGLLCIDMGTVERANLLMAHLQNDAQFGFMAVSLGYYETLMSCSGSSTSSEMTEEEQKLAGISPGLVRMSIGYIGTLEQKWSQMEMALERFQEKEPLV

SEQ ID NO: 142754 - protein, 1011 aa, Glycine max
  Coding DNA Sequence Number=SeqID_51069
  Gene Ontology: Mol. function=nucleic acid binding; Cellular component= chromatin; Biological process=regulation of transcription, DNA -dependent
  Homolog annotation: Hit_ID=A7PIA9; Match level="QueryCoverage=68%, HitCoverage=60%, E-value=0.0, Identity=54%"; Hit description =Chromosome chr13 scaffold_17, whole genome shotgun sequence
  Pfam annotation: Domain name=PWWP; Domain location=366-439; Score =52.0; E_value=2e-12; Accession=PF00855.8; Description=PWWP domain
MEEQEKGLCGASETTVTHEEKVRIETLEGSVDCGGEVLMEGSFTEDLVGEGGTCNGKDVMVEVLGSDVYIDGVCTHENGAELSGEVGGGGSVECGEDLGKDFRSGGVGCGDSHGVESEEGRSENVAMKLDSVVLGREDRDEAVVGSGEVGAASFQGESLLDNRAHKEVWIEVSNVEDLMVADVGVECTNAPDAETTDHKVNNAVGFPLGGENVQVSSDTGQGVDKDSTIEEELNKNVFDAEKCDLRKGVEVEAEGQPEAESTKTTNHTSDIEGEDTQIADQDNLALMDAGQEEVHDESNIRQNVEVHTGISEQLGSNGGQEVEEFIKAEQRKLEGRVTRRTSLMKSMSSESFHHARYLLPIEKEGEFSVSDMVWGKVRSHPWWPGQIFDPSDSSEKAMKHYKKDCHLVAYFGDRTFAWNEESQLKPFRTHFSSIEKQSTSESFQNAVDCAVDEVTRRAEYGLACSCIPKDTYDSIKFQNVENTGIRPELSVRHGADESLNANSFSPSNLVEYLKTLSALPTGGFDRLELGIAKAQLLAFHRFKGYSCLPELQYCGGFDDDMDSLVHHDENNHAAPVSKNDGPAGSANLKNQSSSRRKRKHNLKDIMHEKKERSLSELMGGTLDSPDGDYWSDEKVTDNLVSPGRSKKKRTVDHYADDFGKPDGRKTISVAKVSNTTKSSFLIGDRIRRVASKLTGSPSMVKSSGDRSQKTDGSADGFSGNGPDFSFEEAQRSNMVAPTEYSSLDDLLSSLRLVAQEPLGDYSFLNPIVSFFYDFRNSIVVADDSVKDIFCKEKVGTKRKKPLTAGLPETFEFEDMSDTYWTDRVIDNGSEAQPAQPCQPPQPARRNRKKDHQLVPTEPGKPVQVSRRPYSRKQYSNNNHIEAPAKPPGYIDENAPAELVMNFAELGSVPSETNLNKMFRRFGPLKEAETEVDTVSSRARVVFKKCVDAEVACSSAQKFNIFGPILVNYQLNYTPSALFKASSVATTQDQEMHLDLSNFEVNIIGILGNFDE

SEQ ID NO: 142755 - protein, 61 aa, Glycine max
  Coding DNA Sequence Number=SeqID_51070
MKREEGREIDTWTEMRRVMRKRLSQESLIVEDKEMEMTLVRANIEEDTKAVHDGFTNKISF

SEQ ID NO: 142756 - protein, 66 aa, Glycine max
  Coding DNA Sequence Number=SeqID_51071
MDNTWNNSKVEFNLQQLTPDQAYKLIKFQGATPKEGLPKKRFSENTTSSCVGPIAGATEVKSEKIF

SEQ ID NO: 142757 - protein, 105 aa, Glycine max
  Coding DNA Sequence Number=SeqID_51072
MPPLLLIFVFPSSPLKTLSFSHKPPNLSQKNNDIGLIHRWIIVKFKNPIIFVEGDNRIARRQYKWRLQSLLLLYNVWEPYQSNQRKKLRNLRKLLEMPLSLSEDM

SEQ ID NO: 142758 - protein, 882 aa, Glycine max
  Coding DNA Sequence Number=SeqID_51073
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=A5AY88; Match level="QueryCoverage=99%, HitCoverage=99%, E-value=0.0, Identity=78%"; Hit description =Putative uncharacterized protein
  Pfam annotation: Domain name=Glyco_transf_20; Domain location=60-552; Score=887.7; E_value=5.4e-264; Accession=PF00982.12; Description =Glycosyltransferase family 20
  Pfam annotation: Domain name=Hydrolase_3; Domain location=600-870; Score=-75.1; E_value=0.036; Accession=PF08282.3; Description =haloacid dehalogenase-like hydrolase
  Pfam annotation: Domain name=Trehalose_PPase; Domain location=601 -864; Score=227.7; E_value=2.7e-65; Accession=PF02358.7; Description =Trehalose-phosphatase
  Pfam module annotation: Pfam domain module=Glyco_transf_20::Hydrolase_ 3::Trehalose_PPase; Domain location=60-552::600-870::601-864
MVSKSYSNLLELASGEAPSFGYMNRRIPRIMTVAGLISDVDDDPVESVCSDPSSSTAHRDRIIMVANQLPIRAQRRPNGNNRSCWSFEWDENALLQLKDGLGDDDIEVIYVGCLKEEVHPSEQDEVSQTLLETFKCIPTFLPADQFTKYYHGFCKQQLWPLFHYMLPLSPELGGRFNRSLWQAYVSVNKIFADRIMEVINPEDDYVWIHDYHLMVLPTFLRKRFNRVKLGFFLHSPFPSSEIYKTLPVREEILRALLNSDLIGFHTFDYARHFLSCCSRMLGLTYESKRGYIGIEYYGRTVSIKILPVGIHLGQLQSVLRMPQTEEKVCELIRQFSDKGRTLLLGVDDMDIFKGISLKLLAMEQLLIQHPEYREKVVLVQIANPARGRGKDVKEVQAETKATVKRINETFGKPGYDPVILIEEPLKFYERVAYYVVAECCLVTAVRDGMNLIPYEYIISRQGNETLDKVLGLASSPKKKSMLVVSEFIGCSPSLSGAIRVNPWNIDAVADAMDSALEMADLEKELRHEKHYRYVSTHDVGYWARSFLQDLERTCSDHVRRRWWGIGFGLSFRVVALDPNFKKLSMEHIISAYKRTATRAILLDYDGTLMPQSSTIDKSPSSKSIEILSSLCRDKNNMVFLVSARSRKMLSEWFCPCENLGVAAEHGYFLRQVTYASCLFNISAFLRMKRDEEWETHVAATDTSWKQIAEPVMKLYTETTDGSTIADKETALVWCYEDADPDFGSCQAKDFSIILKVCLQMNQHNLKTKSITGVGVINKGTVGLFSIKSRGVSKGLVATRLLSAMEEKGMCPDFVLCIGDDRSDEDMFEVITSSMGSPIAAKAEVFACTVCRKPSKAKYYLDDTTEIVRLLQGLACVSEQIDK

SEQ ID NO: 142759 - protein, 29 aa, Glycine max
  Coding DNA Sequence Number=SeqID_51074
MEEDWRTALIEFYHTIVELLIFFEEVFTN

SEQ ID NO: 142760 - protein, 238 aa, Glycine max
  Coding DNA Sequence Number=SeqID_51075
MIKSSDRVFNRHRRSGTYILVCREVTPGDEYFSSSSGGGIHRVGRRRLSSSFVDRWRLPRLSASAHRRGGVDVDALLDLTQTRRYAWGASGLVHLYDQLNDANISTRRQVVGYITLLQLCSVGHMNNFRQLRSTMLIRSTTRCHHMRVSGLPQRRLSKRYLQRCTGSAWIVSGFQMSVGCHMRNTDRSKTFIRFHVSQDSSAGGLLLSDTDRRGLCTNSDTSSAFQHTLSIHGCHLMT

SEQ ID NO: 142761 - protein, 121 aa, Glycine max
  Coding DNA Sequence Number=SeqID_51076
  Subcellular localization annotation: CTP_CleavageSite=40; ConfidenceScore=5.06e-01
MISFSVGGSNKGGSDCSNVDDVGDNSSDNESITVVVIVVVATTLMVMVVIVMLVMPMMMVVVVMVFVVVMVTTNYGCDNDGDGDDGVGGDNDKYDINGSNNGDNNDDNKKVIVKCGKCVIF

SEQ ID NO: 142762 - protein, 115 aa, Glycine max
  Coding DNA Sequence Number=SeqID_51077
MYGFVLDCLILNYFGTILEHFGFIDKGGVASLVEQRVRCRKGVANGCYNGRSGTMQGKHKTTGSWKDKGGSNNLNMSLKSPKNNITKTIGLCFATGLKQGLFNRNTNNEALRKDK

SEQ ID NO: 142763 - protein, 55 aa, Glycine max
  Coding DNA Sequence Number=SeqID_51078
MKMLLIPHDISSIGASEWRRRRFERRCHFKEKMSLEEAHHHREAMDKSLEEEGDE

SEQ ID NO: 142764 - protein, 123 aa, Glycine max
  Coding DNA Sequence Number=SeqID_51079
  Subcellular localization annotation: CTP_CleavageSite=47; ConfidenceScore=5.47e-01
MGRGWGVWGAGTWLPCASCSACSSGARPLGVTRRARVRGATCCATCRVHSGGACLGALCNKKNRPSSERTYVFVVSYDVPPLEVVDQGKEKVKRLSIRGSRGVTRSKLLSQLQSKQEHPNTME

SEQ ID NO: 142765 - protein, 183 aa, Glycine max
  Coding DNA Sequence Number=SeqID_51080
  Homolog annotation: Hit_ID=A2XIH4; Match level="QueryCoverage=51%, HitCoverage=16%, E-value=8e-10, Identity=40%"; Hit description =Putative uncharacterized protein
MQIESRRRFHIIRSWDQDGYHVAEVEWIQDIMPPEGTHEREISYNNKHIMQLKMLIINLHINIVVYTSLHRPVSPTSQTSRSNTRGSIDGEFFAVLGANGGGGEGDGVNGVGKDFKTVADGIRVVGLAPSFKVAPWLPGVISIETDYELGSRVGVAERVTHYKLGEGTSGMTMEAAAMKWKTK

SEQ ID NO: 142766 - protein, 93 aa, Glycine max
  Coding DNA Sequence Number=SeqID_51081
MERKIMIEVMYTQTVKWRNCPSAILLSEEDFFQKISGKPLSGNFPEEPSSGRSICDFRNYSETTSGRTSSGMFPEEASSGRFPFSSGNLFFLK

SEQ ID NO: 142767 - protein, 56 aa, Glycine max
  Coding DNA Sequence Number=SeqID_51082
MKMKTCKARMNPEEVAQQLAQASCLLPPEVTCLPRRAGYFISKSSSGPWGWKMSPK

SEQ ID NO: 142768 - protein, 58 aa, Glycine max
  Coding DNA Sequence Number=SeqID_51083
MVMQSYPARALGRRLQVDWARDPREGPRVLMSLRLLKEVFSKKLLKEVFSRKLLKEAT

SEQ ID NO: 142769 - protein, 145 aa, Glycine max
  Coding DNA Sequence Number=SeqID_51084
MAKFDPDIVLEFYANAWPTEEGVRDMRSWVRGQWIPLDADAIDQFLGCPLVLEEGQECEYGQRRNRSDGFDEEAITHLLCIPGQDFARTAAGRRVRIMRTNMTTLTQIWMTLLLSNIQPSDHNFDLPLPKCQLVYGAYQAPSGPG

SEQ ID NO: 142770 - protein, 224 aa, Glycine max
  Coding DNA Sequence Number=SeqID_51085
  Subcellular localization annotation: CTP_CleavageSite=33; ConfidenceScore=5.21e-01
AYKLQWSLHQMASKKRKTPSTPTQTKFDRSRFTSQEAWERYTDIVLPRKLLPERNVVIYYTEFDEFKEELERRHWDEKLTDFSNNNIDIAIVKEFYANLYDPEELAAKLCIPGRGFELNADGQPLKILRKNMNTLAQTWSVLSFSNLIPTSHTSDITLDRAALITALYKARGVISDSLTLESLDPAINVAYVKKNCWNLDDLSVTFRGPRKANGKRFEAPPSSE

SEQ ID NO: 142771 - protein, 221 aa, Glycine max
  Coding DNA Sequence Number=SeqID_51086
  Homolog annotation: Hit_ID=A8XZZ5; Match level="QueryCoverage=58%, HitCoverage=33%, E-value=6e-07, Identity=23%"; Hit description =Putative uncharacterized protein
  Subcellular localization annotation: CTP_CleavageSite=28; ConfidenceScore=5.57e-01
MTMLRQARNYTLASKRATQKPRTGAPPRGTTRMSKPLNRGLHVLVHQRTTRPRPSEDYTSSPLEDYTSSPLTTRPLRGLHMSSTFRGLHVFLLQRTTRPPSSEDYIFSLQRTTRPYLQKDCMSSPSEGYRSSHQRSTHPRLQRATRPPLQRTARPRLLRTKRPRLQRATRPRLQRATRPYLQRTTHPRIQGTTRPPFQKTARPRLLRATRPYLQRTTRPHL

SEQ ID NO: 142772 - protein, 41 aa, Glycine max
  Coding DNA Sequence Number=SeqID_51087
MDEEVREVLGAGSNTHTTKVFWSPNGSSQYILTFMCDKGTL

SEQ ID NO: 142773 - protein, 283 aa, Glycine max
  Coding DNA Sequence Number=SeqID_51088
  Gene Ontology: Mol. function=oxidoreductase activity; Cellular component=glycerol-3-phosphate dehydrogenase complex; Biological process=glycerol-3-phosphate metabolic process
  Homolog annotation: Hit_ID=A8GCV4; Match level="QueryCoverage=95%, HitCoverage=72%, E-value=3e-96, Identity=66%"; Hit description=FAD dependent oxidoreductase
  Pfam annotation: Domain name=DAO; Domain location=8-281; Score=122.9; E_value=9.2e-34; Accession=PF01266.15; Description=FAD dependent oxidoreductase
  Pfam annotation: Domain name=NAD_binding_2; Domain location=6-137; Score=-85.5; E_value=0.043; Accession=PF03446.6; Description=NAD binding domain of 6-phosphogluconate dehydrogenase
  Pfam annotation: Domain name=Pyr_redox_2; Domain location=8-229; Score=-42.8; E_value=0.034; Accession=PF07992.5; Description =Pyridine nucleotide-disulphide oxidore
  Pfam module annotation: Pfam domain module=DAO::NAD_binding_2::Pyr _redox_2; Domain location=8-281::6-137::8-229
MGAERGADVIVVGAGIIGAACAWRLAREGYRVSVVDDRRAGATAAGMGHLVCMDDNPAELALSAYSLRLWREVTGRMPQACAWRGCGTLWLADKADEMAIAEQKRVRLAEQGVAAELLTAEQIAAMEPMLRHGLAGGLRVPGDGILYAPLAARWLLADGGAAIDVVHGEAAALEEGAVRLADGRRLAAPVVLLACGLGANGLLPQTLLYAKKGHLAITDRYPLRVRHQLVELGYGASAHASDGTSVAFNVQARPTGQWLIGSSRQFGAVDSALDMPLLAAMLA

SEQ ID NO: 142774 - protein, 79 aa, Glycine max
  Coding DNA Sequence Number=SeqID_51089
PLDPTSGIRAGILRKVSQLQDSWPPLMQLQVDWARDPREGPRVLMSLRVSLAIRELLKEVFSKKLLKEVFSRKLLKEAT

SEQ ID NO: 142775 - protein, 268 aa, Glycine max
  Coding DNA Sequence Number=SeqID_51090
  Homolog annotation: Hit_ID=Q6UUU1; Match level="QueryCoverage=22%, HitCoverage=40%, E-value=3e-18, Identity=78%"; Hit description =Putative uncharacterized protein
  Subcellular localization annotation: CTP_CleavageSite=42; ConfidenceScore=5.17e-01
GTSYVPINVSFSPKVGPGLPAVPPVQLLTGWCVTAKAPPDISAGKCSGRVPFAIQAAQLLGRAIGAGLFAITPAGERGMCCKAIKLGNARVFPVTTLENSESVLGAPAAVAALPHRTALWIARRFSAGSSAAAQDGTCDLPASLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142776 - protein, 121 aa, Glycine max
  Coding DNA Sequence Number=SeqID_51091
MTLLLSNVLPSDHNSDFLCRVSAGVCHPDTDERHVAQLIADAIYLFAGMPPTKHPLDPNKSNRALGFPAFITGLCQSFGVPVTPSKVIRPPITRAFIEKYCTPRQAQGDAPQAADAPPPPH

SEQ ID NO: 142777 - protein, 40 aa, Glycine max
  Coding DNA Sequence Number=SeqID_51092
LTFSPWVKVYGELGFWLKACRMARHDTCQGLDLVQGCGIL

SEQ ID NO: 142778 - protein, 254 aa, Glycine max
  Coding DNA Sequence Number=SeqID_51093
  Pfam annotation: Domain name=RRM_1; Domain location=39-109; Score =14.7; E_value=0.0065; Accession=PF00076.13; Description=RNA recognition motif. (a.k.a. RRM, RB
MKVMQKSSLAGRQSQNLEIGDNNKHYRLNWRNNADITSFYFTHFPDEANEELLWRHFKNWGDVREVYIAKRLNKHGRRYRFMRFKGVSDAKGLEVRLDNIFINDCKLFVNLPRFDRPVRNTEDRRRLDRARVLVRTPLLPLIRSEVIVRVGELEYRVWIVEETGFEGGSNRKGSSSSDGWSEMITSDDGGEVGDVLDDTNTNFSFSSELPNQKLSPSRTQRAEGGTDVRCCDLRPLGNIQADVTPKEKSKGTVE

SEQ ID NO: 142779 - protein, 84 aa, Glycine max
  Coding DNA Sequence Number=SeqID_51094
MDNCHTLISSGDHCLVACNLLLTAMRYLTPIVRQSMKFRNMPEVERKHCCTIRKVPQHSRSQKGHCCVIRKVSQHSAKKIGVVT

SEQ ID NO: 142780 - protein, 29 aa, Glycine max
  Coding DNA Sequence Number=SeqID_51095
MAGTVIAARVPPSISFSPFAPVFSFIKAG

SEQ ID NO: 142781 - protein, 98 aa, Glycine max
  Coding DNA Sequence Number=SeqID_51096
  Subcellular localization annotation: CTP_CleavageSite=27; ConfidenceScore=5.48e-01
MATPPASPPPPPADTSAYPSTLKRTCKATRLRSLATRPPGAERLVVNVDPATGKANDPHKKKLRTYLGIFARDKVDVTYDTWKEVPTAQKDLIWEDIQ

SEQ ID NO: 142782 - protein, 78 aa, Glycine max
  Coding DNA Sequence Number=SeqID_51097
MAVRICWMFLRWPQGNLPQRDPGMIKRPKEPVPLPSMTVIALGALNTSSASRPSRDGHFSGSDASSSGTMSIPISRRR

SEQ ID NO: 142783 - protein, 59 aa, Glycine max
  Coding DNA Sequence Number=SeqID_51098
MWYHVSEKPRRAPKRRPVKVIVFCENAPTTWDQHRLKGALKPGDPQGLHSEESVRASPS

SEQ ID NO: 142784 - protein, 148 aa, Glycine max
  Coding DNA Sequence Number=SeqID_51099
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=72%, HitCoverage=96%, E-value=5e-25, Identity=56%"; Hit description =Putative uncharacterized protein
MTMITPSSKLTLTKGNKSWPEFEESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142785 - protein, 53 aa, Glycine max
  Coding DNA Sequence Number=SeqID_51100
MSLNFTNCLTMGAKYLEVVKRGSHPNNGWSPDEIRLDDVRPFFGPREVLGTHH

SEQ ID NO: 142786 - protein, 179 aa, Glycine max
  Coding DNA Sequence Number=SeqID_51101
  Subcellular localization annotation: CTP_CleavageSite=24; ConfidenceScore=5.17e-01
MAPRKLASKRSRRTRRPKGLVPLLSMTVTALGVLYTSSASRPSRDGRFSESDAAPAVDITGYSHGQWIPFDADAIGQLLGYPLVLEEGQECEYGQRRNWSDGFDEEAIAQLLCIPGQDFARTAAGRRVRIMCTNMTTLTQIWMTLLLSNILPSDHNSDLPLPKCQLVYAILTRMSVHVA

SEQ ID NO: 142787 - protein, 111 aa, Glycine max
  Coding DNA Sequence Number=SeqID_51102
MKSDDMRGYLIVTHTVRQPWANELIDAQRLTSSSAPFVVLTREVRGNEFPLTRGELTSSSAPFVVLTREVGDMRGYLMVTRTFGQLGANKPVDAQRLTLSSALLSSFPEVK

SEQ ID NO: 142788 - protein, 306 aa, Glycine max
  Coding DNA Sequence Number=SeqID_51103
MVEPSKKRKGSSSRSQRHFETQETQIPSSISSSSLFSSEEQRIRYTNLFSSRSIIDPKFIDMDFFSNESFECIQAFENFNLIPFMSLKLFVYSDLVKAFNSNLEIHEGTLISEVYGIKMVIDQSLFYDLTQLSSEGVPFEGTLLDDWRYDFSVHDARRLVCTNQADMTGRLLAGSLAFESRILHYLIVRILLPRSSNPAQRSFLIGATVIASFGYRKEHDGSWVKKGAQPIDEEGNLHGGEDSSLLQKILDRFDGLQTFVGERFDTLELQVDMRFNEMESRIIKVEEDVSYIRTSFNLPPPPPPSS

SEQ ID NO: 142789 - protein, 26 aa, Glycine max
  Coding DNA Sequence Number=SeqID_51104
MGDTDPPLVCPREGITTEPAHDAYAK

SEQ ID NO: 142790 - protein, 59 aa, Glycine max
  Coding DNA Sequence Number=SeqID_51105
MVLAIIGTGREVDRLTLFIRSEEVFQHALQHLLVGAQGLQLARKVLQFIFQLLDFSPLL

SEQ ID NO: 142791 - protein, 188 aa, Glycine max
  Coding DNA Sequence Number=SeqID_51106
MVEAMMSMKKIMEAKAVTVAATSIVAKVNPMPPSGLNQMNHPTSDMVGKDLGSRDDPHDVQIQNKHAFPPYGLPPNCTPPNVAYTPSENTHEIPHHNLADSEPCLGYATGGQAVGGIPMPNTLEAPQFRPQPQPLHFAVGRAPPTMSKKGKLDHIEERLKDIERGEYYAFANLEELFLVPEHGHSQVQ

SEQ ID NO: 142792 - protein, 92 aa, Glycine max
  Coding DNA Sequence Number=SeqID_51107
MTYERGGDFLEDAGKILNREVKGPRQSHFSIGSAPLTIITKSDTQILVAKPDRTIKIPGVSPWRLPRALSCSCLSVYRCHSAVMAAFVSFHA

SEQ ID NO: 142793 - protein, 71 aa, Glycine max
  Coding DNA Sequence Number=SeqID_51108
MRTRSPLKARASNPLQARMCSPLMARTYSTLKVIGKHRLTVLLKEVIIHATSSYLLQISPGTPSEYVFCSI

SEQ ID NO: 142794 - protein, 273 aa, Glycine max
  Coding DNA Sequence Number=SeqID_51109
  Subcellular localization annotation: CTP_CleavageSite=41; ConfidenceScore=5.59e-01
MAEPSKKRKGSSSTTAAAAHRRHGPSGAPTTPIHPSLSSLRSSTLFSSDDQRLRYLSQFSSRIILDPKYLDVEFFNDETFDCYQVFQNSGLVDFMSLKLPYYPKLVKVFYCNLKIQDCIIISEVHGIPMVIDQSLFFSLTNLPSQGAPFEGTIVDDWKFDYSSHDARRMRSFAIGAGAVTSFGYRKDRNGQWLKKDALPPQDERTPSPPPQRDDSALMNEVLSELRGLRSYVGDRFDSLDTRFAGMDIHLTQLEEDVGCIRQSFDLPPPPPPS

SEQ ID NO: 142795 - protein, 134 aa, Glycine max
  Coding DNA Sequence Number=SeqID_51110
MPLSFSGLHVLAFRGPHVLTFIGLDVLAFRGLHALTFRGLHALAFRGLHVVALRELTRPRLQRTTCPHLQRTTRLDVLAFRGLHALTFRGLTPSPSEGYTLSPSENYTSSPSEDYMPSAFRGLHVLAIRGLHAL

SEQ ID NO: 142796 - protein, 95 aa, Glycine max; identical to SEQ ID NO: 109893
  Coding DNA Sequence Number=SeqID_51111
  Homolog annotation: Hit_ID=A0PAV3; Match level="QueryCoverage=40%, HitCoverage=17%, E-value=5e-07, Identity=76%"; Hit description =Restriction endonuclease

SEQ ID NO: 142797 - protein, 62 aa, Glycine max
  Coding DNA Sequence Number=SeqID_51112
  Homolog annotation: Hit_ID=A0PAV3; Match level="QueryCoverage=61%, HitCoverage=17%, E-value=5e-07, Identity=76%"; Hit description =Restriction endonuclease
MVKVGTSYVPINVSFSPKVGPGLPGINRDTRIYLFCEVIFRHRCSVASVSISCPSCSATDGV

SEQ ID NO: 142798 - protein, 288 aa, Glycine max
  Coding DNA Sequence Number=SeqID_51113
  Gene Ontology: Mol. function=transporter activity; Cellular component= integral to membrane; Biological process=transport
  Homolog annotation: Hit_ID=Q1R549; Match level="QueryCoverage=99%, HitCoverage=71%, E-value=1e-122, Identity=76%"; Hit description =Putative resistance protein
MMLWLSAGVLVGLADGAGYLLTLSNCVKWFPERKGLISAFAIGSYGLGSLGFKFIDSHLLSSVGLEKTFMIWGAIVLVMILFGATLMKDAPQQEVKTVNGVVENDFTLAQSMRKPQYWMLAVMFLTACMSGLYVIGVAKDIAQGMVKLDAMTAANAVTVISIANLSGRLVLGILSDKIARIRVITLGQVVSLLTFFAAIACVAFNFGGTITVFPSLVSEFFGLNNLAKNYGVIYLGFGIGSICGSLIASLFGGFYVTFCVIFALLIISLALSTTIRQPQREVFKEVHA

SEQ ID NO: 142799 - protein, 161 aa, Glycine max
  Coding DNA Sequence Number=SeqID_51114
MWAFHTGQQIDWAHLAQYRMHKALRLNAPLPYPHLVTLFLQHFNIPLDFEPYVPIKRSFLISVAVVASFGYRKERDGSWVKKGAQPNDDEGHLPVEGDSSLLQSILDRFDGLQTYVGERFDSLERQVETLFEEMNSRIAKVEEDITIIRDCFDLPPSPPSV

SEQ ID NO: 142800 - protein, 88 aa, Glycine max
  Coding DNA Sequence Number=SeqID_51115
MSNHKSTESALKNFEVQVGQLAKQLADKSSNRFVANTEKNPMEECKVVMTRNKRFLEAEDEESVVHKKRAAEKKGTDGKKNDVRGESH

SEQ ID NO: 142801 - protein, 83 aa, Glycine max
  Coding DNA Sequence Number=SeqID_51116
MDGFMEPMKQHNLEMLGLRARRGSRVRFPKEEKCAESPPTFICGKRRKNRRKPVIKNIPDSGVVFMFEEGISTSHVCPKGQQP

SEQ ID NO: 142802 - protein, 71 aa, Glycine max
  Coding DNA Sequence Number=SeqID_51117
MDGFIGDICHMGMLWPARSLEQVIHWLTMESDCCTHENLTDKLAPIVNNKMMQETVRGFQDSSIITPPPIG

SEQ ID NO: 142803 - protein, 180 aa, Glycine max
  Coding DNA Sequence Number=SeqID_51118
MVSRGGGERDECLFHLGESHDMETCPAVEELLQRLMDCGQLEVSIGGREEPQVCMQAEEKKVPLTPKALVICFTRKGTGSTPIYPRTAPKPTPYAYQSNKAVPWKYTPPAFSEKVATEVDSLSAKVTNITGLSGVTRSGRVFASPHPAELPSKGKVPMVQEPTDVATPSKEVDPPVVRGD

SEQ ID NO: 142804 - protein, 128 aa, Glycine max
  Coding DNA Sequence Number=SeqID_51119
MGTNQTGKRFYQVKIKGLDVTSLKELGRLMGPLQMQAFRKAYGKILDLTIAEIFTEAIVSLTQYYDQPLRCFTFGDFQLGFGKRVGSCKAKSKRHSGPTTKLLKRQGKGYGESRGVGPVYGRISIANL

SEQ ID NO: 142805 - protein, 177 aa, Glycine max
  Coding DNA Sequence Number=SeqID_51120
DSLQEQTTQGSFVPHGHDDILNIAIARPEHPGRVRVAGSGMTISQYYGRASCGSSSSSTSITQQQLAEIIGSLKEEYMNEIIRNPKEEVRNEIEEENKGSQYSPLIEAEIQALGARVSTKGSNVETVVNPSGEEHDGHAISTMGLYVQRENCTHLVALGKIYEGGSSIPNMAYANDV

SEQ ID NO: 142806 - protein, 142 aa, Glycine max
  Coding DNA Sequence Number=SeqID_51121
MLGFTRDSPQISASLHQLDLAPYAPEPYNAQWNAPGLLRDKHTLRSSRILGEMEVDEPWLGLWLPLNYQVDMGSSLAYDNGIWGEPYRLFAAKFLFITGFVVDLGMAFVDNWVVGKEEEWQLQHGFLPHPHPLHLPQFSQSS

SEQ ID NO: 142807 - protein, 123 aa, Glycine max
  Coding DNA Sequence Number=SeqID_51122
MLLSSNVIYICVRVVMLVRMIRTRLFAAARVKSCPGMHSSCVIASLSGCARTVGPPPISGGGPGTVRACNPLKARRCSPLEVRACSPLLARTCSPFKVRACNPLRVRTCSPLKARTYSPLNGE

SEQ ID NO: 142808 - protein, 101 aa, Glycine max
  Coding DNA Sequence Number=SeqID_51123
MGRCPLEEEFSDITYSQCTPNTTINHDVFMRSQVIFIGSQVEGYTSPSSSESMKKPQDLRGQNPFKVRDDAILPPKGMDRRLKEAWLELLKRGPRVLITLG

SEQ ID NO: 142809 - protein, 177 aa, Glycine max
  Coding DNA Sequence Number=SeqID_51124
  Gene Ontology: Mol. function=tetracycline:hydrogen antiporter activity; Cellular component=integral to membrane; Biological process=response to antibiotic
  Homolog annotation: Hit_ID=Q37953; Match level="QueryCoverage=49%, HitCoverage=73%, E-value=3e-24, Identity=66%"; Hit description=LacZ protein
MTMITPSSKLTLTKGNKSCKQTVVVKLRIDTPIEVDYYRHGGILPYVLRQLLESNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142810 - protein, 127 aa, Glycine max
  Coding DNA Sequence Number=SeqID_51125
  Subcellular localization annotation: CTP_CleavageSite=28; ConfidenceScore=5.36e-01
MATQLNQAQSQNSDKLPSQTMQNPKNVSAITLRSGKQIGVPPLITAPAPEPVKLHSTPEKEDEIVAQKRKLFDHEGANKKFHAGGPSSNSSDLQQPPIPLPFPPREIPNKKMEEVDKEILETFKKVE

SEQ ID NO: 142811 - protein, 263 aa, Glycine max
  Coding DNA Sequence Number=SeqID_51126
MAWRPRHDVAGGGGSDDLRHDIGVVGDAPAGASLAALPRALHAGCGPAVHGTVPVRRTHPALGLRGDVGAAGGNVGLRAHGERHGRRWNGRGGIAGAGHAGGPVATSAGAALRTAIAHGLADAGVGLAGRCRLDARFAASGGAGRGAAGTGVWLDAAGTAARRAVGRGPGAPEHENDGRIHNPDGGGHAHRRADRWQPGRSARQHRADIVCQAAVAGQAADLDRAGAHAGLDRGRVAGAAADRAGSPRAGHHDAALAHACRVD

SEQ ID NO: 142812 - protein, 277 aa, Glycine max
  Coding DNA Sequence Number=SeqID_51127
  Gene Ontology: Biological process=transposition, DNA-mediated
  Homolog annotation: Hit_ID=Q6UUU1; Match level="QueryCoverage=21%, HitCoverage=40%, E-value=4e-18, Identity=78%"; Hit description =Putative uncharacterized protein
MVKVGTSYVPINVSCSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMRIMNVVFDLRADLIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 142813 - protein, 99 aa, Glycine max
  Coding DNA Sequence Number=SeqID_51128
  Subcellular localization annotation: CTP_CleavageSite=32; ConfidenceScore=5.13e-01
MKENREKLVNSNWAYLGMTRQRCLGSFLAGPSTSSRMGAIIPMCLSLLPFSHCRFLSPLVSSLLDEAPSLGPHGQISSPTPGEVPHPRPLHSPSSLLLA

SEQ ID NO: 142814 - protein, 143 aa, Glycine max
  Coding DNA Sequence Number=SeqID_51129
MNALYDTLMIMEVDMEAMKDQMATMMEAMLSMNKIMEVNVAVVATTSAATEIDPFHPSSMNQVSHPALNMVGQGGEALGSTGGPHVVQSKNFFPPYSLPPNYATPNVVHVPNENVNHPNLVPLESQQPQLGHAHFAQSLGGGT

SEQ ID NO: 142815 - protein, 94 aa, Glycine max
  Coding DNA Sequence Number=SeqID_51130
MFACSLFAKRTPRTKCISVHALSCESHALRAQSLHLRLIWSAKLAKVEPWLSGTYCRQVQFLTAITKVNEAKCQSWQLSKIHCGNISVKRVPLS

SEQ ID NO: 142816 - protein, 271 aa, Glycine max
  Coding DNA Sequence Number=SeqID_51131
NTETFSSLTSYPELRRSEFLIGGYVGARASLLSTTPPFVAMTQELVARGDTLRLSAPRHSVTPSVIDEQRPMWSSAPFSEMSAFFDGDFSSLTSYPELRRSEFLIRGYTQSCSMARRDKLWSFCTLLSSRGDGPDDMRRQIMVIPHPFAIQTQSCPMARRDKLWSFCTLLSSRGGGPDDMRRQIMVIPHPFAIQTQSCPMARRDKLWSFCTLLSSRGGGPDDMRRQIMVILHPFAIQTQSCPMARRDKLWSFCTLLSSRGGGPDDMRRQIM

SEQ ID NO: 142817 - protein, 254 aa, Glycine max
  Coding DNA Sequence Number=SeqID_51132
  Homolog annotation: Hit_ID=A0ST23; Match level="QueryCoverage=9%, HitCoverage=51%, E-value=9e-07, Identity=100%"; Hit description =Putative reverse transcriptase
WPGFPVSTGTPGFIYSCEVIFRHSGFLFLSAVPPVQLLTGVVRKRQKAPPDNQRWQAAQLLGRAIGAGLFAITPAGERGMCCKAIKLGNARVFPVTTLNSITTLHNIKIKGIPIATTCIDPKDLEKLPLTLVHQAYRYRRPRGGARYQLLFPLVRVNFELGVIMVIAVSFGKPVVPAALMNRPTRGERRFAYWALAECILAYYVGTDEEYVIQDIFRLPRSLTRYARSFDCGERKWLTNGAEISWKMPGRYLTG

SEQ ID NO: 142818 - protein, 66 aa, Glycine max
  Coding DNA Sequence Number=SeqID_51133
MAGRIVREGDNNGLQPEPVAGNTLTRLRDRCSRKAHSQTLQGTAPAALRQYPAAVLPDRGITSSDR

SEQ ID NO: 142819 - protein, 221 aa, Glycine max
  Coding DNA Sequence Number=SeqID_51134
  Subcellular localization annotation: CTP_CleavageSite=82; ConfidenceScore=5.14e-01
MVKVGTSYVPINVSFSQQKLAHLGSGYSNRDTGFISHSSANDFRSHQPEASALASVKPGVPKTLTLTHINCVPRLHCAAIPSGNAVVPFAALQAESPTVARRAIGAGFALLRQLALKADVLHTGDYYVGYTDARVFPVRSASVAGEKRLHRSANSSLTELATARSFDCGERSELVAYPRTGCRNSGMLSSGKLNRKCHETGRGLKHEFFHRLRPPDKHHEI

SEQ ID NO: 142820 - protein, 102 aa, Glycine max
  Coding DNA Sequence Number=SeqID_51135
  Gene Ontology: Mol. function=nucleic acid binding
  Homolog annotation: Hit_ID=A5C3F7; Match level="QueryCoverage=62%, HitCoverage=6%, E-value=2e-12, Identity=53%"; Hit description =Putative uncharacterized protein
MEKSEKKNFSEKKMKKAYITWEDNDMESSEDSENEEINLCLMAKSYESDEEVSLRKEWYIDSGCSKHMTRDASKFTHISPKKSGHVTYGDNNKGRILGVGKI

SEQ ID NO: 142821 - protein, 165 aa, Glycine max
  Coding DNA Sequence Number=SeqID_51136
MINRKHIMQQKRHPHAQSLIVSDSSESVNSESTQGSGSNFLTTYEDCQSPTNQPVINTEDTRAHALRLIFTIVIVILYYGIKQFQDILILVINSCNVDIVMHKCGMMKEYQKIKIVGVQGSAYAVEMAKLNCHYYKIHPNISNNFCLMIIQLIVKIINITYEHTT

SEQ ID NO: 142822 - protein, 73 aa, Glycine max
  Coding DNA Sequence Number=SeqID_51137
MEGSPYCSEGFDMRGYSADNDSVDDTVFEKYDISKEKWAQLYQTRRDPSWEDVRKKAQAIQKQNTTPPRVVSW

SEQ ID NO: 142823 - protein, 146 aa, Glycine max
  Coding DNA Sequence Number=SeqID_51138
MERSMIDAANGGALGDMTPVEARNLIEKMASNSQQFSVRNDAIAIRGVHEVATNSSSLGETKKLEGKLDALVNLVTQLAMNQKSAPVARLCGLCSSANHHTDLCPSMQQSEAIEQPEAYATNIYNRPPQPQQQNQPQQNNYDLSSN

SEQ ID NO: 142824 - protein, 129 aa, Glycine max
  Coding DNA Sequence Number=SeqID_51139
  Subcellular localization annotation: CTP_CleavageSite=52; ConfidenceScore=5.36e-01
MVKVGTSYVPINVSFGVAKSWPNRSIPVSTNLAGIPGFTVFYAKLDRYRHLRCSSGVSWFLSAVPSCSATDNCVSASQFGTQAYEPEASALASVAWGAQAAANSPPAALNCLPLQGASAFSSQEPAATA

SEQ ID NO: 142825 - protein, 113 aa, Glycine max
  Coding DNA Sequence Number=SeqID_51140
MSKSCGFGMTGPLDESISCFLIRVDPWVLVPITFRGLHVLANRGLHALTFRGLHVLALTGLHALILVTLTVERTTRPRLERTTRPHHQRVARPHLQRTTCPRLERATRPHLGY

SEQ ID NO: 142826 - protein, 173 aa, Glycine max
  Coding DNA Sequence Number=SeqID_51141
MVKVGTSYVPITERFIFSQKLRPASIAAGRGRPGAGIKLIFRMIPSTSVLQWRIWFLSAVPPVQLLKRGGVIVNAKALQPEHQRGKCSRGAQLQLTTTPAGLMLAATGRVPIRHSGCATVREGLIGAGLFAINESANAAKGEMCCKFAISWVTLAGVILAYHVGTDVVKRRRQ

SEQ ID NO: 142827 - protein, 22 aa, Glycine max
  Coding DNA Sequence Number=SeqID_51142
MEHTDLGIPRSGGSACHWTLGT

SEQ ID NO: 142828 - protein, 213 aa, Glycine max
  Coding DNA Sequence Number=SeqID_51143
  Homolog annotation: Hit_ID=Q6WAY4; Match level="QueryCoverage=95%, HitCoverage=36%, E-value=2e-21, Identity=33%"; Hit description =Putative uncharacterized protein
MGSSQMPSLKKKFYQVKVKSLRITSLKELGQLMGQLQWQAFRKAYGKIWDLAMVEVSTEAIASLAQYYDQPLRCFTFGDFQLSPMVEEFEEILGCPLGGRRPYLFSGFYPSLARIYKIVQISAQELDHRKQVENGVVGIPRKYLEEKARILAGKGEWAPFIDILALLIFGGVLFLNVDGLVDLAAIDAFLVYHDHKESPVVAMLANLYDTFDR

SEQ ID NO: 142829 - protein, 104 aa, Glycine max
  Coding DNA Sequence Number=SeqID_51144
MPRHVDADEGSSSSPPISIFNYPRSASAKSKTYFLDQVDLHIPHLYVIQNCPKVEPNLEYTKAYDPFIFAQQAEQVYYTTYPEEHRGWLAIIKIKARRRITNNI

SEQ ID NO: 142830 - protein, 151 aa, Glycine max
  Coding DNA Sequence Number=SeqID_51145
  Gene Ontology: Mol. function=tetracycline:hydrogen antiporter activity; Cellular component=integral to membrane; Biological process=response to antibiotic
  Homolog annotation: Hit_ID=Q8GEG0; Match level="QueryCoverage=73%, HitCoverage=96%, E-value=1e-24, Identity=56%"; Hit description =Putative uncharacterized protein
  Subcellular localization annotation: CTP_CleavageSite=25; ConfidenceScore=5.41e-01
MTMITPSSKLTLTKGNKSWYRAPPRAQSNSCSPGDPLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASADVRRCFCRYAPPRQ

SEQ ID NO: 142831 - protein, 168 aa, Glycine max
  Coding DNA Sequence Number=SeqID_51146
MLAIINKYQEELDLATTHEHKVADEYARVYAEKEARGRLIDSLHQEATMWMDRFALTMNGSQELPRLLAKAKAMADTYSAPEEIHRLLSYCQHMIDRNAKNWNWRCGTQTEAGFQHPKRSSFFSSFMAEYVVKSKEPTSTSWDLQFQVRVDFSSLEICGRWVLGSYNG

SEQ ID NO: 142832 - protein, 90 aa, Glycine max
  Coding DNA Sequence Number=SeqID_51147
MGYAINSFLTPRCLEILFIVNMKWPQGSLPQRDPGKTRRLKEPVPLPNMTAIVLGALSTSNASRPSKDGHSFGKDVSSSGTTSILTSRKR

SEQ ID NO: 142833 - protein, 87 aa, Glycine max
  Coding DNA Sequence Number=SeqID_51148
MPLKGKQLVVYPCQTLWRALSITHNHTLTAGTHEPLPRSPPFLEDLLSFQFLLPPGDPLLLRGWPCLRALGSWVLSPWRAIPPSEGE

SEQ ID NO: 142834 - protein, 99 aa, Glycine max
  Coding DNA Sequence Number=SeqID_51149
MQRRSTASDLIPIDLEINATCKRRNAERIRNFLQDLEAVTTPEEEPRSSEASSSFPIPGQSHIDLIEEVIMAEEPRRVTLEDYSSSSVLQFFTSIAQPE

SEQ ID NO: 142835 - protein, 126 aa, Glycine max
  Coding DNA Sequence Number=SeqID_51150
MIPFTSSELELTIAAPIKPLKTLLARVLPFGLSWFLVPRLQLWPILTSLSSSYSFQTLMAMDLNFSSTTRALSRSAFRASADDPITASPKLSVLSSRRIPCLANSLEYPRVVVTETPCDERRDAFI

SEQ ID NO: 142836 - protein, 132 aa, Glycine max
  Coding DNA Sequence Number=SeqID_51151
FPSLITGLCQSFGVPVAPTKVIRPPITRAFIENYCTQRQAQGDAPQAAGTPPPPHQAGQAGAFDMEQYLRHLVRQQAANHRAHFRAEVAWPGDWPKAQAGEAPPEAPGDGEEAHEDEEMADLLDFLGGSGDT

SEQ ID NO: 142837 - protein, 129 aa, Glycine max
  Coding DNA Sequence Number=SeqID_51152
  Subcellular localization annotation: CTP_CleavageSite=18; ConfidenceScore=5.01e-01
MGNVVPTSPRASCVLQPRASSVYAQSLPPWLQHTRIATRGDLHATPAAPPARTAGGPAAQRTPVNADPAGHRLWDNLDVPNPNAGIGARARRTRRIRNPPSPNGVISLPYRGDAGSRIAACPAPGHGQY

SEQ ID NO: 142838 - protein, 189 aa, Glycine max
  Coding DNA Sequence Number=SeqID_51153
  Homolog annotation: Hit_ID=A2Q377; Match level="QueryCoverage=92%, HitCoverage=31%, E-value=9e-12, Identity=28%"; Hit description =Nucleic acid-binding, OB-fold
MVIILTHARIKDAQGSYPASVSNSFKASKLLINDPILEIQEFKERLLDLGVEVSPVLIPGDQASSQVSGGSQLSSKDSFLSKAEVKTIFEINGIFEDVVCVTVGTISKIVMDNHSWCYPACVQCHRKTNIQTGPFTCRCGKDNDQPVLRYRVEVMVTQNNESNKFLLWDRECAELIGETADDVNRVKIE

SEQ ID NO: 142839 - protein, 136 aa, Glycine max
  Coding DNA Sequence Number=SeqID_51154
QKNVYTDNHSGISARQRDSNVSMTDLVRAEDDVNLRVSTGLLVAIDEGRRMTIICLCVPSDTTVSEWQKDTTVSEWQKLLLLRILGPTTCDLKISGKGCGMTIIWPLHVTRARRLWNDEVRITVRRLCGLLALGVM

SEQ ID NO: 142840 - protein, 67 aa, Glycine max
  Coding DNA Sequence Number=SeqID_51155
MDERRRKLLQDRTIASILEEETYFSDSLSPDSPSSRESANQHSKTTTMADEHDQRTTLEDYSSGSVP

SEQ ID NO: 142841 - protein, 257 aa, Glycine max
  Coding DNA Sequence Number=SeqID_51156
MVKVGTSYVPINVSFSPKVGPGLPGINDYSRFSLYSAGRIHIPITGILLAQYRAPRGVMLPVPLIDLVYDGVNFEVLQWRIMLSSAVPSCSATDNCGIRVTIAHKHTTPEASALASVKPGVPRRAANHSHPPRLIALPLQGCPHSSMSGTCRPTALMNRPTRGRSSAGLLRITPAGERADVLHTGDYYVGYTDARVFPVRMRSVAGEKSCTGASVRICEYRTHYRANWSSPRWSARSELTRYARSDSTAASGMVTTV

SEQ ID NO: 142842 - protein, 145 aa, Glycine max
  Coding DNA Sequence Number=SeqID_51157
  Pfam annotation: Domain name=Transposase_23; Domain location=26-93; Score=-15.2; E_value=0.055; Accession=PF03017.5; Description =TNP1ENSPM transposase
PKVGPSAARVSTKGSCVDPSPTDHDTGDSDKCGLYIEENPSRLVALGRIYEGSIAVHNIPLLHGQVKVGVEEVKDAEALVPVPTDEIVVSLAKPIDGPNPQVMWDATVFEVFNEHFPLYIRHKDLSEIAHGSQCLSIFVKQLWIL

SEQ ID NO: 142843 - protein, 63 aa, Glycine max
  Coding DNA Sequence Number=SeqID_51158
MEQDKFRRALWGSSYELKLRKAERDKSRIESMVLEDKLKACQRAKAVADTYSAPDEVHDLFDY

SEQ ID NO: 142844 - protein, 193 aa, Glycine max
  Coding DNA Sequence Number=SeqID_51159
  Homolog annotation: Hit_ID=A2Q3D2; Match level="QueryCoverage=67%, HitCoverage=24%, E-value=1e-10, Identity=31%"; Hit description =Putative non-LTR retroelement reverse transcriptase, related
METQNTHKNSSVHLEATSGYLQKAKLRRRQIPIDDMLCPLCRNKEEGAEHLFFNCSKTLPLWWESMSWVNLITVMPQNHRDHFLQHGMEVADGVRSKTWKCWWIALTWTIWHHRNKVVFQDTTFHGIKLLEDALFLLWSWIKAMDKDFTLHFNQWSSNLKEEEHNKGKGNFIKEKKHKVVTMLELNMRYPIHV

SEQ ID NO: 142845 - protein, 57 aa, Glycine max
  Coding DNA Sequence Number=SeqID_51160
  Homolog annotation: Hit_ID=A5AM73; Match level="QueryCoverage=63%, HitCoverage=3%, E-value=2e-07, Identity=52%"; Hit description =Putative uncharacterized protein
MAPNKICEGCIYGKMHRLPFPKTSWRAKAPLQLVHADIWGPSSIPRFWWKTIFSPLR

SEQ ID NO: 142846 - protein, 186 aa, Glycine max
  Coding DNA Sequence Number=SeqID_51161
MTHDLTIRGMHALTFRGLHVLAFRGLHVLAFRGLHVLTFRGLHVLTFRGLDVLAFRGLHVLAIRGLHALTFKGLHRAARPHHLRATRPHLQRTARPCLQRTTRPRLQRAARPHHQRTTRPHHQRAACPHLQRTTRPRLQRTTRPRHQRAAHPHHQRAARPHLQRAARLRLQRTTRTHLQRAARPRL

SEQ ID NO: 142847 - protein, 162 aa, Glycine max
  Coding DNA Sequence Number=SeqID_51162
  Subcellular localization annotation: CTP_CleavageSite=96; ConfidenceScore=5.82e-01
MRGNSPASSSDTSFLPQSSLFSERPFTGISSFGVRVILSFCSSTIFAFPLTFAGCVGRSWGANTRPLWVTPLRPVILVTLADNELMSVASSFLSLRGAYLHGTAWLFRYGNGTGFTTKGYRGFCGAASYGEIYHQRFRPPKTSFICEVHTYMLLFPPLIADF

SEQ ID NO: 142848 - protein, 35 aa, Glycine max
  Coding DNA Sequence Number=SeqID_51163
MEKGYAAASEVGQVHLRMRKMLLVEVLDIAFPTSM

SEQ ID NO: 142849 - protein, 121 aa, Glycine max
  Coding DNA Sequence Number=SeqID_51164
  Homolog annotation: Hit_ID=Q6WAY6; Match level="QueryCoverage=43%, HitCoverage=9%, E-value=5e-12, Identity=60%"; Hit description =Putative uncharacterized protein
MTPSTEDVKRAIQGLFVVLQLFMYEKGGPNWDQLLASKEGASVNLFPRWKEGRTGVLISCGGFPNVPLMGTRGCISYNLVLAIRQLGYPMRGAPLEDELAPVISRGFNKTNMETLQKVRKA

SEQ ID NO: 142850 - protein, 44 aa, Glycine max
  Coding DNA Sequence Number=SeqID_51165
MRFRSKKKPTDTIEQVKDSSTAHVDREAKARRAKKEMVEANLRL

SEQ ID NO: 142851 - protein, 188 aa, Glycine max
  Coding DNA Sequence Number=SeqID_51166
  Homolog annotation: Hit_ID=Q6WAY4; Match level="QueryCoverage=80%, HitCoverage=27%, E-value=3e-16, Identity=33%"; Hit description =Putative uncharacterized protein
MEVFTEAIVSLAQYYDQPLRCFTFGDFQIAPTVEEFEEILGCPLGGRKPYLFSGFLPSLSKIVAVIRDSARELNRIKQTRSGVVCLPRKYLEGKARDMASQEEWVPFADILALLIFGVVIFPNVDGLVDLSVIDAFLAYDHSKESPVVAILATYLIHLTEGARRTAHGLSATYPLFVCGWFRTYSNKT

SEQ ID NO: 142852 - protein, 85 aa, Glycine max
  Coding DNA Sequence Number=SeqID_51167
  Homolog annotation: Hit_ID=Q51617; Match level="QueryCoverage=71%, HitCoverage=88%, E-value=1e-16, Identity=75%"; Hit description =Putative uncharacterized protein
  Subcellular localization annotation: CTP_CleavageSite=69; ConfidenceScore=5.87e-01
MAALHNSLTVMPSVRCFSVTGVSRGPFVSRVSVMTVKTSDTCSSRRRSQLVCKRMPGADKPVRARQRVLAGVGAGLTMRHQSRLY

SEQ ID NO: 142853 - protein, 174 aa, Glycine max
  Coding DNA Sequence Number=SeqID_51168
MVLKEELAACSRSKRSLAQHLEATEQSMLAIIGQYKEELNQSLAHEQKLVEDFARAYTEKEARGRVIDALPQEATMWMDRKLTITKKAQRHPYNTRSKSKMGNEEGVQEQMKADMSALKDQMASMTEAMLKIQKSIEDNPTAAASNTTREAEPGATARNELVPGQKRGGFQSEV

SEQ ID NO: 142854 - protein, 133 aa, Glycine max
  Coding DNA Sequence Number=SeqID_51169
MGKVEEAQEQMKVDMEATKEQMDTMMEAMMSMKKIMEANAVAVAATSAVAKVNPMPPFGLNQMNHPTSARVGKDLESTGDPHYAQIQNKHAFPPYGLPPNYTQPNVAYIPNEDVNNSAPILIESRQPHHAHVF

SEQ ID NO: 142855 - protein, 31 aa, Glycine max
  Coding DNA Sequence Number=SeqID_51170
MEVEEPWQGLWLPLHYQVVFVIESAVDRLCG

SEQ ID NO: 142856 - protein, 97 aa, Glycine max
  Coding DNA Sequence Number=SeqID_51171
  Gene Ontology: Mol. function=ubiquitin-protein ligase activity; Cellular component=ubiquitin ligase complex; Biological process =protein ubiquitination
  Homolog annotation: Hit_ID=A7PI07; Match level="QueryCoverage=75%, HitCoverage=11%, E-value=4e-23, Identity=73%"; Hit description =Chromosome chr13 scaffold_17, whole genome shotgun sequence
PIHIVVEVIRTGSPRNQENVAAVLWSLCTGDPLQLKLAKEHGAEAALQELSENGTDRAKIKDGSILELLQRMEGGPAIKSAATTEPSSQNGKKLEGG

SEQ ID NO: 142857 - protein, 39 aa, Glycine max
  Coding DNA Sequence Number=SeqID_51172
MWVSRERLLADFRREEKENNDFRQEDDKEKREDKLTSVL

SEQ ID NO: 142858 - protein, 107 aa, Glycine max
  Coding DNA Sequence Number=SeqID_51173
MGETHEIPHHNLADFEPWLGYAIEGQAVDGIPFENTLESPQFRPQQQPLHFAVGRAPPAMAKMGKRKGSGPLKEVLDFDKYKGATCPKNHPKMYCRKIRAYAKMRNC

SEQ ID NO: 142859 - protein, 80 aa, Glycine max
  Coding DNA Sequence Number=SeqID_51174
MELQVDMRFDAMESRITKVEEDVSFIPCPDFRDCHHQKRGDCRQRIKLNVLMMPKDHMLLKALFKTKKLKIFKMNDQDSL

SEQ ID NO: 142860 - protein, 42 aa, Glycine max
  Coding DNA Sequence Number=SeqID_51175
MEVDEPWLGLWLPLNYQVDMGANFVVDLGMAFVDNWAVGKEK

SEQ ID NO: 142861 - protein, 115 aa, Glycine max
  Coding DNA Sequence Number=SeqID_51176
MKNRIKIKHIIINNLINYLSTKNRMILRWMFHGIKNVKMNNNITKFHRQCASINIYLESTWVLTFLRNVRNKFTYNADTFLPMLILSSPLSFLLWVQNSFRNLAYLGICLMASSR

SEQ ID NO: 142862 - protein, 189 aa, Glycine max
  Coding DNA Sequence Number=SeqID_51177
  Homolog annotation: Hit_ID=A5BEV8; Match level="QueryCoverage=60%, HitCoverage=17%, E-value=7e-12, Identity=35%"; Hit description =Putative uncharacterized protein
MENISKWFQELDVYGKVTLKIKLREIAYPDLNSMCRPPEKVNTEVKHIASSSNQAIPKRTMPMLDQFHLCIHDSIKNIVDVKADGNYGYRAIATILGMGEDSWSLVRNHLLKELSKWSDEYINLPCGIDLFEELKRSLLVDGLSMVTMDKWMNITDMRYVIASRSQPPIDSSMHCVICIGHVYDNHFVQ

SEQ ID NO: 142863 - protein, 167 aa, Glycine max
  Coding DNA Sequence Number=SeqID_51178
AVHVSSTFEFGAVFHDCLSADPQGNPPFSPFSKPHECYCLALFMCPPLSSVKPLVTGKYVLLRKREGVETRVVITERAGRTKSVSYLCFPLISDERSFLQKAVASGGSNLARLGELGDKLLPYFAINRGRSEEERGSAFLALLSLSKLLRKIISVKKIQAEALPLQR

SEQ ID NO: 142864 - protein, 55 aa, Glycine max
  Coding DNA Sequence Number=SeqID_51179
MTHNPTIEELINKIQLSPKIMSTSSRRLDSSSPEFYSLHPAVVILLPQQCSRSSQ

SEQ ID NO: 142865 - protein, 124 aa, Glycine max
  Coding DNA Sequence Number=SeqID_51180
MAASDIAILRDRAHIPTKKSLMELTSQDALLAQNKLLSKQLKALTETLRCAICGGAHNSGCCIPNEEPAHEVNYMGNQPRQNFNVGGYSRFQHGQPYNSQQRQWQNHPSNQFNKDQDGPSTRPQ

SEQ ID NO: 142866 - protein, 202 aa, Glycine max
  Coding DNA Sequence Number=SeqID_51181
MEEISQPKLTAHDGKGDDHNYGRYVTHSASLSLWPASGLHPRATPEDLSQAPTFEGQLPPYEDYPGQDDGEGDTHPGPLLHLKDPSPHELPQLNIACHIPASPTPVKNLFPLRKIRLCLVPNIVIPPKFKVPDFISTKGRHVQKGISGCIAGSYGGVFCGEKLLVAISFQHPKLGMIRGSCTWIPSGSSRTQWIDLACPFRV

SEQ ID NO: 142867 - protein, 36 aa, Glycine max
  Coding DNA Sequence Number=SeqID_51182
MAAECRGKKDDWRHHFKEKRSQEQAHPHKKPWIRAL

SEQ ID NO: 142868 - protein, 85 aa, Glycine max
  Coding DNA Sequence Number=SeqID_51183
MSLPSTVHLFSTVESGASRMSLPSAVRQFSTFHFHSEPHECHCLALFIHPPPKEFGAMLHDCLSVDPLVQSSILHFFRSPMNVIA

SEQ ID NO: 142869 - protein, 85 aa, Glycine max
  Coding DNA Sequence Number=SeqID_51184
AYIRKLIEFFDDISFHHIPREENQVVDALATLAFISQLTRSTSNSDVAASLSCTLLLDRRTKMVNLGSWTICQVVSRQGIPTGGL

SEQ ID NO: 142870 - protein, 20 aa, Glycine max
  Coding DNA Sequence Number=SeqID_51185
TKGAEDDVSLYVSTSLFAPG

SEQ ID NO: 142871 - protein, 133 aa, Glycine max
  Coding DNA Sequence Number=SeqID_51186
MAKFDPEIVLEFYANAWPTKEGVRDMRSWVRGQWIPFDADALSQFLGDPLVLEEGQECEFSQRRNRADGFNEEVIAQLLCPLGQDFARTAAGRRVRIMHTSMTTLTQMWMTLQLMNVLPSDHNSDLPLSKCQL

SEQ ID NO: 142872 - protein, 138 aa, Glycine max
  Coding DNA Sequence Number=SeqID_51187
  Homolog annotation: Hit_ID=A0ST23; Match level="QueryCoverage=32%, HitCoverage=91%, E-value=1e-11, Identity=73%"; Hit description =Putative reverse transcriptase
MTVKTSDTCSSRRRSQLVCKRMPGADKPVRARQRMRKEKIPHQAPFAIQAAQLLGRAIGAGLFAITPAGERGMCCKAIKLGNARVFPVIIRPGTELEFVIMVIAVSFGKPVVPAALMNRPTRGERRFAYWALFRFLAH

SEQ ID NO: 142873 - protein, 92 aa, Glycine max
  Coding DNA Sequence Number=SeqID_51188
MSVKNLVGRLGGDQSRSQCFARILQPYGINIGLKEHSNCVTPKAYTPKSPSGPLPPDSGPTQKIFQHTDSIYELYKTHDSSIVLKIALTRRP

SEQ ID NO: 142874 - protein, 142 aa, Glycine max
  Coding DNA Sequence Number=SeqID_51189
  Homolog annotation: Hit_ID=P03851; Match level="QueryCoverage=59%, HitCoverage=100%, E-value=4e-44, Identity=98%"; Hit description =Uncharacterized 9.4 kDa protein
STLEDPAVIRLSTESGDNAGKNMTIKIPGVSPWKLPRALSCSDPAAYRIPVVRSKLGCVHEPPVQPDRCALSGNYRLESNPVRHDLSPLAAATGNRISRARYVGGATEFLKWWPNYGYTRRTVFGICALLKPVTFGKRVGSS

SEQ ID NO: 142875 - protein, 263 aa, Glycine max
  Coding DNA Sequence Number=SeqID_51190
  Homolog annotation: Hit_ID=A5C0C2; Match level="QueryCoverage=29%, HitCoverage=53%, E-value=7e-10, Identity=35%"; Hit description =Putative uncharacterized protein
  Pfam annotation: Domain name=Retrotrans_gag; Domain location=82-165; Score=1.9; E_value=0.035; Accession=PF03732.8; Description =Retrotransposon gag protein
ERRRKLLQDRTIASILEEETHFSDLLSLDSPSSRESATQLPEVITMAKEHDQRITLEDYSRLPNEDPYAHLATFIEICNTVKIAGVPDEAKRWLHSFKGNSLKTWEEVVEKFLKKYFPESKTAKGKAAISSFHQSSQSPELPLMGGKIKLKTSEEATELIENMSASDHAILRDRTHQPTKKSLIELSSHDALLGQNKLLSKQLEILKETLSKLPTKLSMGQPTHSSVVQANVFPLKKTLKKFIIWEINSDKGILKEDFQASKP

SEQ ID NO: 142876 - protein, 40 aa, Glycine max
  Coding DNA Sequence Number=SeqID_51191
MASYGGVEGRSPEFEEPLDLRSNPFQDGGDDAILSPKGIG

SEQ ID NO: 142877 - protein, 97 aa, Glycine max
  Coding DNA Sequence Number=SeqID_51192
  Gene Ontology: Mol. function=hydrogen ion transporting ATP synthase activity, rotational mechanism; Cellular component=proton -transporting ATP synthase complex, catalytic core F(1); Biological process=ATP synthesis coupled proton transport
  Homolog annotation: Hit_ID=Q5ZAS4; Match level="QueryCoverage=100%, HitCoverage=20%, E-value=6e-45, Identity=94%"; Hit description=ATP synthase subunit beta
  Pfam annotation: Domain name=ATP-synt_ab; Domain location=1-97; Score= -12.4; E_value=3.7e-07; Accession=PF00006.16; Description=ATP synthase alphabeta family, nucleotide-binding domain
ALVYGQMNEPPGARMRVGLTALTMAEYFRDVNEQDVLLFIDNIFRFVQAGSEVSALLGRMPSAVVYVPADDLTDPAPATTFAHLDATTVLSRGLAAK

SEQ ID NO: 142878 - protein, 243 aa, Glycine max
  Coding DNA Sequence Number=SeqID_51193
  Subcellular localization annotation: CTP_CleavageSite=35; ConfidenceScore=5.69e-01
MGSPPASTPPPHSPPPPPPPSEASASPSAVKQTCKASRLQSLSTRPPGAERPVVHVDPATEKADGGRHLRELEGGPYCLEGPDLGGYSADQDGVEDTVCEKYGINKEKWAQFCQTRKDPSWEDVCKKAQAIQKQNTAPHVLSRGGYDYLEQKLLAEKIKKKLEEAAQSGSVDGIIDPPSLVRRHMKWKMARTKKTGEMTIEAAKEISEKIATQGSYVPHGRQYVLTTVIGRLEHPGRVRAAGA

SEQ ID NO: 142879 - protein, 47 aa, Glycine max
  Coding DNA Sequence Number=SeqID_51194
LKKGFLFAKAHLAPFSRLVQVSEFWLSVIFELSTEKTIFLLGELMTR

SEQ ID NO: 142880 - protein, 211 aa, Glycine max
  Coding DNA Sequence Number=SeqID_51195
MATPRRFIFEALQKGGVIPHGGHKEDSCLLHPGKLHNMETCLAVEELLQRMIDQGRLEVGDEGREEQHIYMQSADERSFGRPKPLVIYFTKDAAPQKPQYPPATKPVPFPYQNSHAVPWKYTPPSEREEETTDVSSLSAKVTNITGLSGVTRSGRVFAPSDLPTRSANIKGKAKMLEEQNDKTTPTPNEDIPVKGLSEKRDGCGKKEVSLE

SEQ ID NO: 142881 - protein, 191 aa, Glycine max
  Coding DNA Sequence Number=SeqID_51196
MEAIKEQMATMMKAMMSMKKIMEANAVIVAAISAVAKVNPTSPSGINQMNHPTSNMVGKDLGSMDDPMMCKFKTSTPSRHMVCLPNYTPPNVVYIPNEDVNNSTPILIKSQQPQSDHAHVSRPMEETREIPHHDLATSSLASDMPLKGKQLVVYPLKTLWRALSFAHNHNHCILRWEEPLLLWSKRERRII

SEQ ID NO: 142882 - protein, 120 aa, Glycine max
  Coding DNA Sequence Number=SeqID_51197
  Homolog annotation: Hit_ID=A6FJQ2; Match level="QueryCoverage=31%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTLVTTVVLYDANGALENPITQNDEIKEYVDS

SEQ ID NO: 142883 - protein, 300 aa, Glycine max
  Coding DNA Sequence Number=SeqID_51198
  Homolog annotation: Hit_ID=Q2HW90; Match level="QueryCoverage=56%, HitCoverage=31%, E-value=7e-24, Identity=39%"; Hit description =Putative uncharacterized protein
MASREKWGPFADILALLIFGVVLFPNVDGLVDLAAIDAFLAYHHSKESPVVAILAYLFDTFDRRCEKNSARIVCCLPALCVWLVSHLFQQDTRYPCPLQSYRSCAEKGRVDWDQHLAGIGGNTINWFPRWKEGKEGVLFSCGDYPNVPLIGTRGCINYNPALAIRQLGYPMRGAPTEESLSPFLVRDLGVQSLKELRGIRNGVIDGYHGWLRVHTRGLDWLSKLKVINEENFEAPEEDEEVQALKLELGKARLAKEKFKSVATHIRKECTELQEENAATARALEQEIKRARKEEYGREKF

SEQ ID NO: 142884 - protein, 63 aa, Glycine max
  Coding DNA Sequence Number=SeqID_51199
MFLCCRAKRASHNKWPQGRGKPQHPGPRNPMIPQDSLLRGPESDIHRTFTPGTSFQRGMLTSL

SEQ ID NO: 142885 - protein, 239 aa, Glycine max
  Coding DNA Sequence Number=SeqID_51200
  Gene Ontology: Mol. function=hydrolase activity, acting on acid anhydrides, catalyzing transmembrane movement of substances; Cellular component=proton-transporting ATP synthase complex, catalytic core F(1); Biological ...
  Gene Ontology: Cellular component=process=plasma membrane ATP synthesis coupled proton transport
  Homolog annotation: Hit_ID=P56757; Match level="QueryCoverage=92%, HitCoverage=47%, E-value=1e-109, Identity=87%"; Hit description=ATP synthase subunit alpha
  Pfam annotation: Domain name=ATP-synt_ab; Domain location=101-238; Score=85.9; E_value=1.3e-22; Accession=PF00006.16; Description=ATP synthase alphabeta family, nucleotide-binding domain
  Pfam annotation: Domain name=ATP-synt_ab_N; Domain location=1-45; Score=10.2; E_value=0.022; Accession=PF02874.14; Description=ATP synthase alphabeta family, beta-barrel domain
  Pfam module annotation: Pfam domain module=ATP-synt_ab::ATP-synt_ab _N; Domain location=101-238::1-45
MAGELVEFEEGTIGIALNLESKNVGVVLMGDGLMIQEGSSVKATGRIAQIPVSEAYLGRVINALAKPIDGRGEISASESRLIESPAPGIISRRSVYEPLQTGLIAIDSMIPIGRGQRELIIGDRQTAIGQKASSVAQVVNTLQERGAMEYTIVVAETADSPATLQYLAPYTGAALAEYFMYRERHTLIIYDDLSKQAQAYRQMSLLLRRPPGREAYPGDMAKYSYLPIYSMLESDPLLM

SEQ ID NO: 142886 - protein, 218 aa, Glycine max
  Coding DNA Sequence Number=SeqID_51201
MDMNLGYLISHQISLIAQHDTSRLGFPALIIALCKARGVQSDSRFLKNLSPAINLAYIKKNCWNLDDPTVTFRGPRKARGKSSEVSTTSAALETPASTSSIAPIPPTQTPVACPRAQPSPSGGGGASTAQEPAPKEPAAAVTEGEDELTPPEPFYFDAGIHMAQEEETSTNQIPEPSPAPIPDDVIPSAPASELEKPIFQDSPAAQVLDLNEHAHEQP

SEQ ID NO: 142887 - protein, 78 aa, Glycine max
  Coding DNA Sequence Number=SeqID_51202
HTSTNCSKELVVLTKASKVTKDQNPIIQSLTNSIFQMGHLSLLPFGLLGTPKIAKPEKTGEEVTNLKSKYLLMRNKTP

SEQ ID NO: 142888 - protein, 171 aa, Glycine max
  Coding DNA Sequence Number=SeqID_51203
MKKKKQVKDSSKPDLVKNTTKLTEESVKGNNVEVKVVHFDGPQVLDKGLEENKLVEGPIEVLEKKKGEKEVEKEKEVEGARKSFPTEKKKGAEALEKSASMAFGDNPSSGAVQANKAILCYHEGKLCSLDHEMVSKANEKTKAMVARLKAMKVTVGKTKELGLELAKSGGR

SEQ ID NO: 142889 - protein, 148 aa, Glycine max
  Coding DNA Sequence Number=SeqID_51204
  Subcellular localization annotation: CTP_CleavageSite=57; ConfidenceScore=5.16e-01
MGVVERCVRESGSCQSKSRLVSSTSRRGAVERTGAANSFVSTRWTTTVYNRQVVEVRYDEKEARGWEHLPFQWVEPVPNATSGTLVARQAAATRGLLELPCAYEYNVVEDSGQTGQIVYEWSYSSNHEDIVLDRRHRLRKMGGPDRRK

SEQ ID NO: 142890 - protein, 134 aa, Glycine max
  Coding DNA Sequence Number=SeqID_51205
MDFTKIVEISSGLLEYCTQEILAEQEADRVHGLPRQPMVKFDNMVVISLSMKLKEEHCSIGFLRPLTNQNKKSFSYGLMEAVVGLTQHSNAKPVADSSFSKAKPEHSLDSQFKPLEASQLVSVFTILFLFGCSN

SEQ ID NO: 142891 - protein, 55 aa, Glycine max
  Coding DNA Sequence Number=SeqID_51206
MVVVGGGGLDDEGMSSALALFLEAISKWVAQLSHYHKELRLAQGYLAQGYWLSLT

SEQ ID NO: 142892 - protein, 99 aa, Glycine max
  Coding DNA Sequence Number=SeqID_51207
  Homolog annotation: Hit_ID=A5ZQM3; Match level="QueryCoverage=65%, HitCoverage=92%, E-value=2e-19, Identity=53%"; Hit description =Putative uncharacterized protein
VLLGGPEPSVRYHSGRARILTLCQDLRAEGQSQAEGSLTARPTRRAGTKVGLSDPTVPSGRAVAQRIKGWAVRPLKRYVSWVQNVVRQFGPYPVWALEH

SEQ ID NO: 142893 - protein, 40 aa, Glycine max
  Coding DNA Sequence Number=SeqID_51208
MDGILISSVLADSRFTRPDMGYHPTKLNFVPSDADEAPLD

SEQ ID NO: 142894 - protein, 61 aa, Glycine max
  Coding DNA Sequence Number=SeqID_51209
MGGMCEEFKIQHPNSTPYRPKIERSSGGSHEEYLEDYPEDDCAHTRTGTRCSHSPYMGTEP

SEQ ID NO: 142895 - protein, 133 aa, Glycine max
  Coding DNA Sequence Number=SeqID_51210
APVSLALARPRRARCDKKPTSKSYGSHSYPKKDQGQGILGVAPSKPKDDKGKNRKRKEEQSLMVKEQSKEVSVSSKMLAKKESHFEIKTNIKETFLLRQPLHLLLCKRTLVTTVIPLELEVIPQVKELLDEGL

SEQ ID NO: 142896 - protein, 89 aa, Glycine max
  Coding DNA Sequence Number=SeqID_51211
MVAKTQRNRGALGNKWEGNIGSKGLSKELIQGRLIWLEAYKNKMPKSSPNMHGKQEVSTRVKPRLLCKQSTGQNTQNKIDDDGSNSHQG

SEQ ID NO: 142897 - protein, 133 aa, Glycine max
  Coding DNA Sequence Number=SeqID_51212
  Subcellular localization annotation: CTP_CleavageSite=76; ConfidenceScore=5.54e-01
MPISPCGSISWSVPSRHRDRTHKTPSGPGKVQQGPGVSSSGYGPLSVLQGARTPPARSRHHRDRACKTPSGPEEVQQGLGGSTEYLSPPARASGPLLIELSSRSTASPGRRRAKHHSSLGMAGSGQQTHRHHL

SEQ ID NO: 142898 - protein, 162 aa, Glycine max
  Coding DNA Sequence Number=SeqID_51213
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=3e-15, Identity=32%"; Hit description= UPI00006A17C9 related cluster
  Subcellular localization annotation: CTP_CleavageSite=74; ConfidenceScore=5.31e-01
MLVRMIHTRLFAAARVKSCPGMHSSCVIASLSGCACTVARPPILGGGPGTVRMWSTLKMRTRSPLEVRACSPLKARMCSPPEERACSPLKVRACSPLLARTCSPLKVRACSPLLARTCSPLKVRACSPTKVRTCSPLMARACSPLKVRTCSPLMARTCSPLQ

SEQ ID NO: 142899 - protein, 91 aa, Glycine max
  Coding DNA Sequence Number=SeqID_51214
MDFAASKRICRDREMFDTFKTDGEFGHFKLGNDGKIKVKGIRSIRMTLHDGAIRTLSNVRDDITRVKVCWFKVGMQGVQQETLGVARIEKQ

SEQ ID NO: 142900 - protein, 28 aa, Glycine max
  Coding DNA Sequence Number=SeqID_51215
MGERKRKRKEGKKAPDQGSKENRRNVQR

SEQ ID NO: 142901 - protein, 62 aa, Glycine max
  Coding DNA Sequence Number=SeqID_51216
MEKSEKKNINEKKLKKAYITWDENDLESSEDSENEEINLCLMAKSYESDEEENKDMPPIRLD

SEQ ID NO: 142902 - protein, 159 aa, Glycine max
  Coding DNA Sequence Number=SeqID_51217
  Homolog annotation: Hit_ID=Q2HW78; Match level="QueryCoverage=29%, HitCoverage=8%, E-value=5e-07, Identity=53%"; Hit description=RNA -directed DNA polymerase
MEWILPTPTPYRLVEPVQVIEVTSSEEDPEEDPEELPPEPAVDALDFLEGDEDPLPEVDSPEDVMSASEADSTEDSGPGEMAIRRGRDQNRDVLDRITVVLETLVQERDVEPAEYRGLMAFRKNHPPKFSGDYDPEGARLWLAETENIFEAMGCLEEHK

SEQ ID NO: 142903 - protein, 168 aa, Glycine max
  Coding DNA Sequence Number=SeqID_51218
  Pfam annotation: Domain name=G-patch; Domain location=2-41; Score =26.3; E_value=0.00011; Accession=PF01585.14; Description=G-patch domain
MARVMLGNGYEPGMGLGKDNGGITSLINAKGNRGKCGLGYKPTQADIKRSIAGRKNGGQSSRLRQESEGSPPCHISRSFINAGLGDEGQVVAIYKDDVPSTLDLVRPCPPDFQLGNWRVEERPGIYATSIISDDESPEGTNTWDPLINFEQETNQTEDEGNEDVGLPP

SEQ ID NO: 142904 - protein, 127 aa, Glycine max
  Coding DNA Sequence Number=SeqID_51219
MGKVEEVQEKMKADMEAMKEQMATMMEAMMSMRKIMEANAVVVAATSAVAKAKLWEVRAAPIMRKFKTSMPSHHMACLPNYTPPNVAYTPNENVNNSTPILIESQQPLIMHMTLDPWGRHIKCPTTI

SEQ ID NO: 142905 - protein, 121 aa, Glycine max
  Coding DNA Sequence Number=SeqID_51220
MEAMKDQMTTMMEAMMSMRKMMEVNVVVSSLQVPPLRASILSHNMACLPTMHHPMLYMGMMRMLTTPLLYPSRANNLSLGMRMSLNPWGRRMKYPETTLWLTSSLTSDMPPRGKHLVAYPN

SEQ ID NO: 142906 - protein, 188 aa, Glycine max
  Coding DNA Sequence Number=SeqID_51221
  Homolog annotation: Hit_ID=A5C7Z4; Match level="QueryCoverage=42%, HitCoverage=28%, E-value=5e-09, Identity=37%"; Hit description =Putative uncharacterized protein
AAVSPEKPPQKPNPEVNDPFYLMTLIIPELFLRPYQVTWDVIVFRVFNPDFLLYIKHEDLSEIAHGGKCLSISVLQLWILGHWQMVVIVPKEHLVVWFCSLHNRPDNYLKGTINIALKGLDDAPQPKSKAHARWIIVKCNRQKGSTECGYYVMHWMSTIILGSFKNNWEAYFNDPRPLEPQRLKALQI

SEQ ID NO: 142907 - protein, 101 aa, Glycine max
  Coding DNA Sequence Number=SeqID_51222
  Subcellular localization annotation: CTP_CleavageSite=83; ConfidenceScore=5.01e-01
RLTSSSTPFVIQGQRVGWWAEIPYGHPSLSSTERNKFGSVRMILVIRCLSFSKFFEGFFTLVVRKHSSPAMCGVLLCWAETIRCNGKGKCRGCPTLSFSKH

SEQ ID NO: 142908 - protein, 150 aa, Glycine max
  Coding DNA Sequence Number=SeqID_51223
MAPKKLPAKRSRKEATCKGSSAAPQANMDFDRHRDEEYVEFQEEIARRQWAQLVSPMAKFDPEIVVEFYANAWLIEKGVRDKRSWVRGQWISFDEDAINQILGHPLVLEEGRHCEFSQRAGLCPEGSRGMGADHVHQHDHPHADLDDVAA

SEQ ID NO: 142909 - protein, 57 aa, Glycine max
  Coding DNA Sequence Number=SeqID_51224
EMAPKKLPAKRSRKEATCKGSSAAPQANMDFDRHRFRSVEHQQRFEAIKGWSFLKKR

SEQ ID NO: 142910 - protein, 144 aa, Glycine max
  Coding DNA Sequence Number=SeqID_51225
  Homolog annotation: Hit_ID=UPI00006A2939; Match level="QueryCoverage =75%, HitCoverage=75%, E-value=3e-09, Identity=34%"; Hit description =UPI00006A2939 related cluster
MSSPSKGYMPSPSEDCVSSPSERLHALAIRGLHVLTFRGLHALAIRGLHVLTFVGLHALTFRGTTRLHALTFRELHVLANRGLHALTFRGLHILAFRGLHVLTLRGLHVLALRGLHVLTIRGLHALTFRGLHVLANREAARPHL

SEQ ID NO: 142911 - protein, 90 aa, Glycine max
  Coding DNA Sequence Number=SeqID_51226
  Subcellular localization annotation: CTP_CleavageSite=41; ConfidenceScore=5.18e-01
MAASSSYSSNLVGSMTLLQIALKTKHRHFMATRTLTDKIPRIATGMEETWRRLWLRSNSDFGLVIDYRTNKPTGNRLQDVVIDYRLPVHV

SEQ ID NO: 142912 - protein, 129 aa, Glycine max
  Coding DNA Sequence Number=SeqID_51227
MTVKTSDTCSSRRRQARQGASAGVGGCRGWLNYAASEQIVLRVHHMRCEIPHRCVRRKYRIRRHSPFRLRNCWEGRSVRASSLLRQLAKGGCAARRLSWVTPGFSQSRRCKRRPVPSLHACRSTLEDPP

SEQ ID NO: 142913 - protein, 161 aa, Glycine max
  Coding DNA Sequence Number=SeqID_51228
  Homolog annotation: Hit_ID=A2Q6B4; Match level="QueryCoverage=97%, HitCoverage=71%, E-value=1e-10, Identity=25%"; Hit description =Ribosomal protein L33; Nucleic acid-binding, OB-fold
MARIPNKIKSIDGSKETLKLVVRITDLWFVGTPNKSEQAEIVFLDSEGDQIHAVCKLDHLKSWKADLKENSTYVMHNFKVVKNDVTIVREADLHELPFKEFRFVEFANVVAGNFMAGLLVDIIGLVDQVVFRHVSSKNSRLVFRMKDLRVYIVEDFIYHVA

SEQ ID NO: 142914 - protein, 49 aa, Glycine max
  Coding DNA Sequence Number=SeqID_51229
MITLTIEHKSLLIEFPSGNGKLDEAISILEGQPIPCVQESLQLKRPSVP

SEQ ID NO: 142915 - protein, 122 aa, Glycine max
  Coding DNA Sequence Number=SeqID_51230
MTPPRLPLWHRGWATYQDVFLARHNNQMPLYYEFQFLVECRGNDPYRVNPRASQKTAVSQVNIHYLEGRSISPLTSRRVPSKAQTTMELGFRWEALNNNFSNVLLGITFKLEPLSMSTLATT

SEQ ID NO: 142916 - protein, 104 aa, Glycine max
  Coding DNA Sequence Number=SeqID_51231
  Homolog annotation: Hit_ID=Q2HTU8; Match level="QueryCoverage=98%, HitCoverage=37%, E-value=9e-09, Identity=31%"; Hit description=H+ -transporting two-sector ATPase, alpha/beta subunit, central region, related
MEFSWRRLLYDNEIDIAINFLREVQGQSIQQQQIGIWEWIGDSSRIYTTRSAYNLIWEEITGGQKEDWSMELWKTKIPSKIAVFSWRLCRGRLPTKENLRKRNI

SEQ ID NO: 142917 - protein, 36 aa, Glycine max
  Coding DNA Sequence Number=SeqID_51232
IASRMLKIIMLKIRMFKITNNRMHRFTSYGMLRMIK

SEQ ID NO: 142918 - protein, 144 aa, Glycine max
  Coding DNA Sequence Number=SeqID_51233
  Gene Ontology: Mol. function=lyase activity; Cellular component=cell outer membrane
  Homolog annotation: Hit_ID=A7ZHR7; Match level="QueryCoverage=100%, HitCoverage=17%, E-value=6e-71, Identity=96%"; Hit description=Outer membrane protein assembly factor yaeT precursor
  Pfam annotation: Domain name=Surf_Ag_VNR; Domain location=24-91; Score=47.9; E_value=3.4e-11; Accession=PF07244.6; Description =Surface antigen variable number repeat
MAMKKLLIASLLFSSATVYGAEGFVVKDIHFEGLQRVAVGAALLSMPVRPGDTVTDDDISNTIRALFATGNFEDVRVLRDGDTLLVQVKERPTIASITFSGNKSVKDDMLKQNLEASGVRVGESLDRTKLADIEKGLEDFYYSV

SEQ ID NO: 142919 - protein, 119 aa, Glycine max
  Coding DNA Sequence Number=SeqID_51234
  Subcellular localization annotation: CTP_CleavageSite=79; ConfidenceScore=5.15e-01
MTVKTSDTCSSPETVTACLCVRRKYRIRRHSPFRLRNCWEGRSVRASSLLRQLAKGGCAARRLSWVTPGFSQSRRCKTTASAKLACLQVDSRGSPTGLLFFTGQYLLSDKHPNTWGTLP

SEQ ID NO: 142920 - protein, 71 aa, Glycine max
  Coding DNA Sequence Number=SeqID_51235
MDPKRIKVILEWPTPPSVEERIHEFQEPLDFRSKTFQGGGNHDMNGSRMEKEEREETPLQGEDESRRNSPP

SEQ ID NO: 142921 - protein, 206 aa, Glycine max
  Coding DNA Sequence Number=SeqID_51236
  Homolog annotation: Hit_ID=UPI0000ECBAF8; Match level="QueryCoverage =19%, HitCoverage=48%, E-value=3e-16, Identity=100%"; Hit description= UPI0000ECBAF8 related cluster
ELPGERPGIVIVRSGFATSDLSVDFCDARQGDGAYGKTPATRPFYGSWPFAGLLLTCSFLRYPLILWITVLPPLSELIPLAAAERPSAATGTTGFPTGKRAVSATQLIYDHDYEFELGTPRASHKGRRHHFRSSSKLFQVFLNLSSIKLSRPAGMQAWHWPSFYNVVTGKTLALPNLIALQHIPLSPAGVIAKRPAPIALPNSCAA

SEQ ID NO: 142922 - protein, 143 aa, Glycine max
  Coding DNA Sequence Number=SeqID_51237
MVAFFQGNNLKTWEEVVEIFLKKYFPESKIAEGKSKQLLDASARGKIKLKTPEEAMELIENMDASDRAILRDRSHVPTKRSLLELSSQDAMLAKNKLLVKQLESLTETLSKLPTQLQAAQPSQLAIIQVGGCSICGGAHESSC

SEQ ID NO: 142923 - protein, 91 aa, Glycine max
  Coding DNA Sequence Number=SeqID_51238
MSSGPPPLDDKRGRMTIICLCVPSDMTVPEWQKVSGMTIICLHVSSGPPPLDDKTRRMTIICLCMPSDTTVSEWQKNDHNLSLRAIGHDCV

SEQ ID NO: 142924 - protein, 124 aa, Glycine max
  Coding DNA Sequence Number=SeqID_51239
  Gene Ontology: Mol. function=protein kinase activity; Biological process=protein amino acid phosphorylation
  Homolog annotation: Hit_ID=Q2QZ78; Match level="QueryCoverage=64%, HitCoverage=14%, E-value=1e-17, Identity=56%"; Hit description=AT hook motif-containing protein, putative
MEVVMPDNGGFFFFIYEYGGTRKTFIWNALSATIEVEALDRTLRHIMRTKNSNSSEQPFEGKVVVLGGDVRHILPVIPKGSIQYIISIAVNSSYLWKFCELLKLTQNEVKITVSNENATDIQVC

SEQ ID NO: 142925 - protein, 160 aa, Glycine max
  Coding DNA Sequence Number=SeqID_51240
  Gene Ontology: Mol. function=protein binding; Cellular component =anaphase-promoting complex; Biological process=regulation of mitotic metaphase/anaphase transition
  Homolog annotation: Hit_ID=A7PUT4; Match level="QueryCoverage=28%, HitCoverage=23%, E-value=7e-18, Identity=91%"; Hit description =Chromosome chr4 scaffold_32, whole genome shotgun sequence
  Pfam annotation: Domain name=APC10; Domain location=65-160; Score= -72.0; E_value=0.0043; Accession=PF03256.7; Description=Anaphase -promoting complex, subunit 10 (APC10)
MNAKRREDIVGVLPKRKILMRPSAPVIGSDGCSPDWQTVFLKEEDHRHEGRVVNSRMGFQKLSGGREDEEPPIEEKLKKTLHCCWNCVGRRKPYTALGTVVGAQSSKLSTLPVNKLDESYTPSKVSIRAGDGFHNLKEIKTVELLKPTGWVYLSLSGVDP

SEQ ID NO: 142926 - protein, 156 aa, Glycine max
  Coding DNA Sequence Number=SeqID_51241
  Subcellular localization annotation: CTP_CleavageSite=41; ConfidenceScore=5.37e-01
MEKPSKKRKGSSSTAAAAAHRRHGPSEAPTTPIHPSLSSPRSSTLFSSDDQRLRYLSQFSSRIILDPKYLDIDFFNDKMFDCYQVFQNSGLVDFMSLKLPHYPELVKVFYCNLKIQDGIISSEVHGIPMIIDQSLFFSLTHLPSQGAPFEGTIAND

SEQ ID NO: 142927 - protein, 182 aa, Glycine max
  Coding DNA Sequence Number=SeqID_51242
MEFGDIVVHFNILDATKHPSKDHSIFRAEILDQIVDDYMFDFNSLHGWKHPFLSDLHICHPPCNESEFEFDPVFDFYAESKFEFESGSDFLGVVPLDVDFLESECTNHVAGSTYTSDLLYEVQAEESSSSPTLVPPTVQPPPTPELRPLPANLKYAYLEDKEKFPVIIFASLAAEQEEKLLL

SEQ ID NO: 142928 - protein, 63 aa, Glycine max
  Coding DNA Sequence Number=SeqID_51243
MEKKNRFLEEGAAQYERFFNFLIKDAKIPKGEGKRVILRLFLNPGSPRLAYVSPGPPNNFMVK

SEQ ID NO: 142929 - protein, 129 aa, Glycine max
  Coding DNA Sequence Number=SeqID_51244
MANDGLISDLASLTFLGPPWRECRNAHAQRGVNPQYHTHFVKGEKKKKKKKKKKKKKKKKKKKKKKKKATKLYRNPLLPRACFRVMILKHPAKAGCGCGAWCSTRASRPEPPEPNLTLNPPHPEPEANE

SEQ ID NO: 142930 - protein, 99 aa, Glycine max
  Coding DNA Sequence Number=SeqID_51245
  Subcellular localization annotation: CTP_CleavageSite=85; ConfidenceScore=5.44e-01
MGAKYLGVRTTCPHLQRATHPCLQRATHPRLQRATYPRLQRATRPPLQRTTRPRLQRTTRPHLHRATRPCLQRTTVLVFRGLHVLAFRGLHVLDQVASE

SEQ ID NO: 142931 - protein, 137 aa, Glycine max
  Coding DNA Sequence Number=SeqID_51246
MVFPSKLPLQFPFEYLTGNQFRFQCMQLKDDADVNTMLMCNHEFSFVGPIELLCSIARIPDGILNLLETTMTHTYDALLYYNGRWNMSRQNEFVGYSFTGKNPKNFDIPTGCTMDELKDLIKQVAPRGIPPYGVDET

SEQ ID NO: 142932 - protein, 246 aa, Glycine max
  Coding DNA Sequence Number=SeqID_51247
VGAIKWVNFNGKPSAKPMDFQLVPTVEEFEEILGCPLGGRKPYLFFGFYPSTTRVAKGKVPWKIKANGLSFIDILVLLIFGVVLFPNMEGLVDLAVIDAFLAFHHGKESPVVAILAMYDTFDRGCEKSGARIVCCALALYVWLVSHLFLQEGRPVYPLQGRKNQDSIFMRRMSKCSLDGTRGCINYNPVLAIRQLGYPMKGVPSDESITPFIARGFSDPNARDRELRGSSNGSIGDYHKWLRVRTQ

SEQ ID NO: 142933 - protein, 88 aa, Glycine max
  Coding DNA Sequence Number=SeqID_51248
  Pfam annotation: Domain name=Retrotrans_gag; Domain location=9-88; Score=4.7; E_value=0.019; Accession=PF03732.8; Description =Retrotransposon gag protein
MSDPERLLKYFCAAILHKHCTARGNSLKTWDEVVEKLLKKYFLESNTAEGKAVISSFHQFPDESLSEALERFHGLLRKTPTHGFSKSI

SEQ ID NO: 142934 - protein, 181 aa, Glycine max
  Coding DNA Sequence Number=SeqID_51249
  Gene Ontology: Mol. function=nucleic acid binding
  Homolog annotation: Hit_ID=Q2AA09; Match level="QueryCoverage=98%, HitCoverage=59%, E-value=2e-09, Identity=28%"; Hit description =Retrotransposon gag protein
MERSMIDAASGGALGDMTPAEARNLIEKMASNSQQFSARSDAIVIRGVQEIATNSSSSAETKKLEGKLDALVNLVTQLTMNQKSAPVARLCGLCSSTDHHTDLFPSVQQSEAIEQPEVYAANIYNRPPQPQQQNQPQQNNYDLSSNRYNPGWRNHPNLRWSNPSQQQQPYFQNVAGPSRPY

SEQ ID NO: 142935 - protein, 207 aa, Glycine max
  Coding DNA Sequence Number=SeqID_51250
  Gene Ontology: Mol. function=protein dimerization activity
  Homolog annotation: Hit_ID=A7QTU3; Match level="QueryCoverage=31%, HitCoverage=10%, E-value=3e-24, Identity=80%"; Hit description =Chromosome undetermined scaffold_171, whole genome shotgun sequence
  Pfam annotation: Domain name=DUF659; Domain location=67-190; Score =7.3; E_value=6.1e-08; Accession=PF04937.6; Description=Protein of unknown function (DUF 659)
MTVKTSDTCSSRRRSQLVCKRMPGADKPVRARQRMRKEKIPHQAPFAIQAAQLLGRAIGAGLFAITPAGERGMCCKAIKLGNARVFPVDSRGSPPSRTFFHKSVDASAYFKNTKWLADLFDSVIQEFGPENVVQIIMDSSVNYTVIANHIVQSYGTIFVSPGTELEFVIMVIAVSFGKPVVPAALMNRPTRGERRFAYWALFRFLAH

SEQ ID NO: 142936 - protein, 53 aa, Glycine max
  Coding DNA Sequence Number=SeqID_51251
ISLSKIKAPVQGFTLFARMLQPYDQIGLKEHSNPVTPKAYTLKSLIPSDLGPT

SEQ ID NO: 142937 - protein, 59 aa, Glycine max
  Coding DNA Sequence Number=SeqID_51252
MKKHDKGRRKSGHFQKDYLKCKSWFEKKSELNAHRLLTIQTISPNEKFVFMGNKVKAPV

SEQ ID NO: 142938 - protein, 176 aa, Glycine max
  Coding DNA Sequence Number=SeqID_51253
MGDQEETQEQMKADMSALKEKMASMMEAMSGMRQLMENNVATAAVVSSAAEADPTLPATAHHPLPNAVGREKSTLGHINNPHLGYNWVAYPYGLPPNYTPPVMRDDMGHVPSPILEGEPPRQPDEVHEDHREYAQGDVDFYSPVPIEGPAPNTLPQHNQYSCPQRDHPIGGRKKET

SEQ ID NO: 142939 - protein, 135 aa, Glycine max
  Coding DNA Sequence Number=SeqID_51254
MELIENMAASDHAIMCDRTHVGGCSIYGGAHESGCCIPLDDAAKEVNYMGNQNRQGFNAGGFLDYQQGPSLYERKTKLEETLAQFMQVSMSNHKSTESAIKNLEIQVGQLAKQITENSSGGFGANTKKNPKEECQ

SEQ ID NO: 142940 - protein, 111 aa, Glycine max
  Coding DNA Sequence Number=SeqID_51255
ATLPEGRKADRYPVSGRVGTGERTRELPGGNAWGAEPMEKRQQRGLRSAPIAAVPNEIAQLSQWRKREDAVLQLRMRYFTPHMVHSQYNRALSRIVNASWHRQVPTGKPGQ

SEQ ID NO: 142941 - protein, 158 aa, Glycine max
  Coding DNA Sequence Number=SeqID_51256
  Homolog annotation: Hit_ID=Q6WAY6; Match level="QueryCoverage=82%, HitCoverage=22%, E-value=5e-09, Identity=30%"; Hit description =Putative uncharacterized protein
VRTVDGTPPDVSLPQGVRKDFRFDHSGVPTVEEFEEILGCPLGGRKLYLFSGFLPSLSKIAVVVRDSARELDRVKQTQNGVVGLPRKYLEGKARDMANQEEWVPFADVLALLIFGVFLFPNVDGLVDLAAIDAFLAYHHSKESPVVAILADLFDTFDQ

SEQ ID NO: 142942 - protein, 316 aa, Glycine max
  Coding DNA Sequence Number=SeqID_51257
  Gene Ontology: Mol. function=monophenol monooxygenase activity; Cellular component=chloroplast; Biological process=metabolic process
  Homolog annotation: Hit_ID=A2IAT9; Match level="QueryCoverage=99%, HitCoverage=87%, E-value=8e-28, Identity=44%"; Hit description =Polyphenol oxidase
  Pfam annotation: Domain name=Tyrosinase; Domain location=36-204; Score=-53.5; E_value=2.3e-07; Accession=PF00264.11; Description =Common central domain of tyrosinase
RDVLIGFGGLYGASTLTNNNNPPLAIAARVLPPDLKTHQLLRPISSTIIDFKLPSPRTALRVRPAAHLVNDVYIDKYREALERMKALSLNDPRNFTLEANVHCAYITVMRILGNLIGNPTFALPFWNWDNHKVGNSQGSSLEALIVLEMNLNLAGTFENVPHAPVHSWTESSFLFNYENKNLVRVKKKDSLDTRNVYQDVDIPWLKNKPKPKRSKAKKVALLAQDFNFGFKAVKFDVFINDEDNKVIRPSNTEFAGSFVSVSHSHVHKNKKIKTCFRVGLTDLLEDLEAENDDSILMTSVPKYGKGLVTIQGIILR

SEQ ID NO: 142943 - protein, 26 aa, Glycine max
  Coding DNA Sequence Number=SeqID_51258
MTVVQHEGSGWWQREKVANTIGTQNV

SEQ ID NO: 142944 - protein, 24 aa, Glycine max
  Coding DNA Sequence Number=SeqID_51259
MANMSPYLTQITSYMLQRVFKLQA

SEQ ID NO: 142945 - protein, 365 aa, Glycine max
  Coding DNA Sequence Number=SeqID_51260
  Gene Ontology: Mol. function=monophenol monooxygenase activity; Cellular component=chloroplast; Biological process=metabolic process
  Homolog annotation: Hit_ID=A2Q4Q3; Match level="QueryCoverage=98%, HitCoverage=66%, E-value=1e-105, Identity=49%"; Hit description =Tyrosinase
  Pfam annotation: Domain name=Tyrosinase; Domain location=1-250; Score= 232.1; E_value=1.3e-66; Accession=PF00264.11; Description=Common central domain of tyrosinase
MKALPPDDPRSFIQQANIHCAYCDGGYKQVEFPKLDFKVHNSWLFFPFHLWYLYFYEKILGKLIDDPTFALRFWNWNNPDVAWDKIHQPPTLVDLNYSKNNDGSANVENNLCVVYKSVVSCGKTPSVFLGKPFHPGEEPNNSAGSVESVPHTPVHIWTGDRNQPNGEDMGRFYSAGRDPIFYSHHANVDRMLNISKTIKGGKRRDVTDPDWLETAFYFYDENKNLVRVTIKDSLDTKKLGQNPKNLEKLRRWHAQHFGVGAAQAAEARPSVKFPLTLNSKRSKPRSWNENEEEEKGVEEVLVIDVEYDSTDGVRFDVFINNQGDNEIGPQDSEFAGSFVTLPHSPHVNHNNITKASFRLGSNKRR

SEQ ID NO: 142946 - protein, 45 aa, Glycine max
  Coding DNA Sequence Number=SeqID_51261
MSDDGRQHTSLFVTRVNKNRKDKGKKLKTKTASLREGSKFPSHPR

SEQ ID NO: 142947 - protein, 118 aa, Glycine max
  Coding DNA Sequence Number=SeqID_51262
MPAHHAYRRKLHCVPHKNHLYSGCSADSVREREKEIQNEWRRTTNGGDEQRADLDNEQQTRGEGENNSDRRLTTGIDRREGDHEQITSRKGAATNRLQQGRERPQGREIGGEQQQANE

SEQ ID NO: 142948 - protein, 638 aa, Glycine max
  Coding DNA Sequence Number=SeqID_51263
  Gene Ontology: Mol. function=double-stranded RNA binding; Cellular component=intracellular
  Homolog annotation: Hit_ID=A7QYP0; Match level="QueryCoverage=98%, HitCoverage=61%, E-value=0.0, Identity=63%"; Hit description =Chromosome undetermined scaffold_252, whole genome shotgun sequence
  Pfam annotation: Domain name=dsrm; Domain location=459-522; Score =48.1; E_value=3.1e-11; Accession=PF00035.16; Description=Double -stranded RNA binding motif
MAERDYALEMWRLLDPDSNLINSKELLGRIVCVKSGLKKSLFNVFQDGLCHPKMALVIDDRLKVWDEKDQPRVHVVPAFAPYYAPQAEASNTIPVLCVARNVACNVRGGFFKDFDDGLLQKIPQIAYEDDIKDIPSPPDVSNYLVSEDDGSISNGHRDPFLFDGMADAEVERKLKDALSAASTIPVTTANLDPRLTSLQYTMVPSGSVPPPTAQASMMPFPHVQFPQPATLVKPMGQAAPSEPSLHSSPAREEGEVPESELDPDTRRRLLILQHGQDTRDHASAEPPFPVRHPVQTSAPHVPSSRGVWFPAEEEIGSQPLNRVVPKEFPVDSGPLGIAKPRPHHPSFFSKVESSISSDRILHDSHQRLPKEMYHRDDRPRLNHMLSSYRSFSGVICFSDLILNVIPAGFEPSPYGIVLRQLPTIRTKNAGDDIPFSRSFSSHRDLDSESGHSVLHADTPVAVLQEIALKCGTKVDFISSLVASTELQFSMEAWFSGKKIGHRVGRTRKEAQNKAAEDSIKHLADIYLSSAKDEPGSTYGDVSGFPNVNDSGYMGIASSLGNQPLSKEDSASFSTASPSRVLDPRLDVSKRSMGSISSLKELCMMEGLDVNFLSAPAPVSTNSVQKDEVHAQFFVPSID

SEQ ID NO: 142949 - protein, 341 aa, Glycine max
  Coding DNA Sequence Number=SeqID_51264
  Gene Ontology: Mol. function=metal ion binding
  Homolog annotation: Hit_ID=A2Q4Q8; Match level="QueryCoverage=72%, HitCoverage=97%, E-value=9e-97, Identity=70%"; Hit description=Zinc finger, RING-type
  Pfam annotation: Domain name=zf-C3HC4; Domain location=220-253; Score= 3.3; E_value=0.038; Accession=PF00097.16; Description=Zinc finger, C3HC4 type (RING finger)
GEDVGAYACSDKFTVLAFKNGIEATRSTLFLSLHCVTLSHTQTRARNIIAQGFGMYVASMRKSFKDSLKVLEADIQHANTLVITVAKGVGDCHVRASDFPREYDGACLQMRMSYSPAAHLFLFLVQWTDCHLAGALGLLRILIYKVYVDGTTTMSTHERKASIREFYAAVIYPSLLQLEKGVTDTEDKKQKAVCMERYRRRDDEEYRQSSDIDIEREDECGICMDMNSKIVLPNCNHAMCLKCYRECLKRVNSGDLWVFTDRRDVVDMATVTRENLRRLFMYIDKLPLIVPDSLFDTYDSHIRMRMRSVQAAKSVFLLVQKMPAGMSDSWVALSYGLEGKG

SEQ ID NO: 142950 - protein, 455 aa, Glycine max
  Coding DNA Sequence Number=SeqID_51265
  Gene Ontology: Mol. function=RNA polymerase II transcription factor activity; Cellular component=nucleus; Biological process=regulation of transcription, DNA-dependent
  Homolog annotation: Hit_ID=Q680U9; Match level="QueryCoverage=95%, HitCoverage=96%, E-value=1e-157, Identity=59%"; Hit description=MRNA, complete cds, clone: RAFL22-33-O09
  Pfam annotation: Domain name=Tfb2; Domain location=13-363; Score =117.1; E_value=5.2e-32; Accession=PF03849.5; Description =Transcription factor Tfb2
MPEVRIIAKNFMDMVASMPAMKLDKLYENGFICEAILRSVPPLAKKYVIQMLHIDVPVAAKLLEEWVLPAGVSKHRVAIDRLVQLRVFLEAVDRKNEKTYKVNPTFQRSLQKLLVQGGTLPRESMPSNITVRLPTLENLEAYALEQWELMDTNAQLWYIIREYISNSEVALTSVMKPSPVIDLVEGFGDLTGRVNCMTNLVRPPGLGWTSPTGRDRGVDAADLISFMLELSFHVIGEAYSVDTLTSFQRTIINDLADLGLVKIQQGRKGSWFIPTKLATNLSMSLADSSSRKQGFVVVETNFRVYAYSTSKLHCEILRLFSRVEYQLPNLIVGAITKESLYSAYENGITAEQIVTFLQQNAHPRVAERVPSVPENVTEQIRLWEADLNRVEMTDTYYYDEFPSRDVFEGACDCAREWNGLLWEDSKKMHMVVKTEKCQVYHQADRWGVQVVALAS

SEQ ID NO: 142951 - protein, 241 aa, Glycine max
  Coding DNA Sequence Number=SeqID_51266
  Gene Ontology: Mol. function=metal ion binding; Cellular component =integral to membrane; Biological process=ubiquitin cycle
  Homolog annotation: Hit_ID=A5B310; Match level="QueryCoverage=89%, HitCoverage=87%, E-value=5e-68, Identity=58%"; Hit description =Putative uncharacterized protein
  Pfam annotation: Domain name=zf-C3HC4; Domain location=34-80; Score =28.9; E_value=1.8e-05; Accession=PF00097.16; Description=Zinc finger, C3HC4 type (RING finger)
MALEHYLSQEWKTSPSPSPSPMTVTENLDGCFDCNICLDFAHEPVVTLCGHLYCWPCIYKWLHVQSASLAPDEHPQCPVCKDDICHTTMVPLYGRGQGIAHSDRDGKASSYRGSFIPPRPPALGAQSLMSTSSQSAQQLPYRNPYQNQHFNPPLYQDEDESSSQMLNPGANMVAPGFPHLVVGMFGEMLYARVFGNSENLYNYPNSYHLGGNKCNRNYVAVKYAVADGLSEKSFPLKILRE

SEQ ID NO: 142952 - protein, 102 aa, Glycine max
  Coding DNA Sequence Number=SeqID_51267
MQSQQTVKEEDDEGPPPGWQPLPAQPPPPPRPSDIPERVLDFFILVFDHHCMKLGINLITLTGKLCEQVGLKWFAVLVVACFHIHEVPNMSNVHAVRLSTLY

SEQ ID NO: 142953 - protein, 495 aa, Glycine max
  Coding DNA Sequence Number=SeqID_51268
  Gene Ontology: Mol. function=small conjugating protein ligase activity; Biological process=regulation of protein metabolic process
  Homolog annotation: Hit_ID=A7R7R4; Match level="QueryCoverage=92%, HitCoverage=55%, E-value=1e-148, Identity=55%"; Hit description =Chromosome undetermined scaffold_1973, whole genome shotgun sequence
MDPIISDSDWETSSDSNSSEDQEEIDFLYGGKAQSILSSLEESIGRIDDFLSFERAFVHGDVVCSLSDPSGQMGRVTSVDLFVDLESIKGKVLKNVNSKKLLRIRSISEGDYVIKGPWLGRVQRVVDKVTVLFDDGAKCDITALEREKLLPLTGNFPEDWQFPFYPGQRVKVKFSSASKSTRWLCDTWRDNHDEGAVCAVEAGLVYVNWISHVLVGCNLSMSAPKCWQDSKNLTVLSFFSHANWQLGDWCMLSVADQKEQITQQAPIGDLTMEHCVSRGYKRSNLNSNIGELFIIGKIKTKVDVVWQNGEHTLGLDPENLLPVNVINTHEFWPHQFVLEKGASDDPPKASSQRWGVVQCMDAKECTVQVQWKTMSTSDPNNLAGDKLEETLSAYELVEHPDYSCFFGDIMFKAAQKQLGNQADKEQAKPVTNFNAEAVTKNGNQMSYQDEFPDNHFMSCIGSVTGFQDGDVEVTWATGFTTKFMRLLDECGSGES

SEQ ID NO: 142954 - protein, 145 aa, Glycine max
  Coding DNA Sequence Number=SeqID_51269
MTETRVNTLMVTSSGNYGMLHNNKIHLNCQFLGLGHSIKEHGRFGLVCSSSLSGGGNKMKLRVKKKGKQSSSPTMMVALNEGHEAISEESTTVKLLALVAVRNSKDNNKVFANEIVNNLLTIFWPQNQTKGVVLQLVSTQLDPST

SEQ ID NO: 142955 - protein, 171 aa, Glycine max
  Coding DNA Sequence Number=SeqID_51270
  Gene Ontology: Mol. function=transcription regulator activity; Cellular component=nucleus; Biological process=regulation of transcription
  Homolog annotation: Hit_ID=A5C0F4; Match level="QueryCoverage=98%, HitCoverage=99%, E-value=5e-55, Identity=63%"; Hit description =Putative uncharacterized protein
  Pfam annotation: Domain name=HLH; Domain location=8-60; Score=33.6; E_ value=7.1e-07; Accession=PF00010.17; Description=Helix-loop-helix DNA- binding domain
MENNPSSSRTDTKSIEQNRRNQMKDLFSKLNSVVPHQSSRDATSRPDKIGEATNYIKNLQIKLEKMKEKRNNLIDIERSKNASMNMGLKSPQFKIQQMGSALEIVLVTGMDCQFMFNETIRVLQEEGSDIVNASYTVVENAVFHTIHCQVGGSANGALRISEKIKKYLNGC

SEQ ID NO: 142956 - protein, 248 aa, Glycine max
  Coding DNA Sequence Number=SeqID_51271
  Subcellular localization annotation: CTP_CleavageSite=72; ConfidenceScore=5.42e-01
MPASLVGTFPSLGKTTKRVKIPYPFFYSFFDSSPNPTLLFFCHPIGGRRTGTWGRGGGGGGGEEGQKTRLFVARSGRGRRVQEEPFLLDGFLFSSFGCVHNHTGAVFVEGTGTVEGVGYEGRDGAENERGEVEDAGRENLVVFPRRERRNDDVVERVDAEILAERVSSFEELETRLFFDGWDHLDDLLEGGGVGLDKGCRVRVGGFGSGHGLRRNSNCGVAKEQDSRRRGGGGALGGTSESPWLTGRY

SEQ ID NO: 142957 - protein, 329 aa, Glycine max
  Coding DNA Sequence Number=SeqID_51272
  Gene Ontology: Mol. function=structural constituent of ribosome; Cellular component=ribonucleoprotein complex; Biological process =translation
  Homolog annotation: Hit_ID=O48549; Match level="QueryCoverage=68%, HitCoverage=90%, E-value=6e-87, Identity=76%"; Hit description=40S ribosomal protein S6-1
  Pfam annotation: Domain name=Ribosomal_S6e; Domain location=76-209; Score=191.6; E_value=1.9e-54; Accession=PF01092.10; Description =Ribosomal protein S6e
MEPLYYHHHCFLFLRCHHNCSLFLCLKASDSIVSLHGSSSIYLHRRGKLHDLRCGMITRPGKRTKEEKGIFVYSSFQWGCTGSKSGHISPKCKPYPFLSLPSLRRAFWDKRISQEVLGDALGEEFKGYVFKITGGCDKQGFPMKQGVLTPGRVRLLLHRGTPCFRGYGRRNGERRRKSVRGCIVSPDLSVLNLVIVKKGESDLPGLTDVEKPRMRGPKRASKIRKLFNLSKEDDVRKYVNTYRRTFTTKAGKKVSKAPKIQRLVTPLTLQRKRARIADKKKRIAKAKSEAAEYQKLLASRLKEQRDRRSESLAKRRSKLSSAAKPTVTA

SEQ ID NO: 142958 - protein, 145 aa, Glycine max
  Coding DNA Sequence Number=SeqID_51273
MDTSISFVDARAFANSINLLHFLLWFLCLLSLSPSLSSELAESDSELADPESDESELPDSSSDADSEPCFCYSRLRRGISFKYSRRFSVRPPRPMDVKKLMQNRVFFGLSFGNMDSKDSRIVGSFNRSFSSWIPRCSDNSCNIIN

SEQ ID NO: 142959 - protein, 284 aa, Glycine max
  Coding DNA Sequence Number=SeqID_51274
  Homolog annotation: Hit_ID=A7R8E3; Match level="QueryCoverage=68%, HitCoverage=72%, E-value=3e-14, Identity=32%"; Hit description =Chromosome undetermined scaffold_2479, whole genome shotgun sequence
MGCCVSSHKTPTSSSLAKFHDPPKPLIKPSESSSAEEAVKELLLETPKWNPTTFAKSKPQKPHQNTNFHRFKDEKSKVEKRALTLSIYKAEDTTSAEVCSLSETVSTDTSIANQIEETRKRVDTSQPKLQKNRSFPGERRERTVVHGARNNSVGSVKLVQCRDQTAKKIGNGGTRRRRDPTENSLRRSRSPATVSGAGEARPVTGRSPSVKKLDRSTTRIRTGTAENGCRKRENPTTAGKWYSAGDTRWNGRMQVDYDEGRDGLVMQQEGKGGVNGMGDWCGEG

SEQ ID NO: 142960 - protein, 124 aa, Glycine max
  Coding DNA Sequence Number=SeqID_51275
MPKKWARHVPPKEWHKADNTIVTSVSEFAGKGDLGLDVGGAAAAAGGGGGGGEWLRGGAEEALEDGHDEEHGDENGGGDETEGDGVDGAVEVGPMLVSVDVQRRTDWWPRIGDGVVFDQHCCCS

SEQ ID NO: 142961 - protein, 154 aa, Glycine max
  Coding DNA Sequence Number=SeqID_51276
MVQRSCIQVLIKGSAAVADNSISKGLLLPESWKCEHHVSNICLFLITDNQSVALFLKFEWYNPSFVSRGTTSMTVLIKTRLYRFIRQQRRVRGPPSLKLQRTTTVYSPLTLPYCQTTTGEPATDVEMETQQIRVLGVPDVEMDHNNDGSLRTQR

SEQ ID NO: 142962 - protein, 1424 aa, Glycine max
  Coding DNA Sequence Number=SeqID_51277
  Gene Ontology: Mol. function=nucleic acid binding; Cellular component= nucleus; Biological process=response to DNA damage stimulus
  Homolog annotation: Hit_ID=A5AIW5; Match level="QueryCoverage=91%, HitCoverage=97%, E-value=0.0, Identity=47%"; Hit description =Putative uncharacterized protein
  Pfam annotation: Domain name=DEAD; Domain location=579-847; Score= -33.3; E_value=0.013; Accession=PF00270.20; Description=DEADDEAH box helicase
  Pfam annotation: Domain name=Helicase_C; Domain location=1162-1240; Score=83.8; E_value=5.6e-22; Accession=PF00271.22; Description =Helicase conserved C-terminal domain
  Pfam annotation: Domain name=SNF2_N; Domain location=581-973; Score =171.3; E_value=2.5e-48; Accession=PF00176.14; Description=SNF2 family N-terminal domain
  Pfam annotation: Domain name=zf-C3HC4; Domain location=986-1021; Score=0.8; E_value=0.074; Accession=PF00097.16; Description=Zinc finger, C3HC4 type (RING finger)
  Pfam module annotation: Pfam domain module=DEAD::Helicase_C::SNF2 _N::zf-C3HC4; Domain location=579-847::1162-1240::581-973::986-1021
MADADVDLSELFSGNADEDDDMFYIDIQTVQKVLDEDDDCYFQENSPEDSSSKNVSPSESGIHDTFQIQNVTSCSPFCSDVSDFGVRGSVGVSDSAANSMLDCERENQGPQSRACSSPNAFPGNFSDSFSPGESDEVFRTERTQVSKHEIPAYSVETSFPEAQSNNISICGDNLNLSMWIGENESQFKHVREDVESEHASLSSIVDNDDVNIEGYVEDIIAGVSGQQENDSCTSFEASFMDADRSLHVTTSTDSSVGQGSHVSSDFIDYHVSPNCYQGTHDGPFVADSSLGFVPNAINSQLWPYEEMMNNIKAENVELNADIAYMSNGMPSSTTGWMPFQDSQLMLADNGYPSFHSGNFDDMSSLSLSACASYMSYGDHYQNNFHRDDAEFNVGQEVKQTPGIFSSEGCQAYQCFQNEDNYAVISGISNQYQDSIGRTASFQGNFDNLNLKAADNSWLHPQELITSEKQFGCVKREGGIQHNFIDSHLSKGRTENFHVEEDPDVCIIEDISHPAPTSRPAGIGNSLNISQSCRYVGSTVGSTRMKACDERNILRVALQDLSQPKSEVSPPEGLLAVPLLRHQRIALSWMIQKETSSLNCSGGILADDQGLGKTVSTIALILKERPTLLNGCTTARKSELETLDVDDDMLPQNGIVKEESNMCEDKPSGYPMNLLKQAKGRPSAGTLIVCPTSVLRQWAEELRSKVNGQATLSVLVYHGSNRTKDPYEVAKHDVVLTTYSIVSMEVPKQPPADKDDEEKEIFEDHATPSRKRKSPSNSSKSGKKKLDGTNLEAVARPLAKVSWFRVVLDEAQSIKNHKTQVARACWGLRAKRRWCLSGTPIQNAIDDLYSYFRFLRYDPYSDHASFCTRIKNPISRNPANGYRKLQAVLKTIMLRRTKGTLLDGEPIISLPPKYIELKKVDFSMEERDFYSKLEADSRAQFQEYADAGTVKQNYVNILLMLLRLRQACDHPLLVKRYNSNSLWRSSDPPEDAVVSVCGHVFCNQCICEHLSGDDNQCPAANCKSQLSTSMVFSKATLNSCLSDQGCDNSPSCSGPEAEEAEPWSESKPYDSSKIKAALEVLKSLCKPQCYTSKSTSEHSTFREDKNCLGNPSIAKNGKSLKDSPESQNLSDENRSSNASVTVVGEKAIVFSQWTRMLDLLEACLKNSSINYRRLDGTMSVVARDKAVKDFNNCPEVTVIIMSLKAASLGLNLVVACHVLMLDLWWNPTTEDQAIDRAHRIGQTRPVTVLRLTVRDTVEDRILALQQKKRMMVASAFGEDGTGDRQTRLTVDDLKYLFMIEQPLQDIVPNNLNILIGFPEEQQMHHPFINPNRLILTPGLTVQLSTPMQHYEGKTHITEPPIQQIGDPQKLHHSPQPGFGAPGSCEEFEAKWGGEEGGGAFLALLPLLCEDDAGFVIVELWLWFLY

SEQ ID NO: 142963 - protein, 43 aa, Glycine max
  Coding DNA Sequence Number=SeqID_51278
MMQEICGATIMGKTHQYDCSSTSQRFFGILAPKDAWIQCITVM

SEQ ID NO: 142964 - protein, 88 aa, Glycine max
  Coding DNA Sequence Number=SeqID_51279
MTSTTRIFFPEVSDAATTEHRSQNTSKLASLKNMHEPRHQLDSHVRQANGGLHTRDRHEAHPTSIQNPITPPPHFPSASTDTAICYYR

SEQ ID NO: 142965 - protein, 78 aa, Glycine max
  Coding DNA Sequence Number=SeqID_51280
MATSDHAILRDQNHVPTNRSLLELSSQDVLLAQNKLLAKQLESLMETLTKEVNYMGNKHRLGFNTGGFAGYQQGGHFN

SEQ ID NO: 142966 - protein, 121 aa, Glycine max
  Coding DNA Sequence Number=SeqID_51281
MAYERGGDFLEDARKILNREAFPPGGSLVRSPVPAFRFTGVIPLLWPRLSHSTPDTQFRVGSSLQAGLYARTPRSVRPLRLIRHAPVKAKLKGQVLVTALLKPVTSVQECSSETFENRPAG

SEQ ID NO: 142967 - protein, 161 aa, Glycine max
  Coding DNA Sequence Number=SeqID_51282
  Homolog annotation: Hit_ID=A6FJQ2; Match level="QueryCoverage=23%, HitCoverage=84%, E-value=3e-11, Identity=92%"; Hit description=50S ribosomal protein L5
  Pfam annotation: Domain name=DUF1195; Domain location=13-161; Score =52.7; E_value=1.3e-12; Accession=PF06708.2; Description=Protein of unknown function (DUF1195)
MTVKPLTHAVPGDGHSLSVSGCREQTSPSGRVSGCWRMRKEKIPHQAPFAIQAAQLLGRAIGAGLFAITPAGERGMCCKAIKLGNAREVEEREKVVRRMWDVYTQSKSGRGSGLPRFWSDAFHAAYDHLVSDVQSVRDAAVSEIAKISLHSLPLHHLKSHS

SEQ ID NO: 142968 - protein, 51 aa, Glycine max
  Coding DNA Sequence Number=SeqID_51283
MGGGGFGCLGKLPGNHIYKRNLKESWASSSKGNNTKKSSLPWIQTENAIET

SEQ ID NO: 142969 - protein, 68 aa, Glycine max
  Coding DNA Sequence Number=SeqID_51284
MNCVFVHVSSTFEFGAMRSDCLVQFSILNPFSEPHEEEKRRSRDESRHHGKGRTDEISVLSLLSSYLR

SEQ ID NO: 142970 - protein, 298 aa, Glycine max
  Coding DNA Sequence Number=SeqID_51285
  Gene Ontology: Mol. function=beta-lactamase activity; Cellular component=plasma membrane; Biological process=beta-lactam antibiotic catabolic process
  Homolog annotation: Hit_ID=P62593; Match level="QueryCoverage=84%, HitCoverage=88%, E-value=1e-129, Identity=92%"; Hit description=Beta- lactamase TEM precursor
  Pfam annotation: Domain name=Beta-lactamase; Domain location=44-293; Score=178.1; E_value=2.3e-50; Accession=PF00144.15; Description=Beta- lactamase
  Pfam annotation: Domain name=Peptidase_S11; Domain location=41-264; Score=-123.4; E_value=0.038; Accession=PF00768.11; Description=D -alanyl-D-alanine carboxypeptidase
  Pfam module annotation: Pfam domain module=Beta-lactamase::Peptidase _S11; Domain location=44-293::41-264
MAPDAVFSPYASVRPDTRQHPLTRPDGLVCSRHPLTDKLNAGESKDAEDQLGARVGYIELDLNSGKILESFRPEERFPMMSTFKVLLCGAVLSRIDAGQEQLGRRIHYSQNDLVEYSPVTEKHLTDGMTVRELCSAAITMSDNTAANLLLTTIGGPKELTAFLHNMGDHVTRLDRWEPELNEAIPNDERDTTMPVAMATTLRKLLTGELLTLASRPQLIDWMEADKVAGPLLRSALPAGWFIADKSGAGERGSRGIIAALGPDGKPSRIVIIYTTGSQATMDERNRRIAEIGASLIKP

SEQ ID NO: 142971 - protein, 113 aa, Glycine max
  Coding DNA Sequence Number=SeqID_51286
AVRKVDYIGNPRIYAYFQLPKHFVAYYALLVSGCLALYRLSSRVGDKRTRTADIRHRDPATGEPGTESFPRPPFFSARLFALKNTGFYGRSATPGCRRRPWGDLVVPTGWRRW

SEQ ID NO: 142972 - protein, 100 aa, Glycine max
  Coding DNA Sequence Number=SeqID_51287
MLQQEEEASSSKKEDTSSVEEDEEDPFYRNEDDCIESGSMEECRNTSQTFQYKKKEPSSERPFLKNFQRQSLPAILGPGNPIKLNIEQGMWSPREDYGTK

SEQ ID NO: 142973 - protein, 172 aa, Glycine max
  Coding DNA Sequence Number=SeqID_51288
  Homolog annotation: Hit_ID=A6FJQ2; Match level="QueryCoverage=22%, HitCoverage=84%, E-value=3e-11, Identity=92%"; Hit description=50S ribosomal protein L5
MTVKTSDTCSSRRRSQLVCKRMPGADKPVRARQRMRKEKIPHQAPFAIQAAQLLGRAIGAGLFAITPAGERGMCCKAIKLGNARVFPVTTFRETCRASCINESANARGEAVCVLGALPLPRSLTRCARSFGCGERYQLTQRRSFAPSWAVCTNPPLQPTAAPYPVTIVLSPT

SEQ ID NO: 142974 - protein, 270 aa, Glycine max
  Coding DNA Sequence Number=SeqID_51289
  Gene Ontology: Mol. function=helicase activity; Biological process =viral genome replication
  Homolog annotation: Hit_ID=Q9LX60; Match level="QueryCoverage=83%, HitCoverage=13%, E-value=2e-62, Identity=49%"; Hit description =Putative uncharacterized protein F4M19_60
MASITDEIDQIISVKILSQQDDPELYSLVKNHLVHGPCGSLNPRYPCMKKGKCSRFYPKKFQPHTVLDADGFPVYRRRNNGNAIEKNGVIVDNKYIVPYNARLLRKYQVHINIEWCNQSTSIKYLFKYINKGYDRVTTILIDEDNDQTENGGTHNDEIKEYLDCRYISPCESTWRIFGFPIHGRKPVVERLHFHLPGQHSVLYEDHDDIDDVLSKPCISDSKFISWLTPTKILLKGEILLMQDLFLSLYTIRRKDVGSLGRKAIPLADTM

SEQ ID NO: 142975 - protein, 130 aa, Glycine max
  Coding DNA Sequence Number=SeqID_51290
EPNGKDQKVHYLVTTTEGGFMDYQQQCITKRGKLLMSLHCYQASQRPSMTTDRPPLPMSHTDSGIWPNISMCVKTCRCHVCIEQSKNYPTDAILPRKGPVTRTMSNKLQEDWARAVEKGPRVLMNLRVDF

SEQ ID NO: 142976 - protein, 141 aa, Glycine max
  Coding DNA Sequence Number=SeqID_51291
MARTRGLGRAIGRVVGRDRAADEDAGDVPERRRPTASARRLRVHQMTTEGRDMAEDVADMTDDVPEQPTEAPEMHADAQGADSGEGSDGDDAAEGFPGGPRDPSVLTSFAEHVAHAVWSGQERPDLKLVSHGRKLTLIGRP

SEQ ID NO: 142977 - protein, 271 aa, Glycine max
  Coding DNA Sequence Number=SeqID_51292
  Gene Ontology: Mol. function=aspartic-type endopeptidase activity; Cellular component=small subunit processome; Biological process=DNA integration
  Homolog annotation: Hit_ID=A5B4S8; Match level="QueryCoverage=92%, HitCoverage=22%, E-value=4e-36, Identity=35%"; Hit description =Putative uncharacterized protein
AWKTEKVLVADSLEEVNRKLDKFYMVLILKILHSDFDHVRDQVLAGDQIPSMDSLITRLLRVPHLLKDENPTDGVETSTMVVSRGKGSSRNNRGGRSGRGGRPHCTYCKRMGHTQENSYSLHGFPDKEYLKLKSEKPNNQAQSSSVPCVSTACISQSIEGSSPWILDSGASDHISGNKSSFSSFSFPKIPHHVTVANGSKVVSQGNGQEHGTGRLIGEGHESRGIYYLESSPLGACFAISKPKFLHDRLGYPSLPKLKMMVPSLKNLRVLD

SEQ ID NO: 142978 - protein, 52 aa, Glycine max
  Coding DNA Sequence Number=SeqID_51293
MMFLHIKWYQTLNESPIGHNHAQSVEVTSHTTDLGCDGLLEEDENGAKQRIV

SEQ ID NO: 142979 - protein, 26 aa, Glycine max
  Coding DNA Sequence Number=SeqID_51294
MDKGMTLADAPRSSMAFSNLLFPIRQ

SEQ ID NO: 142980 - protein, 43 aa, Glycine max
  Coding DNA Sequence Number=SeqID_51295
MADQQATKSKAKDKQSTSRTHLVAHDPRNLNKTSTSSEGRKIP

SEQ ID NO: 142981 - protein, 90 aa, Glycine max
  Coding DNA Sequence Number=SeqID_51296
  Homolog annotation: Hit_ID=A5AYU6; Match level="QueryCoverage=74%, HitCoverage=12%, E-value=1e-10, Identity=43%"; Hit description =Putative uncharacterized protein
MAFLDSLFFKSIFRNRLFQDHDEDQVNLCLMTKSHDNNKEESVRKKWYIDSGCSKHMTGYVSKFTTISPKKSGHVTYGDNNISKISKKIN

SEQ ID NO: 142982 - protein, 155 aa, Glycine max
  Coding DNA Sequence Number=SeqID_51297
VPSDSGQVLSYTLWENYCLQFLSYLNDIEDERPIVILLTHARIKEAQGSYLASVSNSFKASKLMINDLVLEIQEFRESLLDLGIEVRSILAPIGQRSSQVSGQEFVCVTVAKITTIVMDNYSWCYPACGQCYKKADMQTVLFTCPCGKENDQPVL

SEQ ID NO: 142983 - protein, 118 aa, Glycine max
  Coding DNA Sequence Number=SeqID_51298
MGTNQIGKRFYQVKIKGQDVTSLKELGRLMGPLQMQAFRKAYGKILDLTIAEGFGERVGSCKANSKWRSGPTAEVLGRQGKGYGESRGVGPVCGRISFANLWDCPLSKRGQFGGLSRD

SEQ ID NO: 142984 - protein, 67 aa, Glycine max
  Coding DNA Sequence Number=SeqID_51299
LFPEELWCLPTWMAKSYLHPDFLSVVSLVTIFQRNERGFEAFSPHGQDHLGLPSGMETKHERQKPIK

SEQ ID NO: 142985 - protein, 168 aa, Glycine max
  Coding DNA Sequence Number=SeqID_51300
  Gene Ontology: Mol. function=chlorophyll binding; Cellular component =integral to membrane; Biological process=photosynthetic electron transport
  Homolog annotation: Hit_ID=Q2MI75; Match level="QueryCoverage=100%, HitCoverage=39%, E-value=1e-68, Identity=69%"; Hit description =Photosystem II P680 chlorophyll A apoprotein
  Pfam annotation: Domain name=PSII; Domain location=1-168; Score= -61.3; E_value=6.4e-09; Accession=PF00421.10; Description=Photosystem II protein
MGNIETVLSSSIAAVFFAAFVVAGTMWYGSATTPIELFGPTRYQWDQGYFQQEIYRRVGAGLAENQSLSEAWSKIPEKLAFYDYIGNNPAKGGLFRAGSMDNGDGIAVDGDGIVRADVPFRRAESKYSVEQVGVIVEFYGGELNGVSYSDPATVKKYARRAQLGEIFD

SEQ ID NO: 142986 - protein, 120 aa, Glycine max
  Coding DNA Sequence Number=SeqID_51301
  Homolog annotation: Hit_ID=A7PLR8; Match level="QueryCoverage=35%, HitCoverage=4%, E-value=3e-07, Identity=66%"; Hit description =Chromosome chr14 scaffold_21, whole genome shotgun sequence
MKIEECEVYGQKNGANIRTSDKKHAKVYPMKARNGILDNKIDYLENKIKMVEGELREIATIEAALYSVVADHMALTTGLIALESKTFSCFTLAVVLLTIKDKLFQDKVTAGNTHLRWIGL

SEQ ID NO: 142987 - protein, 211 aa, Glycine max
  Coding DNA Sequence Number=SeqID_51302
  Gene Ontology: Mol. function=intramolecular oxidoreductase activity, interconverting aldoses and ketoses; Biological process=carbohydrate metabolic process
  Homolog annotation: Hit_ID=Q5PJ62; Match level="QueryCoverage=100%, HitCoverage=74%, E-value=1e-116, Identity=97%"; Hit description=L -ribulose-5-phosphate 3-epimerase ulaE
  Pfam annotation: Domain name=AP_endonuc_2; Domain location=3-157; Score=80.4; E_value=5.7e-21; Accession=PF01261.15; Description=AP endonuclease family 2
MCLSAHRRFPLGSEDDAVRAQGLEIMRKAIQFAQDVGIRVIQLAGYDVYYQEANNETRRRFRDGLKESVEMASRAQVTLAMEIMDYPLMSSISKALGYAHYLNNPWFQLYPDIGNLSAWDNDVQMELQAGIGHIVAVHVKDTKPGVFKNVPFGEGVVDFERCFETLKQSGYCGPYLIEMWSETAEDPAAEVAKARDWVKARMAKAGMVEAA

SEQ ID NO: 142988 - protein, 38 aa, Glycine max
  Coding DNA Sequence Number=SeqID_51303
MAFFQSYLDYKAQNAQVSNALGNGNVVHSPDVFSKIPM

SEQ ID NO: 142989 - protein, 195 aa, Glycine max
  Coding DNA Sequence Number=SeqID_51304
  Gene Ontology: Mol. function=GTP binding; Cellular component =intracellular
  Homolog annotation: Hit_ID=A7NT40; Match level="QueryCoverage=37%, HitCoverage=23%, E-value=3e-12, Identity=57%"; Hit description =Chromosome chr18 scaffold_1, whole genome shotgun sequence
MTVKTSDTCSSRRRSQLVCKRMPGADKPVRARQRMRKEKIPHQAPFAIQAAQLLGRAIGAGLFAITPAGERGMCCKAIKLGNARVFPVTTLIPLMLNLGRLGGDPSFGAGMYSSEATLADLHGLIEGAHLGKAVCVLGALPLPRSLTRCARSFGCGERYQLTQRRSFAPSWAVCTNPPFSPTAAPYPVTIVLSPT

SEQ ID NO: 142990 - protein, 84 aa, Glycine max
  Coding DNA Sequence Number=SeqID_51305
MGVQITIFKFLNLALPEKFRIRVAYGGSNPARLGELGDNLLPPFPINRRREAVPKIPNPLGYAFQVFWVKKIVSMKKIQAEVLL

SEQ ID NO: 142991 - protein, 262 aa, Glycine max
  Coding DNA Sequence Number=SeqID_51306
VDSRGSHLAGQQFGEAAGAAGAQIDHHLRHARQAFPVGGVARQANILPRAVFVEQERAAADRLSVDQLLMAFARQRVGVFGGQHRRVVGRQVPQERGVRRLQADLHRVVVELSHALHRIAELQAVEIGVFAAVDVVIRVFLVKYAREAEHYVVGVHLAGGGEPGGGLERHVLAQMEAVGGAVVQHFPALRQLGDQPVGVGIDIQQAIVQLGGQGIHRQAAAGHLRVEGIQYAADAIDKAALANVRQRRRGGRGRCCCGQGGA

SEQ ID NO: 142992 - protein, 47 aa, Glycine max
  Coding DNA Sequence Number=SeqID_51307
MEEGATKVDVGVGAAEVEGSSAGLAPALLAPRIETVRSSGFQQFFLM

SEQ ID NO: 142993 - protein, 76 aa, Glycine max
  Coding DNA Sequence Number=SeqID_51308
MVKQGQDRLGLPFGVKTKHERQKPVKVLKDERKRGWGHDRPIVTLLCAKQAGNVAARQPRILCILQLSFTICLGKE

SEQ ID NO: 142994 - protein, 31 aa, Glycine max
  Coding DNA Sequence Number=SeqID_51309
MGVQIAPRPTWALQNIPPEENLSRGASETFP

SEQ ID NO: 142995 - protein, 313 aa, Glycine max
  Coding DNA Sequence Number=SeqID_51310
  Pfam annotation: Domain name=Fib_succ_major; Domain location=138-275; Score=-68.6; E_value=7.2e-05; Accession=PF09603.1; Description =Fibrobacter succinogenes major domain
MGCFWRGFISDGGATFNDLAIDTLNKYLVLVYSQDGTRVKRISIAGSSQTCTNADPGNNPGDTGCVSFTYKGSQVSYSTVRGKDGKIWLQQNLGSIQVATSMTDEDSYGDLFQWGRWDDGHQKRNSQTVGIPTPNSPDGLTGITSFVTGSWWNANSLTDHWSANNMNAVNSGNGYDPCKAISLDWKMPSQADWAALQSAEVINNPATAYSSTLKLSAGGYRGASTADFTFVGQRGYYWSSTPSAFGAKYFYIGNTIGNPNAGGPRGQGQSVRCVKDVSALSTSEIRLNTISVYPNPTNGIVNIDVDSAIENVQ

SEQ ID NO: 142996 - protein, 59 aa, Glycine max
  Coding DNA Sequence Number=SeqID_51311
MAWSRIVSSHGQKSRQVNGRNQPRYLGMEANGGYGHGQPLSLPSARQTENVAAWQANIL

SEQ ID NO: 142997 - protein, 81 aa, Glycine max
  Coding DNA Sequence Number=SeqID_51312
MYLPIPQAFKIVETDASDKEYIKGTSNSLPDYLMNSYRKMVMPPKASGASLRGGRSTGKGSRLALPELSTKKSSTSSGSPT

SEQ ID NO: 142998 - protein, 111 aa, Glycine max
  Coding DNA Sequence Number=SeqID_51313
MAPKKLSTKRSRRDTVAEGSSAAPEFDSHRFRSAEHQQRFEAIKGWSFHRERRVQLREDEYTNFQEEIARRHWTSLVTPMAKFDPEVVLEFYANAWPTEEGVQDMRSWVKG

SEQ ID NO: 142999 - protein, 49 aa, Glycine max
  Coding DNA Sequence Number=SeqID_51314
MESPTVATCPFVGVRGEAHGAFSKGGKMRGVATNVDKSEALAPTYPPEK

SEQ ID NO: 143000 - protein, 76 aa, Glycine max
  Coding DNA Sequence Number=SeqID_51315
MVAITSARVPQPPFFRGYDSNATCAYHGGVPGHSIKQCMTLKPIGLFAQATCAPKFFDFQDRSIRDYSSCTSMGVP

SEQ ID NO: 143001 - protein, 59 aa, Glycine max
  Coding DNA Sequence Number=SeqID_51316
MTKCPSTTNFSFWWSVEGTTPTEWIHGRPNRQLAYLYWEIDLSPNLSASAVEGPTPGIL

SEQ ID NO: 143002 - protein, 90 aa, Glycine max
  Coding DNA Sequence Number=SeqID_51317
MTNCPSRFDSSFSYEVVKTLGYLYLMPYTGGYRHPRLQRTWGTIKSHPLLEDYTSSPRLYALTLRGLHVLANRGLHALTLRGLHVLANRG

SEQ ID NO: 143003 - protein, 151 aa, Glycine max
  Coding DNA Sequence Number=SeqID_51318
MVVVVGETEGPPKCFQRVYHQLLALQWHIRAKARSQLGCGGEFHVSPPWPDGGIRFTLATTLVAATATIPTSLIFFLLIMASIIVAICSFMASMSAFICSCTFSTSPITIALARGLERMCRNLPFGGRATRDSRDACSTKGIRAESPPTFI

SEQ ID NO: 143004 - protein, 140 aa, Glycine max
  Coding DNA Sequence Number=SeqID_51319
MTEEIITMIVDTLSVFYYEKMVGSMPSSFADLDFTGERIEVGLRRGKFDYPALMDGKLGANGESNKEGGTHVVTIVPTWPNFPPAQQCHYSANIGSSYYPPPYQPRIPNQPQRPPLNQPQGLPAAHTIPNTTLNTNQNTN

SEQ ID NO: 143005 - protein, 69 aa, Glycine max
  Coding DNA Sequence Number=SeqID_51320
MSDNFVSQRALRGRARARLTGALSKGGKMRGVATNVDKSGAFAPTYPPLERKSDLRSSFLSVNQVILFT

SEQ ID NO: 143006 - protein, 164 aa, Glycine max
  Coding DNA Sequence Number=SeqID_51321
VIADAIYLFAGMPRTRHLLDPDKSNRALGFSALITGLCQSFRAQGDAPQGTAAPPPPHQAGPAGSLGMKRYLQHLVRQQAANHRGLVQIHECLYHFSRSQQGQSSTPFVCPTPEQFAAEDAWPGDWSDAQVGEEPTGSPGRMDEPRMDEDMTDLFDFLGGSGAT

SEQ ID NO: 143007 - protein, 103 aa, Glycine max
  Coding DNA Sequence Number=SeqID_51322
SWESKLRSTGRSSKQTNGLHPHSGFTRDSPQISASPHQLDLAPYTSEPYNAQWNAPGLLRDKRTLRSSRILGEMEVDEPWLGLWLPLNYQVDMGASQHRTLEL

SEQ ID NO: 143008 - protein, 53 aa, Glycine max
  Coding DNA Sequence Number=SeqID_51323
MRRKAIKKEDPRRRISLGMTMTHPMVWRRRSNFYPRTMKVMRTSLKKFKRSVW

SEQ ID NO: 143009 - protein, 362 aa, Glycine max
  Coding DNA Sequence Number=SeqID_51324
MSAPEPSLVYSPPPPMDWDQLLAGIGSRTISPPPPDGRKEKKESFSHVEDTQTFRWVPHEGSTDGRKHVSFPCEGSRRTKFQDYTKIHKAWETPLRKDQELRGIRNGIIGGYHEWLKVRIRGLDWLAKLKVVSEENFEAPEEDEDVQALKSELGKAKLAKEKFKLAATHVRKECAGLREENAITARALERETKRARKEEYGRNKFRGALWGSNNELKLRREERDQSRAHSMVLKEELVACSRSKRSLSQRLCETETNMLAIIAKYQEELGLATAHEHRIADEYAQVYAEKEARGRVIDSLHQEETMWMDRFALTLNGSQELPRLLAKAKAMADTYSAPEEIHGLLGYCQHMIDLMAHIIRNR

SEQ ID NO: 143010 - protein, 121 aa, Glycine max
  Coding DNA Sequence Number=SeqID_51325
MVISFHTEGQIQAHNISRRLEIEQSEAAREIQMVITFALGGPILAHNISRSLDIEQWKLLSISNGHNVSLGGPIQGDNISRHSKLNNGSSSRNSNGHNFSHGGQIQAHKISRRSKLNNGSS

SEQ ID NO: 143011 - protein, 70 aa, Glycine max
  Coding DNA Sequence Number=SeqID_51326
MGNVEEAQEQMKADMEAMKEQMATMMEALMSMKKIMEANAVTVAATSAVAKVNPMPPSGLNQMIIQPQLW

SEQ ID NO: 143012 - protein, 122 aa, Glycine max
  Coding DNA Sequence Number=SeqID_51327
MSVHWVYDGRGHMTITRAPRNTGSKQSFTRLEGGHNNQFREWGKGMTISVGSLILAIAHGSYKRLWLDCCYLAQWIVSQLLFSLDLATFIAIAGSLATFFRDMVEEKANALTPTAPTPSPKA

SEQ ID NO: 143013 - protein, 69 aa, Glycine max
  Coding DNA Sequence Number=SeqID_51328
MKSDKAVVAFLGRQFTAIQNLDRRQKPHVQNIPFDTEGKAVNTRRENYAPEVRRFSAEPTEEGLRKSGG

SEQ ID NO: 143014 - protein, 100 aa, Glycine max
  Coding DNA Sequence Number=SeqID_51329
MAAQLIHDRVEMECLEGAWETLEGNTRWEPVHVIEVTSSEEDPEEDLEELPPVDALDFLEGDEDPLPEVDSPEDVMSASEADSTEDSGLGEMAISGGSSS

SEQ ID NO: 143015 - protein, 165 aa, Glycine max
  Coding DNA Sequence Number=SeqID_51330
MDMNMGYLISHQIFLTAQHDTSRLGFPTLITALCKARGVQSDSRSLESLSPAINLAYIKKNYWNLDDPIIAFRGPRKAKGKRSEAPSTSTSEAPIPSSSTLPPSSSTDIPVIPPTPSQIPLPAPLSADASLHAPEHPQRAVHHHADPSGLGLDLHYEHGGVWGIL

SEQ ID NO: 143016 - protein, 160 aa, Glycine max
  Coding DNA Sequence Number=SeqID_51331
  Homolog annotation: Hit_ID=A5B5G7; Match level="QueryCoverage=98%, HitCoverage=10%, E-value=5e-07, Identity=29%"; Hit description =Putative uncharacterized protein
MASKKRKAPSIPTQARFDRSRFTSLEAWERYTDIVVPRKLLLERNVVVYYTEFDEFKKELERRHWDENLTDFSDSSIDITIVKEFYANLYDPEDKSPKQVRVRGHLVKFDEDTLNTFLKTLVVQEEGENLCTYSRFALLRSDPQELAAKLCIPGRGFELN

SEQ ID NO: 143017 - protein, 90 aa, Glycine max
  Coding DNA Sequence Number=SeqID_51332
  Pfam annotation: Domain name=zf-CCHC; Domain location=8-25; Score =21.5; E_value=0.00084; Accession=PF00098.14; Description=Zinc knuckle
MQEKTSSMKCFKCLGRGHITSQCPTKKTMIMRGQDFYSSQDEATTSPFSSESEEEKGEESSEEIYPQEEGQPLMVKEECKEVLLGTKSLK

SEQ ID NO: 143018 - protein, 72 aa, Glycine max
  Coding DNA Sequence Number=SeqID_51333
  Subcellular localization annotation: CTP_CleavageSite=26; ConfidenceScore=5.12e-01
MGIPPTACPSVAYPRCRNVPFYGRARARLTGALSKGGKMRGVSTNVYLWKTSEKPKETGQNENSKFGSCIYA

SEQ ID NO: 143019 - protein, 183 aa, Glycine max
  Coding DNA Sequence Number=SeqID_51334
MQRRSTVGDLIPIDLEINDPCRRRNQERIRNFLHDLEAATIPKEEPQSSKASSSFPIAGHSHIEPFEDTIMAEEPRRVTLEDYSSSNVPQFFTSIAQPEVQAQTITYPPSLIQLIQNNLFHGLPNEDPYPPSLIQLILWFIEKNSHSWILRTDTAQHFYRWVKTAIQAAIGRFCRWKNQIENP

SEQ ID NO: 143020 - protein, 242 aa, Glycine max
  Coding DNA Sequence Number=SeqID_51335
  Subcellular localization annotation: CTP_CleavageSite=56; ConfidenceScore=5.75e-01
MSLSVAANSLAVTSHCCSARFTSTFPQSRSPLLIRTTTRIPRVHGAPRPTLDSRCLLDPVWGAPTGPGLPFDFMLFRSPALGACCCLLPTREGRAAVWIHTDHSCFGCRFMYDDIHDRWMHYSNHIVPVGEVCTVPGQCASDYIDWFFRISHPFKTPSHTSDPPQPRVIPQAPQTDIPHVSEPGAPSTSARLAEEPRHAVKVCHGIAERLERHLSLGVVTPGSSTHEVIEECLRMARSVTQD

SEQ ID NO: 143021 - protein, 98 aa, Glycine max
  Coding DNA Sequence Number=SeqID_51336
CKTRGNPSDLQPFDPEIDRTFHRLVRHHIVAFEHPEHSVIGESEHSVVGNFEHPDFEHYNFEHSENMAQPPPRERTLREMAAPDFTYENLCIQYPDED

SEQ ID NO: 143022 - protein, 195 aa, Glycine max
  Coding DNA Sequence Number=SeqID_51337
  Homolog annotation: Hit_ID=Q6L477; Match level="QueryCoverage=36%, HitCoverage=11%, E-value=4e-08, Identity=32%"; Hit description =Putative uncharacterized protein OSJNBa0009L15.8
  Subcellular localization annotation: CTP_CleavageSite=23; ConfidenceScore=5.54e-01
ASPPASPPPPLPSDASASPCAVKQTRKASRLRSLSARPPGADRLVVHVDPTTGKADDPHRKKLRTYLGIVAGDKVDVTYKNWKQVPTAQKDLIWEDIQAEFEISEASDSRTKKKLLQIVDERWRQFKSNLTRKWALAVDQDGVDDTVCEKYGISKEKIGSVLPNSQRPFLGGCAQKGTGHPEIEHYPPRFVSWGL
